United States Patent 11,098,302 (IDENTIFICATION OF POLYNUCLEOTIDES ASSOCIATED WITH A SAMPLE) - sequence listing, part 12

SEQ ID NO: 38543 - DNA, 842 bp, Homo sapiens
  misc_feature: GYAE6OF02IEPQR.18.14.B03.1.454.CMB.1.raw
  modified_base (156)..(156): a, c, t, g, unknown or other
  misc_feature (156)..(156): n is a, c, g, or t
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
tcagtacgagtatgcacgaccggtgctcgatttagtgtgagtagtttgggctgagctgggttttccttgttgctatttaaaaggtgtccagtgtgaggtgcagctggtggaggtccgggggagcgttggtccagccgtgggggtcctgaactctcngtagcagctcgtggttcacgttcagtggtcctnacgtctatcgacgngtcgggtcccncgacggtccgttaccggggaaaggtcgtaggacggttacggggttcggaccggtttaagttacggaaacgaccgtaaaggtaccttaaaacggtaccggttaacggaccgaacgtaacggtaccgtattaccgtagggtccttacggtaccggttcgggttaaaggtaaacgggtaccgtaccggtttaaccgtaccggttacccttaccgaaacggtaaaacgtttacgtaaacggttaaccgtaaaacggtaaaccgtacccgggtacgttaaccgttcgtacgtaaccgtaaagttacgaacgaacgtccgtaacggaaacggtacgacgtacggacgtgtactactagtaccaacgtctaaccccgtagaaccggtctaaccgtaactaacgtactaaccgtacgtaccggtgtaccgtcgtacgggaccgtaacgggaccgacggtaccgtacccgtacgtcccgtaaacgtccgtaccgtacccgtacggacgggtaccctacggtaccccggttaccttaccccggtacgcccgttccgtaccgccttacccggacgggttaaccgccgtaacccggtacggtaccgtaacggtccgaccggtaccggtcccggtacccgg

SEQ ID NO: 38544 - DNA, 784 bp, Homo sapiens
  misc_feature: GYAE6OF02IB37X.18.14.B03.1.454.CMB.1.raw
tcagtacgagtatgcacgaccggtgctcgatttagtgtgagtagtttgggttcgggggaggcttggtccagcctgggggggtccctgaaactctcctgtgcagcctctgggttcaccttcagtggctctgctatgcactgggtccgccaggtccttccggggaaagggctggaggtgggttggccgtattagaagacaaagctaacaggttacgcgacagcatatgctgcgtcggtagaaggcaggttccaccgtctaccaagtaaatgtattacgaaagaaccgacggtacgtatcgtagacaaatagaacacgaccgtaacggaaaaccggacggaacgaccggtaccgttacgtacgttactagtactacgtacgagggtagtattagtaggttggggtagttacgacggtaacgggtaaccggggggtataccgtacgtactagtggacggtcgggtacggaccggaacgggtacccgacgggttacccgacccgttccgtaccgtaccgaccggtaccctacccgtacccggaaaccgggcccctaacggttcccggttccccttcccccgtaccggtaccccttacccctacccgtaaccgaaccgaccggtacctacccggttaccgggtcggggaccgtaccgacggtcccgggtcccgttcgggtaccgtccgttaccggttacgtaaccggtaacggtaacccttacccgttacctaacccgttaccgtacgtacggtaccggaccgggtccggtaccggtaggacgtaacggg

SEQ ID NO: 38545 - DNA, 892 bp, Homo sapiens
  misc_feature: GYAE6OF02IDFZQ.18.14.B03.1.454.CMB.1.raw
  modified_base (82)..(82): a, c, t, g, unknown or other
  misc_feature (82)..(82): n is a, c, g, or t
tcagtacgagtatgcacgaccggtgctcgatttagtgtgagtagtttgggctgagctgggtttctgttgctatttaaaaggngtccagtgtgaggtgcagctggtggaggtccgggggagtcttggtccagccgtcgggggtccctagaaactctcctgtgcagcctgtgggttccaccttcagtggtctctgtctatgcctacgtcgggtcccgaccgaacgggtccgttaccgggggaaagggcgttagggtacggttgggggttacggaccggttaagttaaggaaacgaacgaaaacgtaccgttaaacgacggtttaaccgcgtaacgacggacaagttaacgttgcgttcgggtaccggttagggtaacggtaaacgggtcgtaccggttacccgtaaccgttaccgtaaccgtaagtaaaagttacggttaaacttacggaaaacgtaaccggaccggttaacgtatccgttaacgaacttaaaacggacgtaacccgtaacgaccggtaaacggaaaaacccgggacgggtacccgtaaacggtaccggttaacgttaacggtttacctaagggttaaaccgttaacggtaaccggtaagggtaagttaacgttaacggttagggtttaaccggggtagtttaacgtacggggtaaaccgggtaacgggggtacctaacggtacgtacgtaagttacggtacgtccggtagggacgtaacgggaccgttaacggtacctccgtaccgttccgacgtaaccgtccaaaccggtaccggtaaccggacccgtacgttaccccgttcccgtaccccgttcgtaccccgtccctaccccgtagaaccggtaccgtaccgcccgggttacggtcccggacctacccggg

SEQ ID NO: 38546 - DNA, 201 bp, Homo sapiens
  misc_feature: GYAE6OF01DR62N.38.13.B02.1.454.CMB.1.raw
  modified_base (186)..(201): a, c, t, g, unknown or other
  misc_feature (186)..(201): n is a, c, g, or t
tcagtcgatcacgtcacgaccggtgctcgatttagtctagcgactttgggtttgacgtttgggtttgggggaagaggaagactgacggtcccccaggagttcaggtgctgggcacagcggccctgggcctgcctggtcaaggactacttcacgtgatcgactgagcgggctggcaaggcgcatagnnnnnnnnnnnnnnnn

SEQ ID NO: 38547 - DNA, 187 bp, Homo sapiens
  misc_feature: GYAE6OF01APCOK.38.13.B02.1.454.CMB.1.raw
  modified_base (185)..(187): a, c, t, g, unknown or other
  misc_feature (185)..(187): n is a, c, g, or t
tcagtcgatcacgtcacgaccggtgctcgatttagtctagcgactttgggtttgactttgggtttgggggaagaggaagactgacggtcccccaggagttcaggtgctgggcacagcggccctgggctgcctggtcaaggactacttccacgtgatcgactgagcgggctggcaaggcgcatagnnn

SEQ ID NO: 38548 - DNA, 572 bp, Homo sapiens
  misc_feature: GYAE6OF01AMYOS.38.13.B02.1.454.CMB.1.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (516)..(516): a, c, t, g, unknown or other
  misc_feature (516)..(516): n is a, c, g, or t
tcagtcgatcacgtcacgaccggtgctcgatttagtctagcgacttccgcggggggggtctcgaggacggcacgcggcttctcaggtacattctccaccatggcctgggctctgctgctcctcacccgtcctcgactcagggcacgagggttcctgggcccagtcttagccctgactcagcctgcctcgtgtctgggtctcctgggacagtcgatcaccngtcctcctgcactggaaccngcagtcgacgttggtgttataactatgtactactggtaccaacaacacccaggccaaacgcccccaaatcagtgatttatggagtcactaatcggccctgtaggggtttctaagtcgtcttcgtctcggctacctaagtcctggacaacgccggtcctcccgtcgacctactctcgtcgggctaccgaggtctagaacggtacgacggtcttagtatttatacctagcagtctacttaagtagaacgaagtacgcgtacttcgtagtcggttcggngggtacggaccaaggtcgtcgaccgtctagtcacgcctaggctcgccctgtctccg

SEQ ID NO: 38549 - DNA, 508 bp, Homo sapiens
  misc_feature: GYAE6OF01DCCPG.38.13.B02.1.454.CMB.1.raw
  modified_base (301)..(301): a, c, t, g, unknown or other
  misc_feature (301)..(301): n is a, c, g, or t
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtaccaacaacacccaggcaaagcccccaaactcatgatttangaggtcactaatcggccctcaggggtttctaatcgcttctctggctccaagtctggcaacacggcctccctgaccatctctgggctccaggctgagacgaggctgattatactgcagctcttatagaagaagtagcactctggtgttcggcggagggaccaagctagaccgtctaagtccagcccaaggctgccccctggtctaccg

SEQ ID NO: 38550 - DNA, 673 bp, Homo sapiens
  misc_feature: GYAE6OF01CIWF8.38.13.B02.1.454.CMB.1.raw
  modified_base (267)..(267): a, c, t, g, unknown or other
  misc_feature (267)..(267): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
tcagtcgatcacgtcacgaccggtgctcgatttagtctagcgactttagggggttgggactagagctctcggagaagagctgcctcgagttaggacccaggaagggaaccttagtcggaaacccctagcgtcagacttcggtcttccgtttcctgcctttacgtcctggggccttacccgagtagtaacccaaccggaagaaaaattgtggtttggacgtcacgtcctcacggctacccttgtctttcgtcctccgaaggggtaacngcctacctctctgcagggccaggtcaggacgtacgtagcagacagctactgcctaggaccagcagaaacctggccaggccnccgaggcctcctcatctacggtnacactcgagcgacggcctacgcgactactaccgaagacgtacgtcgaggtcgcgtaggtgggtacgtagggaaactcttacacttctctacactacgagacgaacggtacgtacggacgtacgtaagtaacgtttacgtttcgagttaaggttagttaacttacgtagtacgtacgtacgttaagtacgttacgtactacgtaaccttacgttaccgttaccggtttaccggtaccggtaacggaaaccgtaaaggttcgtaaactacgtaaaccgtaaacgtacgttcggtaggtcgtacg

SEQ ID NO: 38551 - DNA, 622 bp, Homo sapiens
  misc_feature: GYAE6OF01BBLXC.38.13.B02.1.454.CMB.1.raw
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtaccaacaacacccaggacaaacgcccccaaactcatgatttatgaggtcactaatcggccctcgtagggtttactaagtcgtcttctctggctcaagtctggacaacgaccgcctcctacgacctatctcgtcgggcctccgaggctggacggacgaggtctagtatttattactcgcagtcttacttaagtaagaagtaagtacgtacctaacgttcgttacgggttcggttacgggacggggtaacgggaaccctaaaggtccgttacggtacccgttaccgttaaacggtacccgaacggtaaccccgtaaacgggtccccgttacccggtcccccccgttcgggttcccttaccccgg

SEQ ID NO: 38552 - DNA, 633 bp, Homo sapiens
  misc_feature: GYAE6OF01C96PS.38.13.B02.1.454.CMB.1.raw
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttatactatgtctactggtaaccaacaaccacccgagaccaaacgacccccaaactcatgtatttangagtcaactaatccgccctcgtagggtttctaatcgtcttctctcggtctccgaagtcctaggacaaaccgaccggccctccgtcgacctatcctcgtacgggcctccgaggtctaggacggtacgaggcttaggtaatttacgttaacgttcgcgtaacgtcttacttaagtaagtaaaggtaagtacgtactaacgttcgttgggtcggttaccgggcgggtaacgggaacccgtaaggccgtacgaacccggttaccgtaacgttcccgaacgtaccccgaaacggtcccgtacccggtccccccgttgggtacccttacccg

SEQ ID NO: 38553 - DNA, 586 bp, Homo sapiens
  misc_feature: GYAE6OF01ATD0X.38.13.B02.1.454.CMB.1.raw
  modified_base (369)..(369): a, c, t, g, unknown or other
  misc_feature (369)..(369): n is a, c, g, or t
tcagtcgatcacgtcacgaccggtgctcgatttagtctagcgacttccgcggggggggtctcaggaggcagcgctctcaggacaatctccaccatggcctgggctctgctgctcctcaccctcctcactcagggcacagggtcctgggcccagtctgccctgactcagcctgcctccgtgtctgggtctcctgggacagtggatcaccatcgtcctgcactggaaccagcagtgacgttggtggttatgactatgtctctggtaccaacacaccccgccaacgcccccaaactcatgatttactgaggtcagtaatcggcccgtcggggtttactaagttcggttctcgtgctcgaagtctggccaacnccggccctccctgaccctatcctcgtcgggcctaccgcgcctgaacggacgaggctgattattacgtgcagctcatactactacgcacgctactctacgtttgggtcggttccggggccgggggtaccaacggccgtacggtacccggttacgtacgggtccaccggacccgaacggtccgtaccggtccccccgttcgggtccctaccgttcccgg

SEQ ID NO: 38554 - DNA, 528 bp, Homo sapiens
  misc_feature: GYAE6OF01E0AIF.38.13.B02.1.454.CMB.1.raw
  modified_base (225)..(225): a, c, t, g, unknown or other
  misc_feature (225)..(225): n is a, c, g, or t
  modified_base (454)..(454): a, c, t, g, unknown or other
  misc_feature (454)..(454): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctactggtaccaacaacacccaggcaaagccccccaaatcatgatttatgaggtcactaatcgccctcgagggtttctaatcgcttctctggctccaagtctggcaacacggccctccctgacccatctcgtgggcctccgaggctggaggacgaggctgtattattactgcagtctacttatagaagaagtagctacttntaggtgttcggcggagggaccaagcgtcgaccgtacgtaagcgacgcccgaaggctccgccccctggtctaccg

SEQ ID NO: 38555 - DNA, 550 bp, Homo sapiens
  misc_feature: GYAE6OF01B1QEJ.38.13.B02.1.454.CMB.1.raw
tcagtcgatcacgtcacgaccggtgctcgatttagtctagcgacttccgcggggggggtctcaggaggcagcgctctacaggacatctccaccatgggcctgggctctgctgctcctcaccctcctacactcagggcacagggtcctgggcccagtctgccctgactcagcctgcctccgtgtctgggtctcctggacagtcgatcaccatctcctgcactggaaccagcagtgacgttggtggttataactatgtctactggtaccaacaacacccaggcaaacgcccccaaactcatgatttatgaggtcactaatccggccctcgtaggggtttctaagtcgacttctctggctccgaagtctggcaacacggcctccctgacctatctctggctccgaggctggaggacgaggctagtattatactgcagctcttatagaagtagtagctactcgtggtcgttcgggcgggtagggaccaaggtccgtcggacccgttccgtaagtcgaacgcccgtaaggcctaccggccccctggtccctaccg

SEQ ID NO: 38556 - DNA, 187 bp, Homo sapiens; identical to SEQ ID NO: 38547
  misc_feature: GYAE6OF01CJ63S.38.13.B02.1.454.CMB.1.raw
  modified_base (185)..(187): a, c, t, g, unknown or other
  misc_feature (185)..(187): n is a, c, g, or t

SEQ ID NO: 38557 - DNA, 187 bp, Homo sapiens; identical to SEQ ID NO: 38547
  misc_feature: GYAE6OF01C68N3.38.13.B02.1.454.CMB.1.raw
  modified_base (185)..(187): a, c, t, g, unknown or other
  misc_feature (185)..(187): n is a, c, g, or t

SEQ ID NO: 38558 - DNA, 649 bp, Homo sapiens
  misc_feature: GYAE6OF01AU4WN.38.13.B02.1.454.CMB.1.raw
tcagtcgatcacgtcacgaccggtgctcgattttagtctagcgactttagggtttggggacgacgaagctcctggaggaagagcctgctcagttaggacccagaggaaccatggaaaccccagcgcagcttctcttcctcctgctactctggctcccagatacccaccggacgaaatttcgtagttgacgtcagtctccaggcaccctgtctttgctccgaggggaagacgccacctcgtcctgcagggccagtcagagtcttagctagcagcttacgttagcctggtaccagcaagaacccgtcgggaccaggcctcccgaggcctcctcgatcgtaacggtgccatcccaagccgagggcccacgtcggacactcccaagaccaggttacaaggttcggacaggttcgggtcgtagggaaacgtccttacacttcctacctaccactacgacgacgacgtacgtaggacgtccgtgaacgtagttttgctaggtagttacttacgtacgtacgagtaccgtagttacgttacgttaacctaccgtaccgtaacgttaccgtaccgtttacccggacccgttacgggtaaccgtaaacggttacggtaattaacgtaacgaaaccggtaactacggtacgtcgtaccg

SEQ ID NO: 38559 - DNA, 869 bp, Homo sapiens
  misc_feature: GYAE6OF01DGBYZ.38.13.B02.1.454.CMB.1.raw
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctcgccctgactcagcctgcctcgtgtcgtgggtcctccgtggacagtcgatccaccatcctcctgcacgtggaaccagcagtgtacggttggtagttaataactatgtctacgtgtaaccaacaaccgaccgagacaaaccgaccccaaatcatacgtattataggacgtacaactaacgtccggtacctacgggttaacgggttttactaacgtccgtcctttacgtccgttacgggtacccttaccgtaaacgttccggtacggaccaaaccggtaccccggtccccttacccgacgttaaccctacgttccttccgggtaccgggtcccttacccggaagggtcgtaacgggaacgggtaaccgggtaggtacgtttaagggtaaacttttaacgttaccgttaggtaccctacggtttacccgtttaacgttttaaaacgggaaggtaaaaccggttaaggtaacccgtaccgtttaaaccggtttcggggtttacgggtttaccgggggttacccgggggaaaccgggggtaaaccgggtaaaacccccggaaagggttccccgtttaacggggtaaacccccccggttttaacgggttaaacccggacccggtaaaccccgggtacccccgggtaaaccgggttcccccggtttaaccccccgggcccccccggtttttaaccgggaccccggtttttaacccccccgg

SEQ ID NO: 38560 - DNA, 522 bp, Homo sapiens
  misc_feature: GYAE6OF01DGHG5.38.13.B02.1.454.CMB.1.raw
  modified_base (301)..(301): a, c, t, g, unknown or other
  misc_feature (301)..(301): n is a, c, g, or t
  modified_base (417)..(417): a, c, t, g, unknown or other
  misc_feature (417)..(417): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttataactatgtctactggtaaccaacaacacccaggcaaacgcccccaaatcatgatttangaggtcactaatcgccctcgagggtttctaatcgcttctcgtgctccaagtctggcaacacggcctccctgaccatctctggctccgaggctgaggacgaggctagattacttacngaccagcttacttaatagaagaagtagctactcgtggttcgtcgggcggacgggaccaagcgtacgaccgtctaacgcacgcctagcctcgcccctggtctaccg

SEQ ID NO: 38561 - DNA, 526 bp, Homo sapiens
  misc_feature: GYAE6OF01D36AY.38.13.B02.1.454.CMB.1.raw
  modified_base (225)..(225): a, c, t, g, unknown or other
  misc_feature (225)..(225): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctactggtaccaacaacaccaggacaaacgcccccaaactcatgtatttatgaggtcactaactcggccctgtagggtttctaatcgtcttctctgctcagtctggcaacgcgccctccacgacctatctcgtcggcctccgagctgacggacgaggcgtgtattattacgtgcagtcttacgttaataagaagtagtacgctactcgtggtcggttcggacggaggacagcgtcgacgtctagcacgaccgacgctccgccccgtgtctaccg

SEQ ID NO: 38562 - DNA, 626 bp, Homo sapiens
  misc_feature: GYAE6OF01DC4YH.38.13.B02.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgccactggaaccngcagtgacgttggtgtataactatgtctactgtaaccaacaacacccaggacaaacgcccccaaactcactgatttangagtcatactccgcctgtacgggttactaatcgcttctctggtcctaccgaagtcgtcggacaaccgccggtccctcccctagaccacttctccgtcgggccctccgtaggcctaggacggacggacggcttagtaatttacgttactgctacgtccttactttaagtaagaaagtaaggtaacgtcctacttcggttggttcgggttccgggacgggtaacggaccgtaacggtaccgtcggtaaccccggttaccgtaaaccggtaccgaccgaccccgtaacggtccctacccggtccccccgtggtcccctaccccg

SEQ ID NO: 38563 - DNA, 595 bp, Homo sapiens
  misc_feature: GYAE6OF01AKPIG.38.13.B02.1.454.CMB.1.raw
  modified_base (437)..(437): a, c, t, g, unknown or other
  misc_feature (437)..(437): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtaggttataactatgtctactggtaccaacaacacccaggcaaacgcccccaaactcatgatttatgagtcactaatccggcctcgtagggtttctaatcgtcttctctggtctcaagtctggacaacgccggccctccctgaccatcctcgtcgggcttccgaggctaggacggacgaggtctagtatttacgttacngactacgtccttacttaagtaagaaagtaacgtacgacctacgttcgttgggtacggttacgggcgggaacggaccgtaacggtccgtacggacccgttaccgtacggtacccacggacccgaacggtcctcccggccccccttcgggtcctaacccg

SEQ ID NO: 38564 - DNA, 683 bp, Homo sapiens
  misc_feature: GYAE6OF01EAXZW.38.13.B02.1.454.CMB.1.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (302)..(302): a, c, t, g, unknown or other
  misc_feature (302)..(302): n is a, c, g, or t
tcagtcgatcacgtcacgaccggtgctcgatttagtctagcgacttccgcgggggggtctcagggaggcagcgctctcgaggacatctccaccatggcctgggctctgctgctcctcaccctctcactcagggcacagggtcctgggcccagtctgccctgactcagcctgcctcgtgtcgtggtctcctggacagtcgatcaccntctccngcacgtggaaccagcagtgacgttggtgttataactatgtctactgtaccaacaacaccaggacaaacgcccccaaactcatgtatttangagtacactaatccgcctagtagggtttctaatcgtcttctcgtcggcctactaagtcgtacggaccaaccgacccggtcccttcccgtacgaccctacgttccgttccggtcgggtcccttaccggacgggtacgttacggaacgggtaaccggaacgggttccttaaggttaactttaactttaccgtcggaccgtacgttaccgttactttaagtaaacggtaaaggtaacggtacgaccttacgttcgttcgggtcggttcggggaccgggtaaacgggaccgaacggtccgtaaccgggtacccgtacggttaaacggccgtaaccggaccccgtaacggtcccgtaccccggtcccccgttcggtcccttacccg

SEQ ID NO: 38565 - DNA, 779 bp, Homo sapiens
  misc_feature: GYAE6OF01DZBM3.38.13.B02.1.454.CMB.1.raw
tcagtcgatcacgtcacgaccggtgctcgatttagtctagcgacttccggcgggggggggtctcagggaggcagcgctctcaggacatctccaccatggcctgggctctgctgctcctcaccctcctcactcagggcacgagggtcctgggcccagtctgccctgactcagcctgcctccgtgtcgtgggtctctggacagtcgatcaccatctcctgcacgtacggaaccagcagtgtacggttggtggttaataactatgtctactaggtaaccaacaaaccaccgaaggacaaaacgaccccccaaactacactagtatttaagtaggagtacaactaaagtccggtccctacgtacggggtttactaagtcgtcttctcgtggcctacctaagtcgtaggacaaccgtaccggccctcctacgtaaccctactccgttaccgtcgggcctaccgacggtacgtaggtaacgggaacggacggtacgttagtaagttttaacttaacgtcgactacgtactttaccttaaagttaaacggtaaaggtaaaggttacgtaccgttaaccgtttacgggttacgggtttacggggtacggggtaacggggaaaccgggggtaaaccgaaaacggtaccggttaaccgggttaaccccggtttaaccggtaaaaccggttaccccggaaaccgggtaacccccgggtaaaacgggttcccccggtttaaccccgggtacccccccccggtttagggttaacccccgtttaacccccggg

SEQ ID NO: 38566 - DNA, 569 bp, Homo sapiens
  misc_feature: GYAE6OF01D48GU.38.13.B02.1.454.CMB.1.raw
  modified_base (298)..(298): a, c, t, g, unknown or other
  misc_feature (298)..(298): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttataactatgtctactgtaccaacaacaccaggacaaacgccccaaatcatgatttangagtcactaatcgcctgagggttctaatcgtcttctctggctccgaagtctggaccaacaccggccctccctagaccctatcctcgtcgggcctccgaggcgtggaggacgagctgtatttattacgtgctagtcttacttaagtaagaaagtaagtacgctacttcgttagggttcggttcgggacgggtaagggaccaaggtcgtacggtacccgtaccgtaaggaccacgaccccgaaggtccctaccggccccctcggtcctacccg

SEQ ID NO: 38567 - DNA, 645 bp, Homo sapiens
  misc_feature: GYAE6OF01DEJRT.38.13.B02.1.454.CMB.1.raw
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
tcagtcgatcacgtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatccaccatcctcctgccactcggaaccngcagtgacggttggtagtaataactntgtctatacgtaaccaacaaccaccgagacaacgccccaatcatgtattancgagtcactaatccggtaccctagtagggttactaatcgtcttctcgtgcctactagtcgtcgactaaccgcggtccctacccgtgtacctacgttcgtccggtcggtaccctccgacggtcgtagacggggactacggcttagtatttactacgcgtacacggtcttacgttagaaagtaagtaacgtagctacgtcgttagggttcggtaccgggccgggtaacgggaacctacgggtacgtaccggtaacccggttacgtaacggtacccgtaaccggacccggtaaaccgtccccggttacccggtacccccgttccgggtaccttaccccgg

SEQ ID NO: 38568 - DNA, 697 bp, Homo sapiens
  misc_feature: GYAE6OF01DJ4B5.38.13.B02.1.454.CMB.1.raw
  modified_base (273)..(273): a, c, t, g, unknown or other
  misc_feature (273)..(273): n is a, c, g, or t
tcagtcgatcacgtcacgaccggtgctcgatttagtctagcgacttccggcggggggggtctcaggaggcagcgctctcaggacatctccaccatggcctgggctctgctgctcctcaccctcctcactcgagggcacgagggtcctgggcccagtctcgccctgactcagtcctgcctcgtgtcgtcgggtctaccgtggaccagtcgactcaccgtatctctgcacgtcggaaccagctaggtcgacggtttggtaggttaataactagtntctacgtcgtaaccaacaccaccgaggacaaccgtacccaatcatacgttattagtgacgtacacgtaacgtccgccgttacggttacgggtttacaaggttcttacgtttcctcgttacgtcccgtaactacgttcgtacggaaccgtaacgtacccgtcccgttacgaccgtaacctcgttccgttaccggtcggtaccctccggaaggtcgtacgggaacggtacgggtacgtcttaacgggtacttttaacgtacggtcgacttaagtaccttaagttaacgtaaggaaacgtacggttctaccgaacgtttggttcggttagggaccgggacggttaacggaccgtaggtaccgtactaccggtacgacgtccgacggtaccggaacgtcccggtaccgtcccgtatcccgttacccgg

SEQ ID NO: 38569 - DNA, 852 bp, Homo sapiens
  misc_feature: GYAE6OF01DI7Q6.38.13.B02.1.454.CMB.1.raw
  modified_base (265)..(265): a, c, t, g, unknown or other
  misc_feature (265)..(265): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacgagggtcctgggcccagtctgccctgactcagcctgcctcgtgtcgtgggtctccgtggacagtcgatccaccatcctcctgactactacggaaccagctaggtgtacggtttggttagttaataactntcgtctacgtacggtaaacccaaaccaaccacccgaacggaccaaaccgacccccctaaatctaagtgttaatttagtggtaacggtacctaacgttaacgtccggtcccttacggttacggggtttacctaacgtccgtctttcgtcgtcggtacctaccgtagtcgtacggaccaaccgtcccggtcccttcccgtacgaccctacgttccgttcggtcgggtccctaccggacgggtccgttaaggacgggaaccggtacggtaccgttaacggttaatttttaccgtacgtacgtaccgtaacgttcccgttttaaacgttaaaggtaaacggttaaaggtaacggttaccgttaccgttaaccgttttcgggtttaacgggggttttaccggggtaacccgggggtaaccggggtaaccggggtaaaccgtaaccgggttcccggggttaaaccggttaacccccggttaaaccgggtttaaacccgacccgggtaaacccccgggtaaacccgttcccggggtacccccttaccccccggggtttaccccccggttccgggttaccccctttacccccggg

SEQ ID NO: 38570 - DNA, 655 bp, Homo sapiens
  misc_feature: GYAE6OF01A49E9.38.13.B02.1.454.CMB.1.raw
  modified_base (229)..(229): a, c, t, g, unknown or other
  misc_feature (229)..(229): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccattctcctgcacgtcggaaccngcagtgacggtttggtagttataactatgtctactcgtacaacaaccaccagacaacgaccccaaactcatagtattatgagtacaactaacgtccgtacctcgtacgggttactatcgtcttctcgtcgcctaccaacgtcgtacggcaaacgccggtaccctccctacgacctacgtctacgtcggcctccgacgcgtaggaacggacggacggtctagtaacttacttacgtcgacgtagtacttacgttaagtaaggtaacgtaagtacgtaaccgtacttacggttcggggttaggttaccggggacgggtacgggaaccgtacggtccgtaccggttacccgtaccgttaaccgtacccgtaacccgtacccggtaaccggcccgtaccccggtcccccgttccggtacccgttacccgg

SEQ ID NO: 38571 - DNA, 802 bp, Homo sapiens
  misc_feature: GYAE6OF01BB0H5.38.13.B02.1.454.CMB.1.raw
  modified_base (207)..(207): a, c, t, g, unknown or other
  misc_feature (207)..(207): n is a, c, g, or t
tcagtcgatcacgtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctcgtgtcgtgggtctcctggacagtcgatcacntctcctgcacgtacggaccagcagtgtacggtttggtgttaataactatgtctacgtgtaaccaacaaccaccgagaccaaaccgacccccaaactcagtgtatttagtgacggtacaacttaacgtccggtcccttacggttacgggttttacctaagttccgtctttcgtccgtacgggtcctaccgtaacgtttccgtacggaaccctaaacccgacccgggtcccccttaccccgtacgtaaccccttacgttccgtccggttacgggtcccctaaccggcggggtcgtaagggaacgggacggtacggtacgttacgttaacttttaacgttaccgtcgactaaccggttctttaacgtttaaggtaaaggaaacggttaacggtaccgtaaccgttaccggttacggtttccgggggttacgggttaccgggggaaccggggtaaccgggtaaccgtaaaccggggttccggttaaccccggttaacccggttaaccgttaacccggttaccggaaacccggtacccccgtaaccggggtccccgttacccccggtcccccggtttaccggttccccgttaaccccggg

SEQ ID NO: 38572 - DNA, 619 bp, Homo sapiens
  misc_feature: GYAE6OF01CN7H1.38.13.B02.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacngtcgatcaccatctctgcactggaaccngcagtgtacgttggtgttataactatgtctactgtaccaacaacaccaggacaaacgcccccaaactcatgtattatgagtcaactacgtccgtccctacgtacgggttactaagtccgtctttctcgtcggtcctacctaacgtcgtacggaccaaaccgtcccggtaccccttccccgtacgtaccctacgttccgtccggtcgggtccctaccggacggtcgtagggacggacggacgtcgtagtaattttaacttacgtcgactacgtcttacttaagtaaagaagtaagtacgtactacgttgttggtcggtccgggacggacggactacggcgtaccggtaccgttacgtagcgacgacccgtaggccctacccgccccgtcgtctacccg

SEQ ID NO: 38573 - DNA, 692 bp, Homo sapiens
  misc_feature: GYAE6OF01EMCQ2.38.13.B02.1.454.CMB.1.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgtttggtgttatacgtatgtctactgtaaccaacaacacccaggaccaacgaccccctaaacnctatgtactttagtgtacggtacactaatccggacccttcgtagggttttctaatccgtctttctcgtacggtcttaccaacgtctcggtacaaccgaccgcccttcccgtacgaccctacttcctacggttcgggccttaccggacggtccgtacgggacggacggtacggccttaggtaatttaacgttactcgtacgtacgtactttaccgttaagaaaggtaaagtaagtccgtaaccgtaaccgtttcggttacgggttacgggttcgggacccggggaacgggtaacccgaaggttcccgtaccggtaacccgtcccggttaaacggtacccgaccggaccccggtaaaggtcccgtacccggtcccccgttccgtcccggttaaccccg

SEQ ID NO: 38574 - DNA, 688 bp, Homo sapiens
  misc_feature: GYAE6OF01AXGXR.38.13.B02.1.454.CMB.1.raw
  modified_base (214)..(214): a, c, t, g, unknown or other
  misc_feature (214)..(214): n is a, c, g, or t
  modified_base (239)..(239): a, c, t, g, unknown or other
  misc_feature (239)..(239): n is a, c, g, or t
  modified_base (405)..(405): a, c, t, g, unknown or other
  misc_feature (405)..(405): n is a, c, g, or t
  modified_base (516)..(516): a, c, t, g, unknown or other
  misc_feature (516)..(516): n is a, c, g, or t
  modified_base (546)..(546): a, c, t, g, unknown or other
  misc_feature (546)..(546): n is a, c, g, or t
tcagtcgatcacgtcacgaccggtgctcgatttagtctagcgacttccgcggggggggtcgtcaggaggcagcgctctcaggacatctccacatggcctgggctctgctgctcctcaccctctcactcagggcacgagggtcctcgggcccagtctcgaccctgactcagcctgcctcgtgtcgtgggtctaccgtggacagtcgatccaaccnttcctcgtagcctagtacggaaccngctaggtgtacggttggtacgttaataactagtgtctacgtcggtaacaaactaccaaccgaggaacctaaaccggaccccaaaactcctaggtataagtttactaggacgtactaacctaagtccgtacccgtggtagggttttacaactccgttacttccgttntcggtacctacgtaactcgtacgtaccaaccggaccgtccctacccgtacgtaacctcttacgtccggttcgggaccctacgtccggagttaacggaccggaggtaccggngttacggtactttagttaccgtgtaaccgngtttacttacggttaataacggggtaactaacggtctaaccgtacgttacgttggggtaccgttacgggacgggaacggtaccgtagtcggtacgtaccgtacgtataccggacgcgtacgacgtcccgctaggtcctaccg

SEQ ID NO: 38575 - DNA, 819 bp, Homo sapiens
  misc_feature: GYAE6OF01DXV5K.38.13.B02.1.454.CMB.1.raw
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
  modified_base (377)..(377): a, c, t, g, unknown or other
  misc_feature (377)..(377): n is a, c, g, or t
tcagtcgatcacgtcacgaccggtgctcgatttagtctagcgacttccggcggggggggtctcgaggaggcagcgctctcaggacatctccaccatggcctgggctctgctgcctcctccaccctctcactcgagggcacgagggtcctcgggcccagtcgtcgccctgacctcgacgtcctcgtccgtcgtcgtcgtggtcctcgtacggacacggtcaactccaaccnctccgtccaggacctacgtacggaaccngacgtcggtacggttaggttggggttaattaaacttaacgtagtcgtacgttacgttaacggaaccaaaacgaacgaccgaaggaccaaccgacccaagtcagttatattgagacgtanacgaacgtccggtactacgggttacggttacactcgtccttacgtcgtacgtcccgtaacgtacggtcgaacggtaacctaaccgaccgtccctacggttaaccgactcgttcgtcggtacggtactccggtagtacgtaagggaacccggtaagaccggttagtaaccgttaagtttacccgtacggtacgtaacgtacgtaacgttactaaagggttaaccggaaaattaccggtacggtaaccgttaaccggttccgggtttagggggtacccgggtttaacgggaacccgggggttaacaaacccgggttacgggttaaccggtacccgggttaaacggttacccgttaaacgggacccgaaacccgggtacccgggttacccgggtaccccgttaaccccccgggtaccggtttccccgggaaaccttttccccggg

SEQ ID NO: 38576 - DNA, 873 bp, Homo sapiens
  misc_feature: GYAE6OF01C1Y9R.38.13.B02.1.454.CMB.1.raw
  modified_base (702)..(702): a, c, t, g, unknown or other
  misc_feature (702)..(702): n is a, c, g, or t
tcagtcgatcacgtcacgaccggtgctcgatttagtctagcgacttccggcgggggggggtctcgaggaggcagcgctctcgaggacatctccgaaccatggcctgggctcgtgctgcctcctcacccgtctcactcgagggccacgagggttcccgtgggacccagttcgtcgacccttgacctcacggccttcgccttccggtgtacggttcgggtcctccgtagggtactgtccgtatacccactacgttcctcctacggaccgtagtaccggaaccaggtcctaggtacggtacgttggtagttaaactactagtacgtctacgtaacgaaccaacgaacaccgacgaacctaaacccgtaccccaagttcgtacttagatttagtaacggtccgtactaacgtacgtaccccgtcgttaacgggttaccggttaactaaccgtcggttcctttacgtacgttcccggtacctaaccggttacgtttcggacggaaccctacggtacccggtacccttcggtacctacccgtacttccggtaccgggttacgggtacccgttacggtaccgggtaaccggttaacgggaacggtaccgggttacggtacctttacggggttaactttaaacggttcctaacgggttacgttaaccgttacgttaaacggttaacggttaaagtaagggtttaaacccncggttaacttcccggggtttagggtttacgtcggggggttaacgaaccgggtaaccggtaaccgttacgggaccctttaaaccggggtctaacccggttaaggtaaccccgaaccgggttccctaaaccgggtcccccgttaacgtccccgttaggtttcccgtaccccgg

SEQ ID NO: 38577 - DNA, 734 bp, Homo sapiens
  misc_feature: GYAE6OF01CSXGJ.38.13.B02.1.454.CMB.1.raw
  modified_base (111)..(111): a, c, t, g, unknown or other
  misc_feature (111)..(111): n is a, c, g, or t
  modified_base (242)..(242): a, c, t, g, unknown or other
  misc_feature (242)..(242): n is a, c, g, or t
tcagtcgatcacgtcacgaccggtgctcgatttagtctagcgacttccggcgggggggggtctcaggaggcagcgctctcaggacatctccacatggcctgggctctgctnctcctcaccctcctcactcgagggcacgagggttcctgggcccagtctcgaccctgactcgacgcctcgcctcgtgtcgtgggttcctcgtggacagtcgatccacatcctcctagactacgtacggaacngacgtacggtgtacggttggttacgtaactaacgttcgtcgtacgtacgtacggtaaccaacgtaaccaccgaaggaacctaaaccgtaaccccctaaatccgtaaagttagttactttaacggtcggtaacggttaccctaaacgttaaccggttcccgggttaccgggttttacgggtttactaacggtttccggttactccgtcgacttaccgagtcgtacggaccgtacgccggtcctccagtacctctcgtacggtcgaccctacgtcgacgtaggacgggacgtagtcgttaaagttacttactagccgtaacgtcttctaattctaacgttacgcgactactaccgtacttaccgggttgtttacggggcgggttaaccggggacggtacctacgggttcggacccgtaacggtacgtaccggtaccggaacgaccccggttaacggtccctccggtacccggtcttacccgttcttaccccggg

SEQ ID NO: 38578 - DNA, 695 bp, Homo sapiens
  misc_feature: GYAE6OF01DM5BU.38.13.B02.1.454.CMB.1.raw
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (398)..(398): a, c, t, g, unknown or other
  misc_feature (398)..(398): n is a, c, g, or t
  modified_base (428)..(428): a, c, t, g, unknown or other
  misc_feature (428)..(428): n is a, c, g, or t
tcagtcgatcacgtcacgaccggtgctcgatttagtctagcgacttccgcggggggggtctcaggaggcagcgctctcaggacatctccaaccatcggcctgggctctgcttgccttcctcaccctcctcactcagggcacaggtcctggcccagtctgccctgactcagcctgcctcgtgtctgggtctaccgtgacncgtcgatccaacctntcctcctgcactcggaaccagcagtgtacggttggttacgtaattaactntcgtactactacgtaaccaacaacaccacggacaacnccccaancatgactttanggactacactactccgtcctagtacggttactaacgtctacgttctacgtcgtacctcgtaagtctacggactaacccncggtaccctccgtaacgtaccctagttccnccggtttacggccttacggacgacgtacggacggaacgtaggtccgtatacgtttacttacgcgtacgtacgttacgtacttaagtaaggtaacggaacggttacgttaaccgtcggtttacgggttacgggttcgggttaccgggaacccggttaagggaccctaaaggcccggttaaaccgtaacccggttacgtaacgtaccccgaaacggtaccccgtacggttacccaccccggttcccgtaaccggttcccgttaaccccg

SEQ ID NO: 38579 - DNA, 506 bp, Homo sapiens
  misc_feature: GYAE6OF02FXK6J.38.13.B02.1.454.CMB.1.raw
  modified_base (489)..(489): a, c, t, g, unknown or other
  misc_feature (489)..(489): n is a, c, g, or t
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtaccaacaacacccaggcaaagccccaaactcatgatttatgaggtcactaatcggccctcagggtttctaatcgcttctctggctccaagtctggcaacacggcctccctgaccatctctgggctccaggctgaggacgaggctgattattactgcagctcttatagaagagtagcactctggtgttcgcggaggaccaagcgtgaccgtctaagtcagcccaaggccncgcccccgtcggtcacc

SEQ ID NO: 38580 - DNA, 186 bp, Homo sapiens
  misc_feature: GYAE6OF02GCXFG.38.13.B02.1.454.CMB.1.raw
  modified_base (185)..(186): a, c, t, g, unknown or other
  misc_feature (185)..(186): n is a, c, g, or t
tcagtcgatcacgtcacgaccggtgctcgatttagtctagcgactttgggtttgactttgggtttgggggaagaggaagactgacggtcccccaggagttcaggtgctgggcacagcggccctgggctgcctggtcaaggactacttccacgtgatcgactgagcgggctggcaaggcgcatagnn

SEQ ID NO: 38581 - DNA, 758 bp, Homo sapiens
  misc_feature: GYAE6OF02GT2NK.38.13.B02.1.454.CMB.1.raw
  modified_base (331)..(331): a, c, t, g, unknown or other
  misc_feature (331)..(331): n is a, c, g, or t
tcagtcgatcacgtcacgaccggtgctcgatttagtctagcgactttagggtttggggcaggggagctactgggagaagagctgcgtcagttaggacccagagggaaccagtggaaaccccagcgcagcttctcttcctcctgctactcgtggctcccgagagtacccaccggagaaattcgtgttgacgcacgtctccagggcacccttggtcctttcgtcgtccaggggaaacgagccaccctctcctgcagggccacgtcagagtcttagcgagtcagctacttagcctggtaccagcagaacctggcccaaggctaccaggtctccncgatctaacggtcgccatccgtagcgagggccctacgtcggccgacttccccaaggtacctacggggtttccaaacggttcgggacctacggttggggtacctagggggtaaaacgtccgtttaccgaaccttccgtaccgttccccgtaacgttaccgaacggaccgacggtaaccgttagggtaacgtacccgttaggaacgttagtttttacgccgtaaggtttcgttaacgtttaccgttaggttaccgtaaggttaccgtaaggtttagttaacgggttaaaccgttaccgggaacccttagtttaccgtaccggttttacccgggtacccggttacgggaacccggtaaacggttacgggtaacttaacggttacccgtaaaccgggtaaccgtttacggttaccggtaccgttaccccgg

SEQ ID NO: 38582 - DNA, 502 bp, Homo sapiens
  misc_feature: GYAE6OF02H9AJP.38.13.B02.1.454.CMB.1.raw
  modified_base (296)..(296): a, c, t, g, unknown or other
  misc_feature (296)..(296): n is a, c, g, or t
tcagtcgatcacgtcacgaccggtgctcgatttagtctagcgacttccgcgggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcaccatctcctgcactggaaccagcagtgacgttggtggttataactatgtctactggtacaacaacaccaggcaaagccccaaatcatgatttangaggtcactaatcggcctcagggtttctaatcgcttctctggctccaagtctggcacacgccctccctgaccatctctgggcctccgagctgaggacgaggctgattattactgcagctcttatagaagagtagcactctggtgttcggcggagggaccaagctaggaccgtctaagtcagacccaatcgctcgccccctggtacc

SEQ ID NO: 38583 - DNA, 511 bp, Homo sapiens
  misc_feature: GYAE6OF02F3QMH.38.13.B02.1.454.CMB.1.raw
tcagtcgatcacgtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtaccaacaacacccaggcaaagcccccaaactcatgatttatgaggtcactaatcggccctcaggggtttctaatcgcttctctggctccaagtctggcaacacggcctccctgaccatctctgggctccaggctgaggacgaggctgattattactgcagctcttatagaagtagtagcacttctggtgttcggcggaggaccaaggctgaccgtcctaagtcagcccaaggcctcgcccctggtctaccg

SEQ ID NO: 38584 - DNA, 521 bp, Homo sapiens
  misc_feature: GYAE6OF02HFGJ5.38.13.B02.1.454.CMB.1.raw
  modified_base (302)..(302): a, c, t, g, unknown or other
  misc_feature (302)..(302): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtaccaacaacacccaggcaaacgcccccaaatcatgatttangaggtcactaatcggccctcgagggtttctaatcgcttctctggctccaagtctggcaacacgcctccctgaccatcctctgggctccgaggctgaggacgaggctgatttattacngcagtctcttanagaagagtagctactcgtggtgttcggcggaggaccaaggcgtggaccctacgtaagtcagcccaaggcctccggcccctggtcctaccg

SEQ ID NO: 38585 - DNA, 200 bp, Homo sapiens
  misc_feature: GYAE6OF02IHUOV.38.13.B02.1.454.CMB.1.raw
  modified_base (186)..(200): a, c, t, g, unknown or other
  misc_feature (186)..(200): n is a, c, g, or t
tcagtcgatcacgtcacgaccggtgctcgatttagtctagcgactttgggtttgacgtttgggtttgggggaagaggaagactgacggtcccccaggagttcaggtgctgggcacagcggccctgggctgcctggtcaaggactacttccacgtgatcgactgagcgggctggcaaggcgcatagnnnnnnnnnnnnnnn

SEQ ID NO: 38586 - DNA, 576 bp, Homo sapiens
  misc_feature: GYAE6OF02HLIL5.38.13.B02.1.454.CMB.1.raw
  modified_base (240)..(240): a, c, t, g, unknown or other
  misc_feature (240)..(240): n is a, c, g, or t
  modified_base (360)..(360): a, c, t, g, unknown or other
  misc_feature (360)..(360): n is a, c, g, or t
tcagtcgatcacgtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggnggttataactatgtctactggtaccaacaacaccaggcaaagcccccaaactcatgatttatgaggtcactaatcggcctcagggtttcaatcgcttctctggctccaagtctggcaacncgcctcctgaccatctctgggctccaggctgaggacgaggctgatttattactgcagtctacttataaggaagtaagtacgctaacgttcgtgggttggttccggggacgggtacggggacctaaggtcccgttaggaacccgttaccgttaaaggttacccgaacgaccccgtaagggcccttaccgggcccccccgttacgggtccctaacccg

SEQ ID NO: 38587 - DNA, 622 bp, Homo sapiens
  misc_feature: GYAE6OF02GHEM8.38.13.B02.1.454.CMB.1.raw
  modified_base (226)..(226): a, c, t, g, unknown or other
  misc_feature (226)..(226): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
tcagtcgatcacgtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctactggtaccaacaacacccaggcaaacgcccccaaactcatgtattatgaggtcactaatcgccctgtacgggtttctaatcgtcttctctggtctccaagtctggacaacncgcctcccngaccatctcgtcgggtcctccgaggtcgtggacgggacggtaggcctaggtaactttaattactgtctacgtctttacttaataaggaaagtaaggttagcctacgttcgttgggttcggttacgggcggggaacgggaccaacggtccgttacggaacccggtttaacccttaaacgggtcctaaacgggaccccgtaacgggtcccttacccggtcccccccgttccggttaccctaccccgg

SEQ ID NO: 38588 - DNA, 189 bp, Homo sapiens
  misc_feature: GYAE6OF02I9HVG.38.13.B02.1.454.CMB.1.raw
  modified_base (185)..(189): a, c, t, g, unknown or other
  misc_feature (185)..(189): n is a, c, g, or t
tcagtcgatcacgtcacgaccggtgctcgatttagtctagcgactttgggtttgactttgggtttgggggaagaggaagactgacggtcccccaggagttcaggtgctgggcacagcggccctgggctgcctggtcaaggactacttccacgtgatcgactgagcgggctggcaaggcgcatagnnnnn

SEQ ID NO: 38589 - DNA, 520 bp, Homo sapiens
  misc_feature: GYAE6OF02FXLF3.38.13.B02.1.454.CMB.1.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtaccaacaacacccaggcaaagcccccaaactcatgatttangaggtcactaatcggccctcaggggtttctaatcgcttctctggctccaagtctggcaacncggcctcctgaccatctctgggctccgaggctgaggacgaggctgattatactgcagctacttatagaagtagtagcactcgtggtgttcggcggagggacaacgcgtcgaccgttcgtaagtcgacgcccaacggtcctcgcccctcggtctaccg

SEQ ID NO: 38590 - DNA, 662 bp, Homo sapiens
  misc_feature: GYAE6OF02HP8NB.38.13.B02.1.454.CMB.1.raw
  modified_base (300)..(300): a, c, t, g, unknown or other
  misc_feature (300)..(300): n is a, c, g, or t
  modified_base (455)..(455): a, c, t, g, unknown or other
  misc_feature (455)..(455): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctactggtaccaacaacaccaggcaaacgccccaaactcatgatttangagtcataatcggcctcgtagggtttctaatcgtacttctcgtcggcttaccaagttctacggaccaacgaccggtccctacccgtgaaccctattcctacgtcgggtcctccgaggcgttaggacggaccgaggctagtaatttagtttaccgngacctagtcctagtttaagtaaggaaacgtaaagtacgacctaacgttcgttcgggttaggttaccgggcggggtaaccgggaacccgtaaacggtccgttaacgggtaaccccggtttacccgtaaacggttacccgaaccgggtaccccgaaacggggttcccgttaccccgggtaccccccggttcccgggttacctaacccgg

SEQ ID NO: 38591 - DNA, 539 bp, Homo sapiens
  misc_feature: GYAE6OF02HHATV.38.13.B02.1.454.CMB.1.raw
  modified_base (302)..(302): a, c, t, g, unknown or other
  misc_feature (302)..(302): n is a, c, g, or t
tcagtcgatcacgtcacgaccggtgctcgatttagtctagcgacttccgcggggggggtctcaggaggcagcgctctcaggacatcgtccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtacaacaacacccaggcaaacgccccaaactcatgatttangaggtcactaatcgccctcagggttctactcgcttctctggctccaagtttgcaacgacgcctccctgacctatttcgtgggcctccaggctggaggacgaggtctgtaattttatgtctccgtcatatacgagcagcagcctacccttatcgttcttacggaacgtggaccaggtcaccgtcctacgtccacgacccgaacggacccaaccccgtactcgtacctactcttcccgg

SEQ ID NO: 38592 - DNA, 544 bp, Homo sapiens
  misc_feature: GYAE6OF02HCQC3.38.13.B02.1.454.CMB.1.raw
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctatggtaaccaacaacacccaggacaaacgccccaaaactcatgatttangagtcactaatcggccctgagggtttctaatcgcttctctggtctccaagtctggaccaacacgccctcccngaccctatctctcgggcctccgaggctggaggacgaggctgatttatacngcagtctcttagacgaagtaagtagactacttntgggtcgttccgggaggacggaccaagcgtacggaccctacgtaacgtcacggacccaaggtcctaccggcccctcggtcctaccg

SEQ ID NO: 38593 - DNA, 687 bp, Homo sapiens
  misc_feature: GYAE6OF02I4Y4D.38.13.B02.1.454.CMB.1.raw
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctactggtaaccaacaacacccaggcaaacgcccccaaaatcatgattatgagtacactaacgtccgcctagtacgggtttactaagtcgtacttctcgtcggtacctacgtaacggttctacggaacaaccgtaccggtccctcccgtacgacctacgttcctcggtcgggtcctaccgaggtccgtaggaacggacggaggtcgtagttaactttaacgttactcgaccgtaacgttccttagtttaacgtaaacgggtaaagtaacgttacgaccgtaacgttcggttacgggtttacggtaccgggtacgggaacggtaccgtaaggtacccgtacggtaacccggttactttaaacgggacccgtaaccggaaccccggtaacgggtcccgtacccggtacccccccggttagggtacccttaaccccgg

SEQ ID NO: 38594 - DNA, 556 bp, Homo sapiens
  misc_feature: GYAE6OF02IUUC9.38.13.B02.1.454.CMB.1.raw
  modified_base (379)..(379): a, c, t, g, unknown or other
  misc_feature (379)..(379): n is a, c, g, or t
tcagtcgatcacgtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacaccaggcaaacgccccaaactcatctatttatgacgtcactcactcgcctcgagggtttcactcgcttctctgctctagttgacacgacgcctcctgacctatttcgnggtctcgaggctgaggacgaggtctagtaattttatcgtccttctactatactacgaggcagcacgtcctaaccctttagtcgttacgttacggaacgtcgggaacctaacggtccacccggttcctaacgtccaacgccccgaacggtccccaacccgacgttaccgtacctaccg

SEQ ID NO: 38595 - DNA, 736 bp, Homo sapiens
  misc_feature: GYAE6OF02GLFMB.38.13.B02.1.454.CMB.1.raw
  modified_base (307)..(307): a, c, t, g, unknown or other
  misc_feature (307)..(307): n is a, c, g, or t
tcagtcgatcacgtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctactggtaaccaacaacacccaggacaaacgaccccaaactcatgtatttangaggtcactaagtccgccctcgtagggtttctaagtcgtcttctcgtcggtctacctaagtctcggacaaaccgtaccgggtccccttacccgtacgaaccctaacgttccgttaccggtccggggtaccctccccggtaagggtacccgttacgggaacgggtaaccgggtacgggtaccttaggttaacttttaacgtttaccgttcggaccgtacgtacctttaccttaaagtaacggtaaaacgtaaaggtacgtaccttaaccgtttcgttacgggttcggtttaccggggaccgggtaacggggtaccctaacggtccgttaaccggttaaccccgttaaccggtaaacggttacccgaaccgggtaccccgtaacgggtcccgtaccccggtaccccccgttccgggttaccctaaccccgg

SEQ ID NO: 38596 - DNA, 540 bp, Homo sapiens
  misc_feature: GYAE6OF02FKGA1.38.13.B02.1.454.CMB.1.raw
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
tcagtcgatcacgtcacgaccggtgctcgatttagtctagcgacttccgcggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtggttataactatgtctactggtaccaacaacacccaggacaaacgcccccaaactcatgatttatgaggtcactaatccggccctcgagggttttctaagtcgcttctctggctcagtcngacaacncgcctccnaccntctcgtggcctccgaggctaggacggacgngctgtatttactactgcagtcttattaanagaagtagtanctactgttggtcgttcgggacggaggaccagtcgtacgaccgttacgtaagtccgacgacccgaggcctccggccccgttgtcctaccg

SEQ ID NO: 38597 - DNA, 856 bp, Homo sapiens
  misc_feature: GYAE6OF02JM667.38.13.B02.1.454.CMB.1.raw
tcagtcgatcacgtcacgaccggtgctcgatttagtctagcgacttccgcgggggggtcgtcaggaggcagcgctctcaggacatctccaccatggcctgggctctgctgctccctccaccctcctcactcgacggcacgacggttccgtcggacccacgtcgtccgccctagtacctcgacgccgtcgcctcgttcgtcgtcggtccttcggtacggaacgtcgtcgactaccaacctcttcctcgtcgacctacgtacggaaccagcgtacgtacggtacggtttggttacgttaaacttaacgtagttcgtacctacgttacggtaaccaaaccaaccgacccgaacggaaccgaaaaccccgaaccccctaaaacctactaacgtacgttaagtttacgtaaggaaccggttactaaaccgttaacgtcccggtacccttacgggttaaccgggttttactaaccgttccgttcctttccgtcgtacggtccttaccgtaacgttcgtacgaccgtaaaccggacccgttccctcccgtacccgtaactaccgttccgttacggtcggtaccctaccggtacggtcgtacgggacggtaacggacgttacgtagttaactttacgtttacgtcgtaccgtacgttacgttactttaaacgtaacgggtaaacggttaacggtaacctaccgttaacgttccggtttacgggtttccgggtaccggggtaaggtaacccggggtaacaacggtccggttaaccggtaaccgttacggttaaccgtaacgtacccggtaacccgggtacgtacccggttccccggtaccccggttagggtttacccctacccgg

SEQ ID NO: 38598 - DNA, 611 bp, Homo sapiens
  misc_feature: GYAE6OF02I1KJ6.38.13.B02.1.454.CMB.1.raw
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (451)..(451): a, c, t, g, unknown or other
  misc_feature (451)..(451): n is a, c, g, or t
tcagtcgatcacgtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaccagcagtgacgttggtggttataactatgtctactggtaccaacaacacccaggcaaagccccaaatcatgatttangaggtcataactcgccctgtaggtttactagtcgcttactcgngtctacgaagttccgtggacaacgccggtccctcccgtagaccgtactcctacgtcggtacctcgaacgggtctaggaacgggacgaggcctaggtaatttacgttacncgctagtccttacgttagtaagaaacgttagtacgactcgttcgttggtacggttccgggagggtacgaacccgtagtaccggtacggtacccgttacctaacggtccgaacgtacccggaggtccccgtcccgtacccccggttggtacccttaacccg

SEQ ID NO: 38599 - DNA, 754 bp, Homo sapiens
  misc_feature: GYAE6OF02HEXUD.38.13.B02.1.454.CMB.1.raw
  modified_base (288)..(288): a, c, t, g, unknown or other
  misc_feature (288)..(288): n is a, c, g, or t
tcagtcgatcacgtcacgaccggtgctcgatttagtctagcgactttggtttaggggaaggtcacgataaccaaccacattcctacctcgtaaagaagtcccctgggtagcacagctcatcaaccatggactggacctcggaggttccgtcttttggtggtggcagtcgtacgcttacacggtgttccgagtcccaggtgcagttggtgcagtcgtgggcgtggaggtggaagagtccgtcggtctcggtggaacggtcccctgcgacggcttcgtggagcaccttcngcaccttactacttcagtcgtggtagcgacacggcccgtggaacgtagggccttgacggtcggtacgtggggaggtacgtccgtacccggtagttcggtttcggacctaaaccgtactaaccgtaacgacctaactaacgaaacgtttaccgaacggtaacaacgtaacttacaacgtacgttaccggaacggtaaccgtaacgtacccgaacggacgaccgtaaccgtacgttactaacaagtacggaacgtaacgttaacggaaacgtacgtacctaggtagtaacttcgtaacgaaaccgtacgtaacccgggtaccgttagttaacttttcggtacgttacggacggtaacgggacgggtacggggcccggtaagggggttccgttaggggttacggttaacgggttggttacgtttacggtttaaggtacgttaacgggttccggtaaccggggtaaccgg

SEQ ID NO: 38600 - DNA, 669 bp, Homo sapiens
  misc_feature: GYAE6OF02HXV73.38.13.B02.1.454.CMB.1.raw
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (517)..(517): a, c, t, g, unknown or other
  misc_feature (517)..(517): n is a, c, g, or t
tcagtcgatcacgtcacgaccggtgctcgatttagtctagcgactttagggggttgggactagagctctcggagaagagctgctcagttaggacccagaagggaaccttatggaaacccctagcgtcagacttcggttacttccgtttcccttacgccttacgtcctggggacctacccgagagtaccaaccggtagaaaattagtggttgacgcagtctacctagctacccttgtctttcgtcctccaagggtaacgagacctaaccttctacctcgacgagggaccgaggtccaggacgtacgttagacagacagtctacttagctggtacagcagaacctgacaggctccagctcctnactctacggtncatcagcacgggccacgtggacactacccagacacggtttcaggttggacaggtgggtacgtaggggaaactacgtttcaactcctactaccgtactacgaacgcgaacgaccgttggacgtccgtagaaacgttagttttacgntaagtacgttaattaaccgtgttacgagtctaagtattacggtaactcgaacctatttaccgtacggtttccgacccggttacggtaaccgttaaacggtcggtaacttaacgtaacccgaaaaaggtacccgttaggtacggtactaacgg

SEQ ID NO: 38601 - DNA, 192 bp, Homo sapiens
  misc_feature: GYAE6OF02FO2BR.38.13.B02.1.454.CMB.1.raw
  modified_base (187)..(192): a, c, t, g, unknown or other
  misc_feature (187)..(192): n is a, c, g, or t
tcagtcgatcacgtcacgaccggtgctcgatttagtctagcgactttgggtttgactttgggtttggggggaagaggaagactgacggtccccccaggagttcaggtgctgggcacagcggccctgggctgcctggtcaaggactacttccacgtgatcgactgagcgggctggcaaggcgcatagnnnnnn

SEQ ID NO: 38602 - DNA, 624 bp, Homo sapiens
  misc_feature: GYAE6OF02IZ65Y.38.13.B02.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagtcgatcacgtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgatcaccntctctgcactggaaccngctagtgacgttggtgttataactatgtctactggtaaccaacaaccacccaggacaaacgacccccaaatccatgatttagtgaggtaccacttaatccggcccttcgtagggtttactaatcgtacttctctggcctcgagtctgacaacncgccctccngacctactctcgtggactccgngtcgnggtacggacgtaggtctagtatttaacgttacgtgtacgtactcttaacgttaactaaggtaaacgtaagtaacgacgttacgtcgttacggtcggtttccgggacgggtaacggaccaaggtccgtacggtaacccgttaccggttaacgtccggaacgtacccggaacggtcccgttacccggcccccggttcggaccgttacccccg

SEQ ID NO: 38603 - DNA, 846 bp, Homo sapiens
  misc_feature: GYAE6OF02H9GBT.38.13.B02.1.454.CMB.1.raw
  modified_base (137)..(137): a, c, t, g, unknown or other
  misc_feature (137)..(137): n is a, c, g, or t
  modified_base (231)..(231): a, c, t, g, unknown or other
  misc_feature (231)..(231): n is a, c, g, or t
tcagtcgatcacgtcacgaccggtgctcgatttagtctagcgacttccgcgggggggggtctcaggaggcagcgctctcaggacatctccaccatggcctgggctctgctgctcctcaccctctcactcagggcacngggtcctgggcccagtctgccctgactcagcctgcctccgtgtctgggtctccgtggacaggtcgatccacctatcgtctgcacgtggaaaccngcctagtcgacgttggtgttaataactatcgtactacgtggttaaccaaacaaccaccgacggaccaaaacgacccccctaaaataccgaataggttaatttagtacgaacggttaccaaccgttaaacgttcccggtccccgttacggttaacgggggttttctacggtaacttccggttcctttaccgttaccgaaccgggtcctttacccgaaaacggtttccggtttacgggaaaccctaaacggaaacccccggggtcccccttttccccggaaccggtaaaccctacgtttacccgggtaccggtttcggggtaccccttaaccccggtagggttttaaccggaacggggaaaccggtaacggggtctaaccgggtaaactttaacgtttaggtttccggacccgttacctaccgtaaacctaggtaggtaaacgttcgggtaacggggtttaacggggtttccgggaccgggttaaacggggaaacttaaaccgggttacgtaccccggttacggttacggtaccgaaccggacccgtaacgggtccgtacccgtccccggttacgtaccgtaccgttcccgttccggttcccccgtccttaccccgg

SEQ ID NO: 38604 - DNA, 910 bp, Homo sapiens
  misc_feature: GYAE6OF02HRW0B.38.13.B02.1.454.CMB.1.raw
  modified_base (542)..(542): a, c, t, g, unknown or other
  misc_feature (542)..(542): n is a, c, g, or t
  modified_base (577)..(577): a, c, t, g, unknown or other
  misc_feature (577)..(577): n is a, c, g, or t
tcagtcgatcacgtcacgaccggtgctcgatttagtctagcgacttccgcggggggggggtctcaggaggcagcgctctcaggacatctccaccatggcctgggctctgctgctcctcaccctcctcactcagggcacgagggtcctgggcccagtctcgcccgtgactcagcctcgccttccgtcgtcgtgggtctccgtcggaccaggtcgaatcccaacctaactccttccgtagaccgtacgtacgggaaaccacgaccgtagtacggtacgggtttaggttaagtttaacgtaaactacttcggttaccgttacgtacggtaaaccctaaaaccgaaacccgaaccccggaaacggaaccgtaaaaacccgaaacccccccgtaaaaaccttacgtaaccgttaggtaaaccgttttagtaacggtacgggtaacctaaaccgtaaacgtcccggtaccgtacggttaacggtttactaaacgtcgttacttccgtcgtcgtactacgtaacgtacgtcgaacaacgtaccgtcccncgtacactaacctcgtacgtccgggtcctaccggngtcgtacggaacgggtacgggtaacgtcgttacggtaaactttaaccggttttacgacgttaacgtaaccgttaacttaaccgttagtaaaaggtaaaaccgggtacggtaaaccgtacgttacggttaccggtttcggggttaaggttaacccgggggtaacggggttaacccggggaaacccggttccgggtaaacccgggtcccggttaaaacccggtttcccgggttaaaaccgtaccccgtaaaacccgggtaccccggtaaaacccggggtccccggtttaaccccccgggtaacccccggtacccggttttaaacccggtcccccc

SEQ ID NO: 38605 - DNA, 813 bp, Homo sapiens
  misc_feature: GYAE6OF02GXSJ3.38.13.B02.1.454.CMB.1.raw
  modified_base (338)..(338): a, c, t, g, unknown or other
  misc_feature (338)..(338): n is a, c, g, or t
tcagtcgatcacgtcacgaccggtgctcgatttagtctagcgacttccgcggggggggggtctcaggaggcagcgctctcaggacatctccaccatggcctgggctctgctgctcctcaccctcctcactcagggcacagggtcctgggcccagtctgccctgactcagcctgcctccgtgtctgggtctcgtggacagtcgatccaccatcctcctgctacgtaggaaccagtcagtcggtacggtttgggtacggttaattaacgtattgtctactacggtaaccaacaaccaccgacggacaaaccgtaccccaaactcagtacgtatttaacgnggtacggtactaacgttaacgtccgggtcccttacggtacggggtttactaacggtccgtccgttacttccggtacggtccttaccgtaacggtttcccgtaacgggtaccctaaaccgtacccggttccccttacctaccgtaaccttacgttcccgttacggtccgggttacctccggaacgggtcgttacgggaacgggaccggtacggtaccgttggtaaacttttacggttacgtcggtacgtaccgttaccttaggttttaaacgaagggtttaaacggtaaacgttcgtaaaccgttaccgtttcgggtttaaccgggttcggggttaacggggaccgggtaacgggtaaccggtaacgtccgggttaaccgtaacccggttaccggtaaaccgttccggtaaacccgtaccccggtacggttaccccggttaacccggtcccccggttaaccggtaccccttcccgg

SEQ ID NO: 38606 - DNA, 623 bp, Homo sapiens
  misc_feature: GYAE6OF02GN2GN.38.13.B02.1.454.CMB.1.raw
  modified_base (198)..(198): a, c, t, g, unknown or other
  misc_feature (198)..(198): n is a, c, g, or t
  modified_base (314)..(314): a, c, t, g, unknown or other
  misc_feature (314)..(314): n is a, c, g, or t
tcagtcgatcacgtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctccgtgtcgtgggtctcctggacngtcgatccacatcctcctgcactggaaccagcaggtcgacggttggtaggttataactatgtctacgtcgaaccaacaaccaccaggacaacgtaccccaaactcactatatttanggtacggtcaactagtccgaccgtcgtacgggtttactaactcgtacttcgtcgtcggtacctaccgtaacgttctacggactaacgaccggtccctaccgtcgacctatcctcgtcggctccgaggtcgtagacggacgtacgctagttaattactagtcgactcgtacttctaagtaagaaagtacgtacgctacgttacgtcgggtttacggtacggacggacgggtaccaggtcctaacggtaccgtactaacgtaccaccggtacccgtacggtcccgtaccgtccccggttcgtacgtacccg

SEQ ID NO: 38607 - DNA, 828 bp, Homo sapiens
  misc_feature: GYAE6OF02JT8EG.38.13.B02.1.454.CMB.1.raw
tcagtcgatcacgtcacgaccggtgctcgatttagtctagcgacttccgcgggggggggtctcaggaggcagcgctctcaggacatctccaccatggcctgggctctgctgctcctcaccctcctcactcagggcacgagggtcctcgggccacgtctcgccctgactcacgcctcgccgtccgtgtcgtgggtcctccgtggacagtcgactacaccattcctccgtcgccgtaccgtacggaaacccgagaccgtacggttacggtacggtttagggttaggtttaacttaaactagttcgtacctaacgttacggtaaacccaacgaaccccgaacccgaacggaaccgtaaaacccggaacccccctaaacgtacgtaacgtacgttaactttacgtacggtacggtaacctaactaaccggtccgtacccgtacgggttacgggtttacctaacgtccgttaccgttctacggtcgtacgtaccgtaacgttcgacggtacctaccgacccggttacccgtccgtaccgacgtacctcggtcggtccggtaccgttaccgacgggtaccgtagggaacggtaccgggtacgtcgttaaccgttacgtttaactacccggttcgtaccgtacgttaccgttaacgtttaaggaaacggtaacgtaaacggtccgttaaccttccgttagggttccgggttacggacccggggttaaggggaaccggtaaccgtaaggtacccggttaaccggtaccggttaacgaacggttacccgaaccggtacggtaccgaccgttcccggaccgttccgaccgtttacccg

SEQ ID NO: 38608 - DNA, 499 bp, Homo sapiens
  misc_feature: GYAE6OF01DYT78.10.79.H02.1.454.CMB.1.raw
  modified_base (201)..(201): a, c, t, g, unknown or other
  misc_feature (201)..(201): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcaggccactggcatcccagacaggttcagtggcagtgggtctgggacagacttcactctcaccatcagcagactggagtctgaagatttgctagtgtattattgtcggctaatatggtagtctaccgtgggtactttggccgagggaccagctggagatcgaaacgaatgtgctgcacatntgtcttntac

SEQ ID NO: 38609 - DNA, 522 bp, Homo sapiens
  misc_feature: GYAE6OF01ED9IS.10.79.H02.1.454.CMB.1.raw
  modified_base (358)..(358): a, c, t, g, unknown or other
  misc_feature (358)..(358): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggagggctggagtgggttcatacatttanctagtggtgataccatatactacgcagactctgtgagggccattcaccatctccaggacaacgcaagactcactgactttgacaaatgaacaccctgacgagccgaggacacggccgtatattactgtgacgagtaactaacccgttcgccttggttattaccg

SEQ ID NO: 38610 - DNA, 514 bp, Homo sapiens
  misc_feature: GYAE6OF01BHC75.10.79.H02.1.454.CMB.1.raw
  modified_base (201)..(201): a, c, t, g, unknown or other
  misc_feature (201)..(201): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcagggccactggcatccagacaggttcagtggcagtgggtctgggacagacttcactctcaccatcagcagactggagtctgaagtatttgctagtgttattattgtcgtataattagtggtagtctaccgtgggtacgttttcggccgtaggggaccaagcgtaggagatacgaaacgtatggtcgctgcacatntntcttctac

SEQ ID NO: 38611 - DNA, 656 bp, Homo sapiens
  misc_feature: GYAE6OF01D7KJA.10.79.H02.1.454.CMB.1.raw
  modified_base (256)..(256): a, c, t, g, unknown or other
  misc_feature (256)..(256): n is a, c, g, or t
tcagcatagtagtgcacgaccggtgctcgatttagtgtcacacgaagggaaagggtctgggagaagagccccagccccagaattcccaggagtttccattcggtgatcagcactgaacacagaggactcaccatggagtttgggctgagcggtcgtttcgtcgtaggcgtactataaaggtgtcagtgtcaggtgagctggtgagtcgtggggaggcgtggtcaagccgtggagggtcctgagactctcctgtgcngctcgtgtgtcgtctcgtgtagtgtacgttcgtagtacgtactactactacgtacgtaccgtccggtccggccgacggccgtccggacgggacgggtacggtggtaggttggttcgtagtactattacgtcgtagtagtagtactactatactactacgacacgtacgtcgtagtaggacggtacgtactactactactacgtaccgaccggaaccgaaccgaaccgaacgtaacgtaccgtacgtacgttacgttacgtaacgtaacgtaacgtaaccgtaccgtacgacgaccggacggacggaaccgaccgtacgtacgttacgttacgtagtacggtacgtaacgtaaccgttaacccgttaccgttaccgttacgtttacgttacgttacgtacg

SEQ ID NO: 38612 - DNA, 576 bp, Homo sapiens
  misc_feature: GYAE6OF01CQU3N.10.79.H02.1.454.CMB.1.raw
  modified_base (239)..(239): a, c, t, g, unknown or other
  misc_feature (239)..(239): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (539)..(539): a, c, t, g, unknown or other
  misc_feature (539)..(539): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcggtggtttcgtgtaggcgtattataaaggtgtcagtgtcaggtgaagctggtggagtcgtggggaggcttgggtcaagcctgggnggtcctgagctctcctgtgcagcctgtggactttccggccttctggtattggacgtttcagttgactactacattgaccgtgggtcccgcgaggtctccgaggggacgggctgggagtggtttcattacatttacnctagtggtnatccgtatatactacgcaagtctctgtgaacgggccattccacgtatccacgaggtaccaacgccaagactcacgtcgtacttaggacctaagtcaaccgtccctgaccgtacgcccgtaaggacgaccggtacctatagttacgtgtcgaacgntaaaccgttcccgttagtccgttggtttacttacccg

SEQ ID NO: 38613 - DNA, 531 bp, Homo sapiens
  misc_feature: GYAE6OF01BVHM8.10.79.H02.1.454.CMB.1.raw
  modified_base (320)..(320): a, c, t, g, unknown or other
  misc_feature (320)..(320): n is a, c, g, or t
  modified_base (462)..(462): a, c, t, g, unknown or other
  misc_feature (462)..(462): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctctggattcgcctctggattgacgttcagtgactactacatgacctgggtccnccaggctccgagggagggctgggagtgggttcatactatttatcctagtggtgataccatatactacgcagactctgtgaacgggcctattcaccatctcgagggacaacgccaagactcactgactttgacaatcgaaccncctgacgagccgaggaccacggccgtatattacgtgtgcgagaactacccgtgccttggttacttaccg

SEQ ID NO: 38614 - DNA, 894 bp, Homo sapiens
  misc_feature: GYAE6OF01C8WDV.10.79.H02.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctccagataccaccggagaaattgtgttgacgcagtctccaggcaccctgtctttgtctccgaggggaaangccacgctctcctgcgagggccagtcagagtctagcagcaactacgttgcctaggtaaccaacaacgaaacctggaccaggcctcccaggctcctcatctacgaagcactccaccgacgggccacgtcggccgtacccgacgcccgtagggttccgagttcgggaccgtaagggttcgggggtacctacgggggaactaacggttaccgtttaccaaccgttccttacccgaacccgtaattaccaacggtccgaacgggtccccgttaggggaaccgtacccgttaagggaaagttacgtttaagtttaccggttaacgtttaacgggtttttttaattttaaggttttacggtaaccgtaacggtaccgtaacggggtaccgtttaacggggaccgttaacggggggtttaccggttaccccgttttttaccggtaacccggggttttttacccccgggggaacccccgggggggttaaacccgttaaaaagggggttaaccgggttaaaaaccgtttaaacccgggtaaaaaaacccggggttaaacccggtttacgggggtaccggggttaaaccctttaccgggggtaaaccccttaaccccgggtttaaacgtttccccggttttaacggttttacccctttttaacccggtaaacccgtttttccccccgggtttaacccccccgg

SEQ ID NO: 38615 - DNA, 510 bp, Homo sapiens
  misc_feature: GYAE6OF01CYM48.10.79.H02.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaangccacgctctcctgcagggccagtcagagtcttagcagcaactacgttgcctggtaccaacagaaacctggaccaggcctcccgggctcctcatctatggtacatctagcagggccacgtggcatcccagacaggttcagtggcagtggtctgggacagcttcactctcacatcagcagactggagtctagtaagtattttgctagtagttattattgtcagctaatagtggtaggtactacgtgggtactttggaccgagggaccaagctggagagtacaaacgtatggtagctgcacatctgtctac

SEQ ID NO: 38616 - DNA, 518 bp, Homo sapiens
  misc_feature: GYAE6OF01E373R.10.79.H02.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcagggccactggcatcccagacaggttcaggtggcaggtgggtctgggacagacttcactctcaccatcagcagactggagtctagtaagtatttgctagttgttattagttgtcggctaatagtggtaggtctaccgtgggtacgttttcggcgtagggaccaagcgtggagagtacgaaacgtatggtgcgtgcacatctgtctctac

SEQ ID NO: 38617 - DNA, 585 bp, Homo sapiens
  misc_feature: GYAE6OF01C0BFB.10.79.H02.1.454.CMB.1.raw
  modified_base (201)..(201): a, c, t, g, unknown or other
  misc_feature (201)..(201): n is a, c, g, or t
  modified_base (390)..(390): a, c, t, g, unknown or other
  misc_feature (390)..(390): n is a, c, g, or t
  modified_base (409)..(409): a, c, t, g, unknown or other
  misc_feature (409)..(409): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaancgccacgctctcctgcagggccagtcagagtcttagcagcaactacgttgcctggtaaccaacaacgaaaccgtggacccgaggcctcccggggctcctcactctatggtacatctagcgagggccagtggcactcccagacgtaggttcaggtggctaggtcggggtctggggactagtacctttacnctacaccatcagtcgatcngcacgcctagacgttatttcgcctactttactacttgacctaacgtcgtaccgtttacccgggtaacccgtttacgttcgggaccgggtacgggtacgtaagggtggacgactacgaaacgtacgtggtcggactggaccactgtccttgtctactactccttacccgctattccg

SEQ ID NO: 38618 - DNA, 533 bp, Homo sapiens
  misc_feature: GYAE6OF01CY9ZS.10.79.H02.1.454.CMB.1.raw
  modified_base (202)..(202): a, c, t, g, unknown or other
  misc_feature (202)..(202): n is a, c, g, or t
  modified_base (521)..(521): a, c, t, g, unknown or other
  misc_feature (521)..(521): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccacgctctcctgcagggccagtcagagtcttagcagcaactacgttgcctggtaccaacagaaacctggccaggctcccgggctcctcatatatgaacgcctcttccagggccacgtggactcccagccaggttcagcggcggtggtctggggacaggactttcactcctcacctatcagcagcctagcagtctggacggtaccttgggacttttatacttggtactagcagtactcattaactggtcctcggtgacgttcgacgaacgggacaggtcgacctacgaaaccgatgcggctggccactatctctcttnactccgtccacc

SEQ ID NO: 38619 - DNA, 585 bp, Homo sapiens
  misc_feature: GYAE6OF01AYTAS.10.79.H02.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccacgctctcctgcagggccagtcagagtcttagcagcaactcgttgcctggtaccaanagaaacctggccaggcctcccgggctcctcatctatggtacatctagcagggccagtggcactcccagactaggttcagtggcaggtgggtctgggactagtacttcacgttctacacctatcagcagacgtggagtcgtagtaagtatttgactagttgttattagttgtactagtactaagttagtggttagtaccgtacgttacgggttacgttttacgggaccggtacggggaaccaaggtacgtagggaacgtaacgtacgtaaacggtaacgtcggtcggtacgtacgtaccaccgtacttcgttgttcgttaccg

SEQ ID NO: 38620 - DNA, 566 bp, Homo sapiens
  misc_feature: GYAE6OF01BHJ1W.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggcctcccgggctcctcatctatggtacatctagcgagggccactggcatcccagacaggttcaggtggcaggtgggtctggggacagtctcactctcacctatcagacagactggagtcgtagaagtatttgcgtagttgttatttagttgtcggactaattagtgggtacgttcacgttcgggtacgttttcggccgtaggggaccaaggtcgtaggagtacgtacgaaacggtacgtaggtcggcgttggacctaccgtacttaccgttgttccctttcgtaacccg

SEQ ID NO: 38621 - DNA, 771 bp, Homo sapiens
  misc_feature: GYAE6OF01CV86E.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccactggagaagtagtgatgacgcagtctccagcccaccctgtctgtgtctccgaggggaaacagccaccctctcctgcagggccagtcagagtgttggcagcaggttagccgtggtaccagcaaggaaacgtggccaggctccgaggctccgtcgtatacgtggtgctactcccaaccgacgggccctaacgtcgggtaactccccgaaggtccccgtagggtttaccgaaggttcgggaccgtaggggttcggggttacgtacgggggaacctaagggtacggttttcccggcttacccgttccgaaaccctaagttcccgaaaggtccgtaacggtttcccgtcggtaaccctaagggtttcccgttaaggtaaaacggtttacgttttttacggaaccgttttaaggttttttaaacgtttaccgtttgggttaaccgtaaaggggtaaattttagtaggtaacggttcgggttaacccgttcggggttacccttaccggtttaaccgtttacggttttaccggaaccgtaaaacggggtacccttaagggttcgggaaacctaacgtaaccgtaaaacggttacgtcggttacggaccgttggaaccctactaacgtttcttacgg

SEQ ID NO: 38622 - DNA, 534 bp, Homo sapiens
  misc_feature: GYAE6OF01AWGXK.10.79.H02.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggcctcccgggctcctcatctatggtacatctagcagggccactggcatcccagacaggttcagtggcagtgggtcagggacagacttcgactctacaccatcagcagactggagtctagaagtatttgctagtgtattagttgtcgagctaatagtggtaaggtctaccgttgggtactttggaccgtacgggaccgaagtccgtaggagacgtcgaaacgtacgtggacggtctacgtacactacgtcttgtcttacg

SEQ ID NO: 38623 - DNA, 579 bp, Homo sapiens
  misc_feature: GYAE6OF01C0NUU.10.79.H02.1.454.CMB.1.raw
  modified_base (297)..(297): a, c, t, g, unknown or other
  misc_feature (297)..(297): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcacctgtctttgtctccaggggaaacagccaccctctcctgcagggccagtcagagtgtggcagcaggttagcctggtaccagcagaaacgtggccaggctcccaggctcctgtatagtggtncatcccaccgagggccacgtggtactctcgaggctagggttccgtggctaggtcgggtctggggacagtgttcacgtcgtccactatcaagccagtcctgcagtctaggaagttattttgactagtttatactgtcagtcaagtataatgcgtcggcccgcgtaccggttcggaccgtaagggtacctaagggtacggtaactttaccgaaacggtaacgttcgggtggcttacgacctaaccctattccgttacgttccttaccacgtttcccttaccccg

SEQ ID NO: 38624 - DNA, 523 bp, Homo sapiens
  misc_feature: GYAE6OF01ADUGK.10.79.H02.1.454.CMB.1.raw
  modified_base (202)..(202): a, c, t, g, unknown or other
  misc_feature (202)..(202): n is a, c, g, or t
  modified_base (416)..(416): a, c, t, g, unknown or other
  misc_feature (416)..(416): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccacgctctcctgcagggccagtcagagtctagcagcaactacgttgcctggtaccaacagaaacctggccaggcctcccgggctcctcatctatggtacatctagcagggccactggcatcccagacaggttcagtggcaggtgggtctgggacagacttcactctcaccatcagcagactggagtctagaagtatttgctagttgttattnttgtcagtcaatagtggtagtcgacgttgggtactttgggaccgagggaccagtcgtaggagagtcgaaacgacgttggcggtactgaccactatccttgtcttacg

SEQ ID NO: 38625 - DNA, 584 bp, Homo sapiens
  misc_feature: GYAE6OF01DINJK.10.79.H02.1.454.CMB.1.raw
tcagcatagtagtgcacgaccggtgctcgatttagtgtcacacgaagggaaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaaggcctgggagggtccctgagactctcctgtgcagcctctggattccgcctctggattgacgttcagtgactactacatgaccgtgggtccgccaggctccgaggggaggcgtgggagtgggtttcatacgtatttatcgtagtggtgataccatatactacgcagactcgtgtgaagggccattcacctatcctccagggacaaccgaccaagacctcactgactttgactaagtcgaaccacccgtgaccgacgacccggaggaccgaccggtaccgttaatacgttaccgtgtacggacgaacgtaaaccgttaaccccggttcgtaccttgggtttactttacccgg

SEQ ID NO: 38626 - DNA, 557 bp, Homo sapiens
  misc_feature: GYAE6OF01A2R4W.10.79.H02.1.454.CMB.1.raw
  modified_base (447)..(447): a, c, t, g, unknown or other
  misc_feature (447)..(447): n is a, c, g, or t
tcagcatagtagtgcacgaccggtgctcgatttagtgtcacacgaagggaaaggggtctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttgggtcaagcctggagggtccctgagactctcctgtgcagcctctggattcgcctctggattgacgttcagtgactactacatgacctgggtccgccaggctccgagggagggctggagtgggtttcatactatttatcctagtggtgataccatatactacgcagactctgtaggaacgggccgattccacctatctaccgaggaccaacgccaaagactcactnactttgacaatcaacaccctgacgacgccgaaggacacggccgtaatacgttactgtacgcgaagtaacgtaaccccgttcggcccttaggttacttaccgttggtaccg

SEQ ID NO: 38627 - DNA, 557 bp, Homo sapiens
  misc_feature: GYAE6OF01CCFOQ.10.79.H02.1.454.CMB.1.raw
  modified_base (317)..(317): a, c, t, g, unknown or other
  misc_feature (317)..(317): n is a, c, g, or t
  modified_base (441)..(441): a, c, t, g, unknown or other
  misc_feature (441)..(441): n is a, c, g, or t
  modified_base (509)..(509): a, c, t, g, unknown or other
  misc_feature (509)..(509): n is a, c, g, or t
tcagcatagtagtgcacgaccggtgctcgatttagtgtcacacgaagggaaaggggtctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtctgggggagcttgggtcaagcctggagggtccctgagactctcctgtgcagcctctggattcgcctctggattgacgttcagtgactactacatgaccgtgggtccnccaggcctccgaggggaaggggctgggagtgggtttcagttacattttatcctagttggtgaataccatatactacgcagactctgtgaagggccattcacatctcagggacaacgccaagacncactgtactttgacaaatgaaccacccgtgacgacgccgaggaccgacggccgtaatacgttacgtgnggcgagaacttaacccgttcgacccttggtttattcccgttgtaaccg

SEQ ID NO: 38628 - DNA, 577 bp, Homo sapiens
  misc_feature: GYAE6OF01BIB72.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttgggtcaagcctgggagggtccctgagactctcctgtgcagcctctggattcgcctctggattgacgttcagtgactactacatgaccgtgggtccgccagggctccgagggagggctgggagtgggttcatactattactctaggtggtgactaccatatactacgcagtactctggtagaacgggtccgtattccacctactccgtaccgagggaccaaccgaccaagaactcacgtgtactttagactaaactcgaaccacccgtgaccgacggaccggacggaccgacggtaccgtattagttactggtcgacgaacgtaactacccgttacgccttggttacttaccg

SEQ ID NO: 38629 - DNA, 570 bp, Homo sapiens
  misc_feature: GYAE6OF01EL73Z.10.79.H02.1.454.CMB.1.raw
  modified_base (186)..(186): a, c, t, g, unknown or other
  misc_feature (186)..(186): n is a, c, g, or t
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (318)..(318): a, c, t, g, unknown or other
  misc_feature (318)..(318): n is a, c, g, or t
  modified_base (376)..(376): a, c, t, g, unknown or other
  misc_feature (376)..(376): n is a, c, g, or t
  modified_base (468)..(468): a, c, t, g, unknown or other
  misc_feature (468)..(468): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttctgtgctatataaagtgtcagtgtnaggtgaagctggtggaggtcgtgggggagcttggtcaagcctggaggtccctgagactctcctgtcgcagccctntggacttccgcctctggtattgacgttnagtgactactacatcgaccgtgggtcccncaggctcgaggggacgggctgggtagtggtttcattacgtatttactcgtagtggtanactacatactactacgcagtactgtggtacggaacggtcctattaccaactctccacgacggaccaacgaccaacgactcatactacgttanaactaacgtacaacccncgngacgacgccgacgaccgaccgtacgttaatatcgtgtacgacgaacgttaaccgtacccgttccgtacgttcggttactacg

SEQ ID NO: 38630 - DNA, 586 bp, Homo sapiens
  misc_feature: GYAE6OF01ECF0N.10.79.H02.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccacgctctcctgcagggccagtcagagtctagcagcaactacgttgcctggtaaccaacacgaaacctcggccaggcctcccgggctcctcatctatggtacatctagtaggccagtggcatcccagacaggttcaggtggcaggtgggtctgggacaggtacttcactctacaccatcaagcacgactggtagtgtagaagttagtttagacgtagttagttaatttattgtacagtactaagttagtggttaaggtccgtaaccggttgggttacgttttcgggaccggtacggggtaccgtaaggtcgtagggaagtagtaacgaaaccggtaacgtggtcggctacgaccgtaactacgtacttcgttcttcctaccg

SEQ ID NO: 38631 - DNA, 524 bp, Homo sapiens
  misc_feature: GYAE6OF01BGEIZ.10.79.H02.1.454.CMB.1.raw
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctgggtccncaggctccgagggagggctggagtggttcatacattatctagtggtnataccatatactacgcagactctgtgaagggccatcaccatctccgaggacaacgccaagactcactgtactttgacaaatgaaccaccctgccgagccgaggaccacggcctatattactgtgacgagtaactacccgttgccttggttacttaccg

SEQ ID NO: 38632 - DNA, 491 bp, Homo sapiens
  misc_feature: GYAE6OF01DKA2D.10.79.H02.1.454.CMB.1.raw
  modified_base (354)..(354): a, c, t, g, unknown or other
  misc_feature (354)..(354): n is a, c, g, or t
  modified_base (464)..(464): a, c, t, g, unknown or other
  misc_feature (464)..(464): n is a, c, g, or t
  modified_base (466)..(491): a, c, t, g, unknown or other
  misc_feature (466)..(491): n is a, c, g, or t
tcagcatagtagtgcacgaccggtgctcgatttagtgtcacacgaagggaaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacgttggggccagggaaccctggtccaccgtctcctcagcctccaccaagggcccagtccggtcttccccctggccgccctgcctccgaggcgccacctccgacgngaccacgacggccggccctgggccttcggccctcggtccaaacggtacctaccttacccacttactagttcgactggacgcgggtctgggaccaagggcgacgtataggngnnnnnnnnnnnnnnnnnnnnnnnnnn

SEQ ID NO: 38633 - DNA, 676 bp, Homo sapiens
  misc_feature: GYAE6OF01CFLNO.10.79.H02.1.454.CMB.1.raw
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggagctttggtcaagcctgggacgggtccctggacgactctcctgtgcagcctctggtacttccgccttcgtggattgacgtttcagtcgtactactacntcgaccgtgggtccncgaggctaccggagggggtacgggcgtgggaggttgggtttcaattactatttactccgttagtcggtagtactacctatactacgtacgctagtactcgtggtaggaacgggtccgtaatttccaacctatcccgtaccgaacgggaaccaaaccgaccaaagtaacctccgaacgttgtaaccgttttagaacctaaaacgttcgaaaccctaccccgtaggaccgaacggacccggaagggacccgaaccgggtacccttaagttacgttacgtggttacgacgtaacggtaaacccgttacccccggttagtccccgtttagggttttaccttacccg

SEQ ID NO: 38634 - DNA, 653 bp, Homo sapiens
  misc_feature: GYAE6OF01DMBIP.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcgttggtcaaggcctgggacgggtccctgacgactctcctgtcgcacgcctcgtggactttccgccttcgtggtattggacgttcaggttcgacttactacagtcgacccgttcgggtcccgccagggtccctaccggaagggggaacggggtcgttagggtagttcggggtttcaagttactatttacgtccgtaggtggtagtaactaccatactactacgctagtctcgtggtacggaacgggtcctattccaacctatcctaccgagggtaccaaccgaccaagacctcactacgtactttacgaactaaacgtacgaacctacccgtagacgacgaccggaaggaccgtacggtacgttattattacgtggtacgacgtaacgtaaccgttaacccggttcgtacccgtttaggttaaccttaccg

SEQ ID NO: 38635 - DNA, 615 bp, Homo sapiens
  misc_feature: GYAE6OF01A53XA.10.79.H02.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggccaccctgtctttgtctccgaggggaaangccacgctctcctgcagggccagtcagagtcttagcagcaactcgttgccttggtaccaacagaaacctggaccaggcctcccgggctcctcatctatggtacatctagcagggccactggcactcccagactaggttcaggtggcaggtgggtctgggacagacttcactctcacatcagcagactggagtcgtagtaagtatttgcttagtttacttactgtcagctagcgtagtcctacggtttcggacgggttacggtcgtcccgttacggttccgggacgggtaacgggtaaacccgtaaaaggttacgggtaaaccgggtaacggaaaacccggttaacggttacgggttacggtaccgtacggtaccctaacccgtaccgtttccgttacggttccgtttacccg

SEQ ID NO: 38636 - DNA, 640 bp, Homo sapiens
  misc_feature: GYAE6OF01C8OBQ.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccacgctctcctgcagggccagtcagagtcttagcagcaactacgttgcctggtaaccaacagaaacctggcccaggcctcccggggctcctcatctatggtacatctagcagggccatggcatcccagacaggttcagtggcagtgggtctgggacaggacttcactctcacatcagcagactgagtctagaagtattttgctagttgttaatttaatttcggttacggtactaacgttagttagggttaacgggttctaacccggttggggttacgttttttacggggacccgttaacgggggtacccgtaaacggtaccggttagggaacggtaagttaccggtaaaaaccggtaaaccggttgggtacgggtccgttacgggaccctaacccgtaacgttcctttacgggttccctttacgtttaaccccgg

SEQ ID NO: 38637 - DNA, 606 bp, Homo sapiens
  misc_feature: GYAE6OF01CWOTG.10.79.H02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctccagataccaccggagaaattgtgttgacgcagtctccaggcaccctgtctttgtctccgaggggaaangccacgctctccngcagggccagtcagagtctagcagcaactgtgcctggtaaccaacagaacctggaccaggcctcccgggctcctcatctatggtacatctagcagggccacgtggcactccccagaccgtaggttcaggtggcgagggttgggctggggactaggtaccttcgactctaccactatccgagacagacgtagggacgttacgtaggtaaagttattttggacttaggtttgttaacgtttagttcggtacgtactaaagttagttagggttaacgtcgtaccggttgggttacgtttcgggaccgtagggacctaaggtcgtaggagtaactacggaaacgtagtggtcggtctacggacctaaccgtatccgttcgttccttacgttacccg

SEQ ID NO: 38638 - DNA, 849 bp, Homo sapiens
  misc_feature: GYAE6OF01AE5I2.10.79.H02.1.454.CMB.1.raw
  modified_base (198)..(198): a, c, t, g, unknown or other
  misc_feature (198)..(198): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctccagataccaccggagaaattgtgttgacgcagtctccaggccacctgtcttgtctcgaggggaanagccacgctctcctgcgaggccagtcagagtctagcagcaacgtacgtgcctggtaccaacgagaacctcggaccacggccgtcccgggcttccactatctagtggtacagtctacgcgacgggacctacgtggaccacgtaccccgaagtaccgtaacgggttacgtaggttcggaccgtaacggggttcggggtaccgttgggggtaaaccgtacggtttaaccgtttcccgtaaacccgtttcccgttaaacccgtaaacccgtaccgtttacccgaaacgggtacccggtaaacgggtaacccggttacggggttaaccggtttaccggttaaacggttaaaccgggtttaggtttttacggtaaccggttaacgggtttaggtttaaacgttttaagtttacggttaaccggtaacgtaacgttaaacgtttacgggttaacgggttaccgggttacccgttaaccgggtttacggggtttaccggtttttacggggaacccggttaacgggggtaacccgttaaccgggtacggttaacgggtaacggtaacgttaaaccggtaaacccgggttaacggttacgggttacggtaccgttacgtacccgttaaccgtacgtttccgttacgttaccgtttaacccg

SEQ ID NO: 38639 - DNA, 551 bp, Homo sapiens
  misc_feature: GYAE6OF01C78IT.10.79.H02.1.454.CMB.1.raw
  modified_base (321)..(321): a, c, t, g, unknown or other
  misc_feature (321)..(321): n is a, c, g, or t
  modified_base (373)..(373): a, c, t, g, unknown or other
  misc_feature (373)..(373): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggagcttggtcaagcctggagggtccctgagactctcctgtgcagcctctggattccgcctctggattgacgttcagtgactactacatgacctgggtcccncaggctccgagggagggctgggagtggtttcatactatttatcctagtggtnataccatatactacgcagactctggtagaagggcctattccacctatcctaccgagggacaaccgccaagactcactgtactttagactaaatcgaacaccctgcgagacccgaggaccgacggaccgtatattacgtgtcgacgagtaacttacccgttgcccttggttacttaccg

SEQ ID NO: 38640 - DNA, 638 bp, Homo sapiens
  misc_feature: GYAE6OF01CV0C2.10.79.H02.1.454.CMB.1.raw
  modified_base (200)..(200): a, c, t, g, unknown or other
  misc_feature (200)..(200): n is a, c, g, or t
  modified_base (409)..(409): a, c, t, g, unknown or other
  misc_feature (409)..(409): n is a, c, g, or t
  modified_base (625)..(625): a, c, t, g, unknown or other
  misc_feature (625)..(625): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagacaacactgcagaaatagttatgacgcagtctccagccaccctgtctgtgtctccgagggganagacgcccaccctctcctgcgagggccggtcagaattattgacctaccaattagcctaggtactacaaacaaaacgcctggcccaggcctcccagacctcctcactctccgtggtgctattccgttcggacgggtccctacgttcgggtcgtccccaggtcccgtaggtttccgaggttcggacgtagggttcgggtctacgggaaacnggtaacgttcactctacacctatcgacggtccggccttgccgtagtctaggtaagttattttgactttaaggttttacttacgtgtacgtagtcttaagttaattaacgttggttaacgttttgggtttttacttccgttacgttttccgggccgttagggaaccttaaggttcggtaactttacgaaggtacgtaagtggtacgctcgaccactntcctgttcttacg

SEQ ID NO: 38641 - DNA, 526 bp, Homo sapiens
  misc_feature: GYAE6OF01CG7HU.10.79.H02.1.454.CMB.1.raw
  modified_base (200)..(200): a, c, t, g, unknown or other
  misc_feature (200)..(200): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccacgctctcctgcagggccagtcagagtctagcagcaactacgttgcctggtaccaacagaaacctggccaggctcccgggctcctcatctatggtacatctagcagggcccactggcatcccagacaggttcagtggacagtgggtctgggacngtacttcactcncaccatcagcagacgtggagtctgtaagtattttgctagttgttatttagtttgtactagactaaatgttcggtaggttcgaccgttgggtacttttgggaccgacggggaccaagtcgtggagagtacaagactggtgctgcactatctgtctcg

SEQ ID NO: 38642 - DNA, 592 bp, Homo sapiens
  misc_feature: GYAE6OF01BJ1GJ.10.79.H02.1.454.CMB.1.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
  modified_base (379)..(379): a, c, t, g, unknown or other
  misc_feature (379)..(379): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcacctgtcttgctccaggggaaangccacgctctcctgcagggccagtcagagtcttagcagcaacttcgttgcctaggtaccaacgagaaacctggaccaggcctcccgggctccncatctatggtacatctagcgagggccagtggcatcccagacnggttcagtgcaggtcggtctgggacagtacttcgactcgtacaacntcagcagtacgtggagtacgtagtaagtatttgactagttgttattattgtacagtactaagttagtaggttacgtacgtacggttaggttacgttttgggaccggtagggtaccgtaaggtccgtagggaacgtaacgtaaccgtaaacggtacgttacggtacggtaccgtacggacctaacccgtagttaccgttcgttccgtttaaccg

SEQ ID NO: 38643 - DNA, 820 bp, Homo sapiens
  misc_feature: GYAE6OF01CCATY.10.79.H02.1.454.CMB.1.raw
  modified_base (183)..(183): a, c, t, g, unknown or other
  misc_feature (183)..(183): n is a, c, g, or t
tcagcatagtagtgcacgaccggtgctcgatttagtgtcacacgaagggaaaggggtctgggagaagagccccagccccagaattcccaggagtttccattcggtgatcagcactgaacacagaggactcaccagtggagtttgggctgagcgttgggttttcctgttgctattataaaggtntccagtgtcaggtgaagctggtggtagtcggtgggggagcgttggtcaagccgtgggacggtccctggacgtacctctccgtggtcgcacggtcccttcgtggtacttccgcccttgtcggtattcggacgttcgaggtacgtaactaacgtacacgttccggtaccgtcgggttccccgacgtaacgggtcctaccggaaggggtaacgggccgttgggtaaggtttcgggtttacaagtttaccgtaagtttacgtccgtaaggttggtactaacgttaacctaagttaactacgtacgactaaggtaccttgtacggtacgggtaaacggtccctaatttacccgaaccctaggttaccccaccggtaaaggggacccaaaccggacctaaaacggtacctacccgtaacgttcgttaaaccgtttacgaaacccgttaaagtaccgtaaaacccctaccccggtggaacccggtaaccggtacccgggtaaccggaaccttaacccggggtaccctttaagttaaaccggttccggtacgggacgtaacccggtaaacggtttaaaaccccgttcccccggtttaagggtcttttaaaccgggtttaaccctttcccggtacggtaacccggg

SEQ ID NO: 38644 - DNA, 601 bp, Homo sapiens
  misc_feature: GYAE6OF01B6CGK.10.79.H02.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctccagataccaccggagaaattgtgttgacgcagtctccaggcaccctgtctttgctccgaggggaaangccacgctctcctgcagggccagtcagagtcttagcagcaactacgttgcctggtaccaacacgaaacctggaccaggcctccgggctcctcatctatggtacatctacgcgacgggccacgtcggcactcccagactaggttacagtcggctaggtgggtcgtgggacaggtacttcgactctcaccatcagcagcctagacgctagaagttatttgacttagtttactacgttgtacagactaggtcgtcgtccgtacgtttcgggacggtggtaccggtccgtaccggtttcgggacgggtaacgggtaaaccgtaaaaggtacggaacgggttaccgaaacggtacggtggtacggacgtacgtacgtaacccgtagttccgttgtccgtttaaccg

SEQ ID NO: 38645 - DNA, 885 bp, Homo sapiens
  misc_feature: GYAE6OF01AIQWT.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggaggcttgggtcaagcctgggagggtccctgagacctctcctgtgcagcctctggtacttccgccttcgtggtattggacgtttcagtcgacttacgtactagtcggacccgtggggtcccgaccgtacgggcctacccggaaggggggtaaacgggggtccgttagggggtacggtttcgggggttttaccaagtttaaccgttaagttttaaccgttcccggtttaaagggttcggggtttacgtaaaccttaacccgtaaagtttaacgttaaacccgttaaccggacctaacgggtacccttaccgttagggttacgggaaaccgggggtccccgtaaacgttttacccgaaccccgtaacgtttaccccgtaacccggtaaccgggggtaaacccaaaccccgggtaacccctaaaacgggtaaacccttaccgtaacccgttacggttaaccctttttacggaaacctaaaacgttaccggaaaacccttaccccgtacggacccggtaacgggaccccggtaacgggtaaccccgtaaccggggtaacccgtttaagtttaacgttaccggttcgggtaccggtacggtaaaccggttaaacccgtttaacccccggtttacggttaccctttaacggggttttaccctttaaaccccggg

SEQ ID NO: 38646 - DNA, 597 bp, Homo sapiens
  misc_feature: GYAE6OF01EKXFH.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggctccagataccaccggagaaattgtgttgacgcagtctccaggcaccctgtctttgtctccgaggggaaagagccacgctctcctgcagggccagtcagagtcttagcagcaactacgttgcctggtaccaacagaaacctggaccacggcctcccgaggccccctcatctatggtgctactccgaacgacgggcccacgtcggccactcccagccaggttcaggtgctaggtgggtcgtgggacagcttcactctcaccatcatcacgcctggacgccgtagaagtgtgttcgtacttagttttacttacgtagtactaactacgtaccggtaccgtaggttccgggtcccggttccgggggtaccttaccggtttcccgggcccgtacgggtaacccgtaaggtcggaatacgtaaccgaaacggtacgtaggtcggctgacctaccattcgtcgttctctaccg

SEQ ID NO: 38647 - DNA, 578 bp, Homo sapiens
  misc_feature: GYAE6OF01C7JDN.10.79.H02.1.454.CMB.1.raw
  modified_base (205)..(205): a, c, t, g, unknown or other
  misc_feature (205)..(205): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagatataaccgccggagaaattgtgttgacacagtctccagccaccctgtctttgtctccgaggggaaangccaccctctcctgcagggccagtcagagtgttagcactaacttgctggtaccaanagaacctggccaggcctcccaggctcctnatctatgatgcatccacggagggccagtcggcactcccagcctaggttcagtggcaggtgggtctgggacagacttcactctcacctatccgaccggcctacgaccctagtaacgttattttcgacttaagttttacttacgttgttacagtctaggtcgtagctagtccgtcggtacccccttccgttccctcgtaccgtttcgggcgggtacgggaccgtaagggtcggaacgtacgtacgaaacgtacgtggtcggacgtgacgtacctattctgtccttctacc

SEQ ID NO: 38648 - DNA, 621 bp, Homo sapiens
  misc_feature: GYAE6OF01CHC6B.10.79.H02.1.454.CMB.1.raw
  modified_base (324)..(324): a, c, t, g, unknown or other
  misc_feature (324)..(324): n is a, c, g, or t
  modified_base (388)..(388): a, c, t, g, unknown or other
  misc_feature (388)..(388): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctgggacgggtccctgacgactctcctgtgcagcctctggattcgcctctggattgacgtttcagtgactactacatcgaccgtgggtccnccaggctccggaggggagggctagggagttgggtttcagtactagtttactccgtaggtcggtnaactaccaatactactacgctaagtactcgtaggtacgaacgggtccctattccaacctatccgtaccgaagggtaaccaaccgcccaaagaacctcaacgtcgtaactttcgaactaaagtcgaaacctccctggaccgacgacccggaaggacccaccgggtcccgttaatagttacgtgtacgacgaacgtaaaccgttacccgttcgaccgtttggttaactttacccg

SEQ ID NO: 38649 - DNA, 700 bp, Homo sapiens
  misc_feature: GYAE6OF01COLPF.10.79.H02.1.454.CMB.1.raw
  modified_base (383)..(383): a, c, t, g, unknown or other
  misc_feature (383)..(383): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcgttggtcaaggccgtgggacgggtccctggacgtacctctcctgtcgcagtcctctggattccgccttcgtggtattggaccgtttcaggttcgactactacagtcgacccgtcgggtcccgccgacggccgtaccggaagggggaaggggtcgtagggnggtttcggggtttacaagttaactatttactccgttaaggtggtacgtaacttacccattaacgtaacgtaccggactacgtaccttcgtaggtagggaacgggtcccgtaagttccaaccgtacttccgtacccgtaagggaaccctaaaccgacccaaacgtaaccgtacctacgttacgtaacctttacgaacgtaaactccgaaacccacccgtacgaccggacgaccgacggaccgaccggtacgtaatacgttacgtggtacgtacgaacgtaaaccgttacccgtacgtccgttaggtttacttacccgg

SEQ ID NO: 38650 - DNA, 818 bp, Homo sapiens
  misc_feature: GYAE6OF01EUSC3.10.79.H02.1.454.CMB.1.raw
  modified_base (327)..(327): a, c, t, g, unknown or other
  misc_feature (327)..(327): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgaagctggtggagtcgtgggggagcttggtcaagcctggagggtccctgagctctctgtgcagcctctggattccgccttctggtattgacgttcgagtgactactacagtcggaccgttcgggtccnccgagggcctacccgagggggtaacggggcgtgggtacggttggggttttaccaagtttaaccgtaatttttacgtcccggtttaaggttggggttagtaacttaacccgtaatttaacttaaccgttaaccggaccaaggtaccttaccgtttagggtacgggaaacgggggtccccgtaattttaccgaacttactaacttcccgttacccgaaagggggaaccaaacccggaaccccaaaaggtaaacccttccgtaacgttacgttaaacccgttttcggaacctaaaacgttacggtaaaaccccgtaccccgttacgggaaccggaaccgggaccccgggtaaacgggaaaccccggtacccggggtaaacccgtttaatttaaacgtttaaccggttcgggtaacggacccgggtaaacggtttaaacccgggtttaaaaccccccggttttccggtaaccccgtttaggggtttttaaacccc

SEQ ID NO: 38651 - DNA, 805 bp, Homo sapiens
  misc_feature: GYAE6OF01C1HHA.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggagcttggtcaagcctggacgggtccctgacgactctcctgtgcagtccctcgtggactttccggccttcgtggtattgacgtttcagttcgacctactacagtcggacccgtggggtcccgcgagggcccttaccggaagggggtaacggggtccgttaggggtacggtttggggttttaccaagttacgtagttttactccgttaggttggtacgtaacttacccgaatttacgtaaccgtacggactaacgtaccttcgtaggtacggtaacggggtacccgtaactttaccgaacctacgttaccgtacccggaacgggtaaccaaacccggtacccgaaacgtaaccctaccgaaccgttacgtaacgttttacgaaccgttaaacgtaccggtaaaccctacccgttacggacccgggtaacggaccccgggaacggtaaacccgtaaccgggtacccggtttaaacgttacgttttaaccgtcgggttaccggtaaccggtaaacggttaaaaccccggttaaaccccgggtttcccggttaacccgttttcggggttttaaccgttttaaaccccgg

SEQ ID NO: 38652 - DNA, 754 bp, Homo sapiens
  misc_feature: GYAE6OF01BUCL9.10.79.H02.1.454.CMB.1.raw
  modified_base (341)..(341): a, c, t, g, unknown or other
  misc_feature (341)..(341): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaggtgtccagtgtcaggtgagctggtggagtcgtgggggaggtcttgggtcaagccgtgggacgggtccctgagactctcctgtgcagcctcgtggacttccgccttcgtggtattggacgttcagtcgacctactacagtcggtaccgttcggggtcccnccgagggtcctaccggagggggtaaggggctagggtaggttgggtttacagttactagtttactccgttaggtggtagaactacctataactacctacgactagtacttcgtaggtacggaacgggtcccgtaattcccaactacgttacccgtaccgaacggggtaaaccaaacccggacccgaaacgtaaccctaccgtaaccgttacggtaaccttttacgaactaaacgtacgaaacccctaccccgttacggaccggtaacggacccgggaacgggtaacccgtaacccggggtacccgttaacgttaacgttaaccggttcgggttaaccggacggtaaaccggttaaacccgttaaacccccgggtttacccggtacccggttttcgggtttaactttaaccccgg

SEQ ID NO: 38653 - DNA, 764 bp, Homo sapiens
  misc_feature: GYAE6OF01EEANW.10.79.H02.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (318)..(318): a, c, t, g, unknown or other
  misc_feature (318)..(318): n is a, c, g, or t
  modified_base (351)..(351): a, c, t, g, unknown or other
  misc_feature (351)..(351): n is a, c, g, or t
tcagcatagtagtgcacgaccggtgctcgatttagtgtcacacgaagggaaggggagagctgctcagttaggacccagagggaaccatggaaaccccagcgcagcttctcttcctcctgctactctggctcccagataccactggagaagtagtgatgacgcagtctccagccaccctgtctgtgtctccagggaaacngccaccctctcctncagggccagtcagagtcgttgcagctaggttacgccgtcggtacagcgaagaaacggtcggccaggcctcccgaaggccttcccgtacggttatacgttggtcanacctcccaccggaccggacctagtaggttaccncgtaacgggtccgacggttaccggttacggtcggaccgttagggggttccgtacggggtaccgtaacgaacgggtttaccgttaccgtaaccgttacgttacccgaaacgttcgtaacggacccgtaacggaccccgttccggttaccgtacggttaaaccgttcgttaagggaaacgtttttcgtttacgtaacgttttaaagttttacccttagttcgtaacggttacgtaacgtttaagtaaacttacgggtaccgttcgggtaccccgggtacccggaccggttaaccggggtcccggtaaacggggtaacccgggtaacgggttaagggaaacggttaaccgtaaacggtaaaacggtcggttacgggtaccgtacgtacgtacccaacgttctttacgtccgtttcc

SEQ ID NO: 38654 - DNA, 832 bp, Homo sapiens
  misc_feature: GYAE6OF01DV806.10.79.H02.1.454.CMB.1.raw
  modified_base (357)..(357): a, c, t, g, unknown or other
  misc_feature (357)..(357): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggtagtttgggctgagcttgggttttccttgttgctattaataaaaggtgtccagtgtcgaggtgaagcgtggtggagtcgtgggggagtcttggtacaagccgtggacgggtccctaggacgtacctcgtcctgtcgcagcccttcgtggtacttccgccttcgtggtattggacgtttcaggtacgtacttactactagtcgaccgttcgggtcccnccgaggcctaccggaaggggtaacgggcgttagggtaggttcgggtttacaagttactagtttacgtaccgttaaggttggtacgtaacttaaccgtaattaacgttaacccgtaacgtaccgtaacgtaccgtttccgtagggttaacgggaaacgggtccccgtaatttacccaacccttacgttacccgtacccggaaacggggaaaccctaaacccggacccgtaaaacgtaaacccgttaccgtaaacccgtttcggttaaaccttttacggaaaccgttaaaacgttaccgaaaaccccttaccccgtagggaccgacccggtaacccgggaacggtaaccccgtaaccggggttaacccgttaaagttaacgtttaaccgtcggtaaccggaaaccgggttaaacgtaaaaaccccgtttaccccggtttacggtaccccgttttaaggtttaaccgtttaaccccgg

SEQ ID NO: 38655 - DNA, 609 bp, Homo sapiens
  misc_feature: GYAE6OF01CFXXX.10.79.H02.1.454.CMB.1.raw
  modified_base (326)..(326): a, c, t, g, unknown or other
  misc_feature (326)..(326): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (506)..(506): a, c, t, g, unknown or other
  misc_feature (506)..(506): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttcctgttgctattataaaaggtgtccagtgtcaggtgaagctgggtggagtcgtgggggagcttggtcaaggcctgggacgggtccctggagactctccgtgtgcagcctgtggattcgcctgtggattgacgtttcagtgactactacatcgaccgtgggccncgaggcctccgaggggagggtctgggtagtgggtttcatactatttacncgtaggtgtnactacgatatacgtacgcacgtactgtgtaggaacggcctattccgacctagtccctacgaacgggaaccaaccgaccaagtaaccctcaacgttagaactttagaactaaatcgaaaccncccgtggaccgaacggccgacggaccgtaccgggtacgtaattacgttacgtgtaccgacgaacgtaaccttacccgggttctaccgtttggttacctttacg

SEQ ID NO: 38656 - DNA, 677 bp, Homo sapiens
  misc_feature: GYAE6OF01AG6RU.10.79.H02.1.454.CMB.1.raw
  modified_base (404)..(404): a, c, t, g, unknown or other
  misc_feature (404)..(404): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggacgggtccctgagactctcctgtgcagtcctctgggacttccgccttcgtggattgacgtttcagtgactactacatcgaccgtggggtcccgccgaggcctccgaggggaaggggctgggagttggggtttacagttactattttacgtccgttaggtgggtanaacttacccaattactaaccgtacgacagtactcgtggtacggaacggggtcccgtaatttaccgaaccctacgttcctacccgaacggggaacccaaaccggacccaaacggaacctacaacgttcgtaacgtttacgaactaaagtacgaacctacccgtacggaccgacggaccggacggaccgaccgggtaccgttacgtactttacgtggtacgacgaacgtaaaccgttaaccccggttaccgtccgtttaggtttactttacccgg

SEQ ID NO: 38657 - DNA, 954 bp, Homo sapiens
  misc_feature: GYAE6OF01A2MCM.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatgggtagtttggctgagcgttggttttccttgttgcttattaataaaggtcgtccagtgtcgaggtgagtcgtggtggacgtcggtgggggacgtcgttggtacaacgtccgtgggacggtccctggaacgtaccttcgtccgttggcgaccgacgtccctgtggtaccgttccgccttcgtggtacttgtaccgtttcgaacgtcgtaacttactactacgtcgtacccggttcgggtacccgacgtaacgggtcccgtaccgggaaggggaacgggtcggttagggtacggtttcgggtttactaacgttacgtttaattttaccgttacggttaggttaggttacgtaacctttaacccgtaacgtttaaaccgtaccgttaaacccgaccgttaaaccggttacccgtttacgttaagggttaaccggggtaaaccgggggttaccccgttaaacttttacccgaaacccgtttaccgtttaacccgtaaccccgggtaaaccgggtaaaccctaaaacccggtaaaccccgttaaaacgtaaaccccttaacgtaaccggttaacgtttaccccgtttaagaaacccgtttaaaacgtaccggtaaacccctaacccggtacggacccgggaaaccggacccgggtaacgggtaaccccggtaaccggggttaacccggttttaacttaaacggttttaccggtacgggtttaacccggggaaaccggttaaaaccggtttaaacccccggttaaaccccgggtttacccggtaaccccgggttttttagggtttaaaccccgtttaacccg

SEQ ID NO: 38658 - DNA, 570 bp, Homo sapiens
  misc_feature: GYAE6OF01DCYZ0.10.79.H02.1.454.CMB.1.raw
  modified_base (374)..(374): a, c, t, g, unknown or other
  misc_feature (374)..(374): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgccttctggattgacgttcagtgactactacatgacctgggtcccgcaggctccgagggagggctgggagtggtttcatactatttatcctagttggtnaactaccatactactacgcagactcgtgtagacgggcctattcactatcctaccgagggaaccaccgaccaagaactcactgtactttgactaaatcgaacctaccctgacgacgcccgaagggaccacgggtccgtaattagttactgtacgcgaagtaacttaacccggttcgaccttggtttacctttacccg

SEQ ID NO: 38659 - DNA, 753 bp, Homo sapiens
  misc_feature: GYAE6OF01DLWB5.10.79.H02.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctccagataccaccgaagaaattgtgttgacgcagtctccaggcaccctgtctttgtctccgaaggggaaancgccacgctctccgtgcgacggccagtcagtagttctagcagacctaacgtacgttgccgtaggtaaccaaacgaacgtaaacccgtggacccacgggtcccgtcccgggtcctccctacacgttaccgttaaggttccgggttaacctaacgttccgtaaacggccggtaaccgggtccctaacgtcggacctacctaccccgaagtaccgtaggttacaggtcggacgtaggggtcggttcgagggaactagtacctttacgaccttccaccgaccagtacacgactaacggtacgtacggtacgttacgtaaggtaaagtttcgtttacgacgttaaggttagtttaagttttagtcggttaacggtaacttaaggtttaggttacgggttaacgtccgttaaccgggttcgggtttaaccgtttcggggaaccggttaaggggacctaagggtcgtaaggtacgtaacgtaacgtaaaaccggtagttcgggtacgccgtacgaacccttaaccgttacgttacttcggttcccttacgttaccccg

SEQ ID NO: 38660 - DNA, 775 bp, Homo sapiens
  misc_feature: GYAE6OF01DPBCU.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccagtgggtagtttgggctggagtcgtttgggtttttccttgttgtcttaattaagtaaaaaggttgtcctagtgtacagggtagaagtcgtggtggtaggtcggtggggggagtcgttggtcaacggccgtgggacggtcccctggacgtaccttcctcctgtgccacgtcctacgtggtacttccgccttcggtgtacttcggacgttcgagtcgtaactactactagtccgaccggtcgggtcccacgtacggccgtaccgggaaggggtacgggtcgtagggtaggtttgggttacaagttacttagtttactcggttaaggttggtacgtaactaccgtaataacttaccgtacgacgtagtaccttcggtaggtacgggtaacgggtccgttaacttccaaccgtctacccgaccgggaacggaccaaaccggaccaacgtaacctctaacgtcgtactttaacaacgtaaacgtaccgaacctccgtacggacgaaccggtaccggggaaccgacccggtaaccggttaccgttaaacgttacgtttaacggtcgtaccgggtaacgaaaccgggttaaaccctttaccccggtttaccggtccggtttaaccggtttaacgtttaaccccggg

SEQ ID NO: 38661 - DNA, 740 bp, Homo sapiens
  misc_feature: GYAE6OF01CU4Q4.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatgggagtttgggctgagcttgggttttccttgttgctattataaaaggtgtccagtgtcaggtgaagcgtggtggagtcgtgggggaggtcgttgggtacaaggccgtgggacgggtccctggacgactctctgtcgcacgcctgtggcttccgcctcgtggattcggtacgttcagtcgtactactacacgtcggtacccgtcggggtcccgcgacggtccgtaccggaagggggacggggctaggggtagtttcggggtttacaattacttattttacgtccgtaaggtttgggtataacttaaccaattaacttacctacgacacgtacttcgtaggtagggacgggtcctaattccgaacctaagtcccgtaccgaacggggtaaccaaaccggaccctaaaacgtaccctaccgtaacttaggtaacctttaggaacctaaaagttcgaaacccctacccgtaggaccggtaacgggacccggaacgggaccggacccggtaccgtttaaacttaacgttaccttcgggcgtaaaccgaacggttaaaccccttaaccccggttggtaccccgtttagggtttaacctttaacccggg

SEQ ID NO: 38662 - DNA, 782 bp, Homo sapiens
  misc_feature: GYAE6OF01EBEOD.10.79.H02.1.454.CMB.1.raw
tcagcatagtagtgcacgaccggtgctcgatttagtgtcacacgaagggaaaggggagctctgggagaagagccccagccccagaattcccaggtagtttccattcggtgatcagcactgaacacagaggactcaccagtggtagtttgggctgagtcgttgggttttccttgttgacttattaagtaaaggtgtaccagtgtcgaggtgagtcgtgggtggtaggtcgggtgggggaggtcgttgggtacaaggccggtgggtacggtcccgtaggacgtccgtccgtccgtggtcgaccgcgtcccgtcgtggtaccttccggtccgttcgtaggtacgttacggtacgtttacgaaggttacgtaaccttacgtaacgtacgttaccggtacccggttccgggtacccgtccggacggtaccgtaccgggaaggggtacggggtcgtaggggttaaggttcggtttacaagttaacttagtttaacgtccgtagttggtactaacgtacctaatacgtacacggactaacgtctcgtaggtacggacgtacctactaccgaactcgtaccgtaccgggaaagtacccaaccgaacctaaacggtacctaccgtacgtcgttaacgttaccgaataaacttaccgaacccttaccggtaggaccggtaacgaccgggaccgaaccgtaccggttaccttaagtaccgttacgtcgggtacgaaacgttaccggtaaacccgttacccggttagtttcccgttaaggttacccttacccgg

SEQ ID NO: 38663 - DNA, 620 bp, Homo sapiens
  misc_feature: GYAE6OF01BXR2T.10.79.H02.1.454.CMB.1.raw
  modified_base (323)..(323): a, c, t, g, unknown or other
  misc_feature (323)..(323): n is a, c, g, or t
  modified_base (577)..(577): a, c, t, g, unknown or other
  misc_feature (577)..(577): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtacaagccgtgggacgggtccctggacgactctccgtgtgcagcctcgtggacttccgcccttcgtggtattggaccgtttcgagtgactactacntcgaccgtgggtcccgccgaggcctaccggaggggaggggctgggacgttgggttacatactatttactcctaggtggtagactaccattactaccgtacgctacgtacttcgtggtagggaacgggtcctattaccgacctacgtcctacgaacgggaaccaccgaccaagaacctacactagtactttagaactaaagtacgaacctacccgtgaccgacgccggagaccgaccggtaccgtatagttacgngtacgacgaacgtaccttacccgtgtccttaggttacttaccg

SEQ ID NO: 38664 - DNA, 724 bp, Homo sapiens
  misc_feature: GYAE6OF01B31RR.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccagtggtagtttgggctggagtcgttgggttttccttgttgtcttattaagtaaaaggtgtccagtgtcaggtgaagcgtggtggagtcggtgggggagtcgttggtacgagtccgtgggacggtcccgtagacgtcctctccgtgtacgcacgtccttcgtaggtcttccgccttacgtggtattcggtacgttcgtaggtacgtaacctactacgtacgtccgtacccgtcgggtcccgcgacggtccgaccggaaggggtaggtcgtagggtacggttggttacaagtacgttattcgtcgtaggtgtataactaccgtaataactaccgtacgacgtacgtaccgtttcgtaggtacgggaaccggtcctaagttccccaaccgtacgttcccggaaccgaacggggtaaccaaacccggtacctaaacgtccctagtaaccgtttaggttacctaacggaaccctaaaagtccccaaacccgttccgaacgacgggaccgacggacgggaccctaacggtcctaattacgtcgtggaccgaacgtaacgtaacccgtttacgccgttacgttggttacttacgg

SEQ ID NO: 38665 - DNA, 854 bp, Homo sapiens
  misc_feature: GYAE6OF01C9V24.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgcttactctggctcccagactaccaccggaagaaattgtgttgacgcagtctccaggcaccctgtctttgtctaccgaaggggaagacgccgacgctctcctgcgacggccagtcagtagtcttagcagacaacgtcgttcgcctaggtaaccaacgaacgaaaccgtcggaccgacggtcccgtacccgggtcctcccgtactacttacctaacgttacggtaactacgtacgtacggaccgaacggggtaccctacggtacggacctaaccgtaccccgtaacggaaccgttaacgggtttccgaaggttcgggacggtaacggggtttcgggggtaccggtacgggggtaaccttaaacggtccgtttaccgacccgtttacctacccgtaacctaacgtaccgtaaccggacgtaacggtaccgtacggggttacgttacggtaggttaaacgttacgtttttacgacgtttaagggtttacgtttaagttttaacggtttcgggttaaccggttaactttaaacggttaagggtttacgggtttaacggttaccgttaaccggggtttaccgggtttacgggtttccgggtaacccgggttaacgggggtacccgtaacgggtaccggttacggggaacgttaacgtaaccgtaaaaacggtacggttacgggtacggtacgtacgaaccgtaccgtaacgttcgttacgttcccgtttccgttacccg

SEQ ID NO: 38666 - DNA, 860 bp, Homo sapiens
  misc_feature: GYAE6OF01DCG5N.10.79.H02.1.454.CMB.1.raw
tcagcatagtagtgcacgaccggtgctcgatttagtgtcacacgaagggaaagggtagctctgggagaagagccccagccccagaattcccaggagtttccattcggtgatcagcactgaacacagaggactcaccatggagtttgggctgagtctgggttttcctgttgctattataaaaggtgtccagtgtcaggtgaagcgtggtggagtcggtgggggaggtcgttggtacgaaggccgtgggacgggtccctggacgtacctctccgtgtcgcacgtccctcgtcggtacttccgccgttcgtggtacttcggtaccgttcagttacgaaccttactacagtcgtacccgtcgggtcccgccgacggtccgtaccgggaggggtaacgggtcgtaggggtaggtttcggggtttacaacgttaaccgtttaagtttacgtaccgtttaggttacgggttactaacgttaacccgtaagttaacgtaaccgttaaccggaccgtaacggtaaccgtttacccggttaggggtaaccggggtaaccggggacccttaacggttttacccaaaccccgttagttaccccgtaacccgggaaaccgggggtaaaccctaaacccggaaccccgtaaacggtaaacccgttacccgtaaccggtttaacgtttaaccgttttaaccggaaaccctaaaacggttacccgaaacccgtaccccggtaacgggtaccccggaaccgggtaaccccgggaaccgggtaaccgaccccgggttaacgtttaacgttaccgtttaacgtcggtaacgacgtaaacgtaacccgttacccggtcgtacgttacgtacgtttacccg

SEQ ID NO: 38667 - DNA, 735 bp, Homo sapiens
  misc_feature: GYAE6OF01DY7H5.10.79.H02.1.454.CMB.1.raw
  modified_base (268)..(268): a, c, t, g, unknown or other
  misc_feature (268)..(268): n is a, c, g, or t
  modified_base (340)..(340): a, c, t, g, unknown or other
  misc_feature (340)..(340): n is a, c, g, or t
tcagcatagtagtgcacgaccggtgctcgatttagtgtcacacgaagggaaaggggagctctgggagaagagccccagccccagaattcccaggagttccattcggtgatcagcactgaacacagaggactcaccatggagtttgggctgagtcgttggtttcctgtgctattaagtaaaggtgtccagtgtcgaggtgaagtcgtgggtggaggtcggtgggggagtcgttggtcaagccgtggacgggtccctgagactcgtctgngcacgcctcgtggacttcgccctgtggattcgacgttcaggtcactactactagtcgtaccgtcgggtcccnccgtaggccgtaccggaaggggtaaggggtccgtggggtaggttgggtttaaccaagttaaccgttattttaccgtaccgtagggttaggtacaacttaaaccagtttaacgaaccgtacgtacgtacgtactccgttaggtacgggtaacggtaccgtacttaccgaacctacgtaccgtaccgaacggaaccgaaccgacctaaacggaactacgtaccgttacggtaactttacgaacgtaaacgtaccgtaaacccgtacccgttaggaccggtaaccgaccggaacggaacccggaccgggtaaccgtaacgtttacgtacgttacggacgtaacggtaaaccgtaaccgtaacccggtttccggtaacccgtttgttaagtttacccgg

SEQ ID NO: 38668 - DNA, 816 bp, Homo sapiens
  misc_feature: GYAE6OF01BC6VM.10.79.H02.1.454.CMB.1.raw
  modified_base (793)..(793): a, c, t, g, unknown or other
  misc_feature (793)..(793): n is a, c, g, or t
tcagcatagtagtgcacgaccggtgctcgatttagtgtcacacgaagggtaaagggggagagctgctcagttaggacccagagggaaccatcggaaaccccagcgcagcttctcttcctcctgctactcgtggctccagataccacggagtaattggtgttgacgcagtcctccgaggcctacccttgttcctttgtcctaccggaaggggaaacgcgccgaccgtcttcctcgtagcgaggccagtcagtcgtcttagccagactaaacttcggtgccgttaggaaccaaagaacggtaaaccgtcggacccgtacgggtcccgtacccgggccttccctactacgttaccgtaagttacggtaacctacgttaccgtaacgcccggaacgggtccctacggtcggacctaaccgttaccccgaaggtaaccgtacggtttaccgaggtcggtacgtagggttcggggtacgtacgggacgtaaccggtaccttaccgtaacctccgttaaccgacctactacgtacggtacgtaacggttaacgtacgggtaacggttaccgttaaagggttaacgttttagtttttaacggaaccctttttaaagggtttttacctttaacggttaccgttacgtaacgtacgttaaaggttaacgttaaacggtcggtaacccgttacccgggtacccgttaccgggtaacgggttacccggaaacgggtaccgggtaccgtaagggttaacgtaccgttaaacgaaacgtacggttggaccgtcgtaccacgtacgtntccgttatccttacgtctccccg

SEQ ID NO: 38669 - DNA, 630 bp, Homo sapiens
  misc_feature: GYAE6OF01C7Y5W.10.79.H02.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggccaccctgtctttgtctccgaggggaagngccacgctctcctgcagggccagtcagagtcttagcagcaactacgttgcctaggtaaccaacagaaaccgtggcccaggcctcccgggctcctcatctagtcggtacatctagcgacgggcctacgtcggacactcccgagaccgtaggttcaggtcggcgagggttcgggtcgtagggactagtaccttcactcctacacctatcagacgacgtacgtaggtacgtacgtaggtaacgttagtttacggcgtagttagttatttacgttgtacctagtactaagttagttagggtacggtaccgttaccgttgggttacgttttacgggaccggtacgggaccgtaaggtcgtaggaagtaacgtaaccgaaacgtacgttggtacggtcgtacgtacctaacctgttccgttgttccgttaccg

SEQ ID NO: 38670 - DNA, 729 bp, Homo sapiens
  misc_feature: GYAE6OF01EZNJ3.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagcgtggtggagtcgtgggggagcttggtcaagcctggacggtccctgagactctcctgtgcagcctctggacttccgccttcgtggattggacgttcagtgactactacatcgaccgtcgggtcccgccgtagggcctccggaaggggaacggggtccgtagggtacggttggggtttaccagttacctagttttactccgttaaggttggtacgtaacttaaccctaattaacgttaacccgtaaccggtaccaacggtaccttcgttacggttacgggaacggggtcccgtaagtttacccaaccctacgttacccgttacccgaacggggaaccctaaacccgacccgtaaaccggtaaaccctacccgtaacgttacgtaaccgttttacgaacctaaacgtacgaaaccctacccgtacgaccgacggacccggacgggaccgaccggtaccgttacgttaacttacgtggtacgacgtaacgtaaccgttaacccgttaccgtccctttggttaacttaccg

SEQ ID NO: 38671 - DNA, 762 bp, Homo sapiens
  misc_feature: GYAE6OF01B4A20.10.79.H02.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctccagataccaccggagaaattgtgttgacgcagtctccaggcaccctgtctttgctccgaaggggaaanagccacgtctctccgtgcagggccagtcagagtcttagcagcaactacgttnccgtaggtacccaacgacgaaaccgtggaccaggcctcccgggctacctcgatcgtatcggtacattcagcgagggccaacgtcggacacgtccccgaagtaccgtaggttccaaggtcggtactaagggttcggggtctaacgggggacacggtaaccttctaacgtcttaccgaacctagtacgagacgacgtaccgtgggtacgtacgtaggtaaacgttagttttacggacgttaggttacgttaagtttacgtttagtacgtaacgtactaaacgttaagttacgggttaacgggttacccgtaaccgggttacgggtttaaccggtttttacggggaacccggtaacggggtaacccggtaaacgggtaccggtttaagggtaaaccggtaaacgttaacccggtaaaaccgggttaaaccggttcgggttaaccgggtaccggttaccggtacccgttaacccgttaacggtttcccgtttacggtttccccgtttaacccg

SEQ ID NO: 38672 - DNA, 739 bp, Homo sapiens
  misc_feature: GYAE6OF01BNHDI.10.79.H02.1.454.CMB.1.raw
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (602)..(602): a, c, t, g, unknown or other
  misc_feature (602)..(602): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggtagtttgggctgagcttgggttttcctgttgctattataaaggtgtccagtgtcaggtgaagtcgtgggtggagtcggtgggggaggtcgttgggtacaagccgtggggacggtccctgacgtactctcctggtcgcagtcctcgtggtacttccgcgtcgtaggacgttgacgttnacggttnaacctactacgtcgtaccggtaccgtcggggtacccacgacgggtcctaccgggaaggggaacgggtgtacggggtacggttgggtttaccaagttacgttaatttacgtccgtagggttggtactaacttaccctagtactaccgtacgactacgtactcgtaggtaggaacgggtccctagtacctaactactccgtaccggaacggaaccgaaccgaaccggtaaactaccgtactacgttacgtacctttaacgaacgtaacgtacgaaacccnccggtacgtaccggaaccgtaccgggacggaaccggtacccggttacggtaaacttaacgttacggtacggtacgtaaccggtaaacggtaaccccgttaccgttacccgttaccgttcggtttaaccttaacccgg

SEQ ID NO: 38673 - DNA, 682 bp, Homo sapiens
  misc_feature: GYAE6OF01E5TXR.10.79.H02.1.454.CMB.1.raw
  modified_base (182)..(182): a, c, t, g, unknown or other
  misc_feature (182)..(182): n is a, c, g, or t
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (564)..(564): a, c, t, g, unknown or other
  misc_feature (564)..(564): n is a, c, g, or t
  modified_base (581)..(581): a, c, t, g, unknown or other
  misc_feature (581)..(581): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtagctataataaaggtntcagtgtnaggtgagcgtggtggagtcgtggggagtcgttaggtcaagtccgtggacggtccctgacgtctctccgtgtcgcagccctntcggtcttccgcctcgtggtacttcggacgttcagttcgaactactaacgtgtccgaccggttcgggtcccgaccgtaggtccgtaccggaagggggtacgggtcgttagggtaggtttacggtttacaacgtaacgttactttacgtccgtttaaggtcggtactaacgtaccgtaacttacgtaaccgtaacggcagttcctcggtaggtccgggaaacggtcctaagttcccactaccgttaccgcgaacggaccaaccgaccgtaacgaccttcacgtagtaccgttanaaacgtactaccgaccncgtacgacggtacgcgaacgacctagggtacccttatacgtacgtgaccggtaaaggtacctaaaccgttacccggtcgtacgtttacgtacgttacccgg

SEQ ID NO: 38674 - DNA, 750 bp, Homo sapiens
  misc_feature: GYAE6OF01EBWHA.10.79.H02.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcacacgaaggggaaagggggagagctgctcagttaggacccagagggaaccatggaaaccccagcgcagcttctcttcctcctgctactctggctccagataccaccggagaattgtgttgacgcagtctcaggcaccctgtctttgtctccgaggggaaangccacgctctcctgcaggccagtcagagtcttagcagactaactacgtttcgaccttggtaacccaaacgaacgaaaacccgtcgggacccaacgggtccctacccggggccttacccgtacacttccttaagttcgggtactaacgttccgtaaggccgacgggacccacgtcggaccacgtccccgaagaccgtaggttccgaggttggaccgtagggtgggtcgtagggacgtagtaccttcgacttccgtacaacctactacgaagccaaggtaccgttagggtacgttacgttaaggtaaagttagttttacggacgttaggtttagtttaagtttacgtttacggttaccggtaacttaagttacgttagggttaacggttaccgtaccgggtttagggttacgttttcggggacccggtaacggggtacccgtaacggcggttacgggaaacggtaacgtaaaccggaaaaccggttagttacgggtacggtacctacggaccctaaccgtacgttccgttacggttccttccgttaacccgg

SEQ ID NO: 38675 - DNA, 655 bp, Homo sapiens
  misc_feature: GYAE6OF01DB64A.10.79.H02.1.454.CMB.1.raw
  modified_base (387)..(387): a, c, t, g, unknown or other
  misc_feature (387)..(387): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcgttggtcaagcctggagggtccctgacgactctcctgtgcagcctctggattccgcctctggattgacgttcagttgactactacatcgaccgtgggtccgcaggctccgagggacgggcgtgggagttgggttcagttactatttacgtcctaaggttggtnaacgttaccaagttaactactaacgctaagtacctcgttaggtacgaacggggtccgtaacgttccaaccctactcccgttacccgaacgggtaaccaaccgacccaaacgaaccttaccaacgttcgaaccttttgaactaagtacgaacctacccgtaggaccgacggtacccgaggtaccgaccgggtccgtaagttattacgtgtacgacgtaaacggtaccgttaaaccccgttccggtacctttagggttactttaacccgg

SEQ ID NO: 38676 - DNA, 714 bp, Homo sapiens
  misc_feature: GYAE6OF01BHUSR.10.79.H02.1.454.CMB.1.raw
  modified_base (368)..(368): a, c, t, g, unknown or other
  misc_feature (368)..(368): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctggagcgttgggttttccttgttgcttaattaataaaaggtgtccagtgtcaggtgaagcgtggtggagtcggtgggggagtcgttggtcaacggccgtgggacgggtccctggacgtacctcgtccgtgtcgcacgtcctcgtggtacttccgtcctcgtggtacttcggtaccgttcaggtacgtaacctactactagtccggaccgtcgggtcccnccgaggtccgtaccggaagggggacgggtcgtagggtcggttcggttacaagttactagtttacgtcgttagggtcgtagaacttaacccgtattaacgtaccgacgactaacgtaccgttcgtagggtacgggaacgggtccttaacttaccaaccgtattacccgtaccgaagggaacccaaacgacccgaaagtacctcgtaaccgtcgtacctttagaacctaaagtaccgaaaccctccgtacggacgacggtacccggaaggacccgtaccgtacgtattacgtacgtggacgtaacgaacgtaaccttacccggttagtccttaaggtttcgttaaccg

SEQ ID NO: 38677 - DNA, 736 bp, Homo sapiens
  misc_feature: GYAE6OF01DYG6K.10.79.H02.1.454.CMB.1.raw
  modified_base (576)..(576): a, c, t, g, unknown or other
  misc_feature (576)..(576): n is a, c, g, or t
tcagcatagtagtgcacgaccggtgctcgatttagtgtcacacgaagggaaaggggagctctgggagaagagccccagccccagaacttcccaggagtttccattcggtgatcagcactgaacacagaggactcaccatggagtttgggctgagtcttgggttttccttgttgctattataaaaggtgtccagtgtcaggtgaagctggtggagtcgtgggggagtcgttgggtacaaggtccgtaggggtaacggggtcccctaggaacggtaaccttccgttcccgttggtcggcgtaacggtccctcgtagggtaacttccggcccttcgtggtaactttacggtaacgttcgtagttagtaaccttaacgtacacgtcggtacccgtcgggtcccgacgacggtcctaccgaaggggaggcgtggagttcgggttacagttactatttactcgtagtgtgactacatactactacgctacgactcgtggtacgaacggtacctattccaacgtattccgtaccgaacgggaaccaaccgacctaagtaacctacctaacgttgtaactttanaacgtaaaacgttcccggaaaccgtacccgtacggaacggtaccggaaccggaacgggacccgtaagggttacccgttaagtttacgttacgttggacgtaccggtaaacggtaacccttaaccccggttcgtacccgtttagtttaacctttaacccgg

SEQ ID NO: 38678 - DNA, 189 bp, Homo sapiens
  misc_feature: GYAE6OF01BOGME.10.79.H02.1.454.CMB.1.raw
  modified_base (181)..(189): a, c, t, g, unknown or other
  misc_feature (181)..(189): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccagtggaggtttgggctgaggcgggctgggacaagggcgacatagnnnnnnnnn

SEQ ID NO: 38679 - DNA, 565 bp, Homo sapiens
  misc_feature: GYAE6OF01DC1F4.10.79.H02.1.454.CMB.1.raw
  modified_base (202)..(202): a, c, t, g, unknown or other
  misc_feature (202)..(202): n is a, c, g, or t
  modified_base (446)..(446): a, c, t, g, unknown or other
  misc_feature (446)..(446): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgccagctctcctgcagggccagtcagagtctagcagcaactacgtgcctaggtaacccaacaagaaacctggcccaaggcctcccggggctccgtcatctatggtacatctagcagggccagtggcactcccagacaggttcaggtggctaggtgggtctggggaacaggtacttcacgttctcaactatacagcagtacgtagacgtcgtagaagtatttagcagttgtattagtgtcgtanaattagtggtaagtcgtaccgttagggtacgtttcggccgtagggaccaagtcgtaggacgtaagtacgaaacgtaagtcggtagtacgtgaccgtacctatcttacgtcttcgtaccg

SEQ ID NO: 38680 - DNA, 906 bp, Homo sapiens
  misc_feature: GYAE6OF01D8I7C.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagtcgttgggttttccttgttgcttaattaagtaaaaggtgtccagtgtcgaggtgagtcgtgggtggagtcggtgggggagtcgttggtcgaacgtcggtgggtacgggtccctaggacgtaccttccgtccgttgtcgctacggtccttacgtggtacttccgcccttgtggtaacttcgtaccggttcgtagtacgtaacctactacgtagtccgtaccggtcccgggtccaccggtacggtcccgtaccgggaagggggtacgggtcggtcgggtacggtttacgggttacctaacgttagtttaactttaccggtacgttagggttacggttactaacttaaccctaagttaactaaccgtaccgtacgtaacgtacgttacggttacgggtaacgggtaaccggggtacccttaacttaccccgtaaacgttaccggttacccgaacccgggtaaacccggggtaaaccgtaacccgaaacccgtaaaccgtaacccttaaccgtacggtttaaccgttaccgttttaacgaaacgtttaacgaaccctaaaccccgttaccggtaccggaccggtaaccgggaacccgggaaacgtacccgggaaaccggtttaccggtaacgttttaaccggttaccggtaacgggtacccgggttaaaacccaaaacccgggtttaaccccggtttaacccccggggtttaccttttaaccgggttttaacccgttaacccgggttttaaacccgg

SEQ ID NO: 38681 - DNA, 761 bp, Homo sapiens
  misc_feature: GYAE6OF01E2A8K.10.79.H02.1.454.CMB.1.raw
  modified_base (341)..(341): a, c, t, g, unknown or other
  misc_feature (341)..(341): n is a, c, g, or t
  modified_base (622)..(622): a, c, t, g, unknown or other
  misc_feature (622)..(622): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagtcttggtcaagccgtggacgggtccctgacgactctcctgtgcacgctcgtggtacttccgcctcgtggtattcggaccgttcagttagactaacgtacagtcggacccgtgggtcccnccgacggccgtaccggaggggacggggtcgtgggtaggttcgggtttacagttactattttacgtccgttaggttaggttagtaacgttaaaccgtaatttaacttaccgttaaccggactacgtacctcgtagggttacggaacgggggtaccttaacttaccaccgtacgttcccgtaaccggaacgggtaaacccgaaacccgtaacccgaaacgtaaccgttaccctaaccgttacggtaaccgttttaacgaaccttaaaacgtccgtaaaacccncccgtacgaccggaacccggtaccggaaccggtaacccgacgggtacccgttaaattacgttaacgtcggttacgacggtaaacccggtaaacgttaccccggttaccggtacccgttttaagggttactttaacccgg

SEQ ID NO: 38682 - DNA, 754 bp, Homo sapiens
  misc_feature: GYAE6OF01DST0N.10.79.H02.1.454.CMB.1.raw
  modified_base (636)..(636): a, c, t, g, unknown or other
  misc_feature (636)..(636): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttggttttccttgttgctattataaaaggtgtcagtgtcaggtgaagctgggtggagtcgtgggggaggtcgttggtacaagccgtagggacgggtccctggagtactctccgtgtcgcacgcctcgtggtacttccgccttcgtggtactttcggtacgtttcgaggttacgtaaccttaccgtaacgtacgtaccggtaacccggttcggggtcccgccgacgggtccgtacccggaagggggaacggggtcgtaggggtacggtttggggtttacaacgttaactaacgttttactccgtttaaggttcgggttagtaacttaaccgtaattaacgtaaccgttaaccgactacggtactttcgtaggtaacggaacgggtccgtactttcccgaactaccgtccgtaccggaacggtaaccaaaccgacctaaacgtacctaccgacttacgtactttacgactaaagtacgaaaccncccgttaggacccgaacggtccgaacgggaccaaccgggtaccgttagttaacgttaggtcgtacgtaacgaaccgtaacctttacccggtaggtcccgtttacggttactttacccg

SEQ ID NO: 38683 - DNA, 861 bp, Homo sapiens
  misc_feature: GYAE6OF01C0CDN.10.79.H02.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaancgccacgctctcctgcagggccagtcagngtctagcagcaactcgtgcctagtaaccaacaagaaccgtggacccaggcccgtcccgggtctccgtacacttcgttagtcggtacagttccgtaggccgacgggccctagtcggacctactcccgaagtaccgtaggttcgaggtcggacgtagggttcgggtcgtaggggactacgtaccttaccgacttcctaccgaacctacgtacgacggtacgtaacggtaccggttacgggtacgttacgtaaggttaacggtttacgttttacggaccgtttaagggtttacggttttaaacgttttacggtttacggtaccgtaacggttaaccgtttaaaggtttaacggggtttaaccggggtttaaccgggttaccccggtttaaacccgggggttttacgggggtttttacccgggtttttaaccgggggaaccccgggttaaccggggggtaaaccccgttaaacgggttaccgggttaacggggtaaaccggttaaaccggttaaaacccgggttaaaaccgggttaaccgggttttacggggttaccgggttacccgttaaccggtaacccgtttaacccgttacgttttacccggtttacccggttttacccgttttaccccgg

SEQ ID NO: 38684 - DNA, 724 bp, Homo sapiens
  misc_feature: GYAE6OF01DHBTG.10.79.H02.1.454.CMB.1.raw
  modified_base (206)..(206): a, c, t, g, unknown or other
  misc_feature (206)..(206): n is a, c, g, or t
tcagcatagtagtgcacgaccggtgctcgatttagtgtcacacgaaagggaaagggggagagctgctcagttaggacccagagggaaccataggaaaccccagcgcagcttctcttcctctgctactctgctccagactaccacggaataattgtgttgacgcagtctccaggccaccttgttctttgtcctaccgaaggggaaancgccacgtcctcctcctgcgacggccagtcagtacgttctagcagacctaacgtcgttcgccgttacggtaaccaacgaacgaaccgtcggacccgaccggccgttcccgggccttccctactacgtacttagttcggtactactcgtagaccgacgggcctacgtacggaccaactaccccgaagaccgtaggttacaggttcggaccggtaggtcgggttacggtacgggactacgtacctttccgtactcgtacaacctagttacgaacgacgtacgtacggttacggtacgttacgtagttaagtttagtttacgacgttaggttagtttaagtttagtcgtactaagtactaagttacgttacggttacggtacgttaccggttggtttaccggtttccgggaaccggtaacggggtacctaagggtcgtacggtaacgtaaacgtaacgtaaacggtacggttcggtacggtacgtacgtaaccgtacgttacttcgttccgttcgttaccg

SEQ ID NO: 38685 - DNA, 788 bp, Homo sapiens
  misc_feature: GYAE6OF01ANIM3.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagtctgggttttccttgttgctattaataaaaggtgtccagtgtcaggtgaagctgggtggagtcggtgggggagtcgttggtacaaggcccgtgggacggggttcccctggacgtaccttccgttcctggtcgccacggccctgtcggtacttccgccttacgtggtattcggaccgtttcagttcgaacttacgtacagtcgaccgttggtcccgcgacggcctaccggaaggggtaaccggggcgtagggtaggttcgggttacaacgttaacgttatttacgtccgttaggttcggtacgaacgttacccaattaaccgttactaccggactacgaccgttcgtagggtaacggaacgggaccttaacgttccaacctaacttccgtacccggaagggtaacccaaaccggtacccaaagtaaacccgttcaaaccttcggttaaacctttaggaaccctaaaagtttacgaaaccccgtaccccgtagggacccggtaacggacccgggaaacgggaaccccgtaaccgggtaccgtttaaacttacggtttaacgtcgggtaacgaaccggttaaacgtaaacccgtttacccccggttagcccggttttagggttttaaccttaacccgg

SEQ ID NO: 38686 - DNA, 719 bp, Homo sapiens
  misc_feature: GYAE6OF01AGXY8.10.79.H02.1.454.CMB.1.raw
  modified_base (186)..(186): a, c, t, g, unknown or other
  misc_feature (186)..(186): n is a, c, g, or t
  modified_base (274)..(274): a, c, t, g, unknown or other
  misc_feature (274)..(274): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtntccagtgtcaggtgaagctggtggagtcgtgggggaggcttggtcaagccgtggacgggtccctggacgtactctcctgtgcagcctntggacttcgcctcgtggtattgacgttcagtcgactactacatcgaccgtgggtcccaccgagggcctaccggaagggggtaacggggtcttaggggacgggtttcggggttttacaagtttaacgtattttacgtcccgtttaaggttggttacgtaacttaaccctaagtttaaacttaacccgttaaacggacctaacgtaccgttcgtagggttacggaaacggggtcccgtatttacccgacctacgtcccgtaccgaacgggtaacccaaccgaccaaacggtaacctaccgaccttaggtaacctttaggaacctaaagtacgaaccctaccgtacgaccgacggccggacggaccgaaccggtaccggtaattagttacgtcgtacggactaacggtaaccgttaccccggtacgtaccgttagtttccgttaaccg

SEQ ID NO: 38687 - DNA, 724 bp, Homo sapiens
  misc_feature: GYAE6OF01D1KUR.10.79.H02.1.454.CMB.1.raw
  modified_base (147)..(147): a, c, t, g, unknown or other
  misc_feature (147)..(147): n is a, c, g, or t
  modified_base (194)..(194): a, c, t, g, unknown or other
  misc_feature (194)..(194): n is a, c, g, or t
tcagcatagtagtgcacgaccggtgctcgatttagtgtcacacgaagggaaagggggagagctgctcagttaggaccagagggaaccatcggaaacccagcgcagcttctcttcctcctgctactctggctccagactaccacgganaattgtgtgacgcagtctcaggcacctgtcttgctacgaggggaacngccacgctctcctgcgagggccagtcagtagtacttagcaagctaacgttacgttcgcctaggtaaccaaacgaacgaaacctggaccgacgggtcctacccgggctaccgtacactacgttatcggtacacttcgtaacgcgaacgggcctaacggtggacctacgtaccgaaggacttagggtacctaggtcggacgtaagggttcgggtacgtacgggactaagtacctttcgaactacgtccaaccgtatacgacgtacgaaggtacgtacgggtagtaccgttaaggaacgttagttttacgacgttaaggttagtttaatttacgtttgtacaacgtaacgtaagtaacggttagggtacgttaccggtaaccgttacggggtttaccgtttacgggaaccgggtaacgggtaacctaaacgggtcgaggtaacgtaacggtaaacctaaacggtaacggttaggtcgggtaacctcgggtaaccctaacggtactttacccgttaggttaccctttaacccgg

SEQ ID NO: 38688 - DNA, 739 bp, Homo sapiens
  misc_feature: GYAE6OF01BLMS0.10.79.H02.1.454.CMB.1.raw
  modified_base (715)..(715): a, c, t, g, unknown or other
  misc_feature (715)..(715): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggtttttccttgttgcttattaataaaaggtgtccagtgtcaggtgaagcgtgggtggagtcgtggggggagtcttggtcaagccgtgggacgggtccctaggacgtacctctccgtgtgcacgcctctgggacttccggccttcgtaggtatttggacgtttcaggtcgtaacctactacagtcggacccgttggggtcccaccgagggccttacccggaaggggggaaggggcttggggtacgttcgggggtttacagttacctaagttttactccgttaggttcggtagaacttaccaatttaactaccgtaacgctaagtaccttcgtaggtagggaacgggtcctattaccgacctagttcccgtaccggaaggggtaacccaaaccggtaacccaaacggtaaccctaccgtaacgttacggtaaccgttttaacgaaccttaaaacgtcgaaaccctacccgtaggaccggacggacccggaaggcccgtaaccggtccgtaattacttacggtcggacgacgaacggtaaaccttaccccgggtttaccncggtttaaggtttaaccttacccg

SEQ ID NO: 38689 - DNA, 640 bp, Homo sapiens
  misc_feature: GYAE6OF01B6A8W.10.79.H02.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccacgctctcctgcagggccagtcagagtcttagcagcaactacgttgcctggtaccaacagaaacctggccaggcctcccgggctcctcatctatggtacatccaacgacgggccacgtggccacgtccccagcctaggttcaggtcggctaggtgggtacgtgggacaggacttcactctcacctatcatcacgcctggacgccgtagaagtatgttgtacttagtttacttacgttgtacctaactacgttaccggtaaccgtgtccgggtacccggttcccgggggtacccttaaccggtttcccgggaccccggttacggggtaaccgtaaacgggttgggaacgtacgtaaccgaaaaccggtaccgttaggtcgggtccgtacgacccgtaccgtacttcgttacgttacctttccgtaccgtttccccg

SEQ ID NO: 38690 - DNA, 1054 bp, Homo sapiens
  misc_feature: GYAE6OF01CG7EM.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagtctgggttttccttgttgctattaataaaaggtgtccagtgtcaggtgaagtcttggtggagtcgtgggggaggcttggtacaagtccgtgggacgggtccctgacgtacctctccgtgtcgcacgtccctcgtggtacttccgcctcgtggtattcgtacgtttcgagtcgtaccttactactagtccgaccggtcgggtcccgaccgacgggtacccgtacccgggaagggggtaacgggggtccggttaggggtaacgggtttcggggttttactaacgtttaacccgtttaagtttttaaccgttacccggtttagggtttacggggttaagttaaaccgtttaccccgtaaatttaacccgttaaacccgtacccgggtacgtaaccggttaaccgtttccggttaggggttaaccgggaaaccgggggtcccttaaccgtttacccgtaaccccttaaccgttttaccccggaaccccgggtaaacgggggtaaaaccccaaacccccgggtaacccgaaaaccgggtttaacccccgttaacccgttaacccgggtttaacggttttaaaccccgttttaacggtaaacccgttaaaaacccgggtttaaccgggaaaacccccccttaaccccgggttacgggaaccccggggtaaccggggtaacccccggggtaaaggggtaaaccccccgtaacccgggggtttacccggttttaaaaacgtttacccggttttaaacggggttacccgggtttaccgggaaacccccggggtttaaaacggtttaaaaacccccgggttttaacccccccccggggtttttaaccggtttaaccccccgggttttttaaacggggtttttaaaccccccggttttttaaaacccccggg

SEQ ID NO: 38691 - DNA, 571 bp, Homo sapiens
  misc_feature: GYAE6OF01BK2HT.10.79.H02.1.454.CMB.1.raw
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggagcttggtcaagcctggagggtccctgagactctcctgtgcagcctctggacttcgcctcgtggattgacgttcagtgactactacatcgaccctgggtcccnccaggcctccgaaggggagggctgggagtgggtttcagtactatttacnctaggtgtnataccatactactacgcagactcgtgtagacgggccgtatcaccactacctccgacggaaccaaccgaccaacgaactcactcgactttagactaagtacgaaccacccgtgaccgacgccgaggaccacgggtacgtatacttactcgtgacgaacgtaactacccgttacgtaccttggttacttaccg

SEQ ID NO: 38692 - DNA, 742 bp, Homo sapiens
  misc_feature: GYAE6OF01D0GXI.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggagcgttggtcaagtccgtgggacggtccctgacgtactctccgtgtcgcagcctcgtggtacttccgccttcgtggtattcgacgtttcaggtgaccttactactagtcgaccgtcggggtcccgccgacggcctaccggaagggggaacggggtcgtagggtaggtttcggggtttacaacgttaacgttaattttaccgtaccgttaaggttcgggtagtaactaccctaattaacctaaccgtacgcgtaacgtaccgttacgttagggtaacggaacgggtacccgtaattcccgaacctactacccgtaccggaacgggtaacccaaaccggacccaaacgtacctacaaccgttagttaaccgtttagaacctaaacgtaccgtaaaccctcccgtaggaccggtaccgaccgggaacggaccgtaccggtaccgttaattacgttacggtaggtaccggaacgtaacgtaaaccgttacccggttacgtacccgtttaggttaacccttaccgg

SEQ ID NO: 38693 - DNA, 636 bp, Homo sapiens
  misc_feature: GYAE6OF01EQAO4.10.79.H02.1.454.CMB.1.raw
  modified_base (399)..(399): a, c, t, g, unknown or other
  misc_feature (399)..(399): n is a, c, g, or t
tcagcatagtagtgcacgaccggtgctcgatttagtgtcacacgaaagggaaaggggtctgggagaagagccccagccccagaattcccaggagtttccattcggtgatcagcactgaacacagaggactcaccatggagtttgggctgagctgggttttccttgttgctattataaaagtgtccagtgtcaggtgaagcgtggtggagtcgtgggggagcttggtcaagcctggacgggtccctgagacctctcctgtgcagcctcgtggacttcgcctctggattgacgttcagtcgacttactacatcgaccgtcggggtcccgccgaggcctaccggaggggaacggggtctagggtaggttgggtttacattactatttactccgtaggtggtnactacctattactacgtacgcaacgtactcgtgtacggacggccgtacgttccaacctcgtacctaccggaaggaccaaccgaccaagacctcacgtagtactttacgaactaaacgtcgaaccctaccgtgaccgacgaccggaaggacccgaccggtaccgttaattacgtacgtgacggcgaacgttaaccgttacccgttcgtaccgtttaggtttaccttccgtgtaacccg

SEQ ID NO: 38694 - DNA, 835 bp, Homo sapiens
  misc_feature: GYAE6OF01BH05O.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggcctcccagactaccaccggagaaattgtgttgacgcagtctccaggcctacccgtgttctttgtccgtaccggaaggggaaagcgacccacgcctctccgtgacgaggccagtccagtacgtacgttacgcgacgactaaccgttacggttacggacccgttacggtaacccaaaccgtaaccggtaaacccgtcgggacccgaaccgggtcccggttaccccggggtcctccccgtaccgtacttaccgtacgttacggttaacctacgttccgtacggaccgtaaccggggtcccaacggtaccgggtaccctaaccgtaccccgtaacggtaaccgttacggttccgaaggtcggaccgtaaggggttcgggtcggttacggggaaccgtaacggtacctacctaccgtaccgtaccaacctacgtaccacgtacctaacggtacggtacggtacgtaccgttaaggttaacgttacggtttagacggtttaagttacggtttaatttacggttagtaccgtaaggtacttaaggtacgtagggttacgttacggtaccggttagggtttaccgttcggaaccgggtacgggtaacgtacggtacggtaaggaacgtacggtaaacggttaccggtaacggttcggtaacggtccgtacggtaccctaaccgttagttccgttaccgttcccgtttaacccg

SEQ ID NO: 38695 - DNA, 918 bp, Homo sapiens
  misc_feature: GYAE6OF01AO5TT.10.79.H02.1.454.CMB.1.raw
  modified_base (100)..(100): a, c, t, g, unknown or other
  misc_feature (100)..(100): n is a, c, g, or t
  modified_base (218)..(218): a, c, t, g, unknown or other
  misc_feature (218)..(218): n is a, c, g, or t
tcagcatagtagtgcacgaccggtgctcgatttagtgtcacacgaagggaaagggggagagctgctcagttaggacccagagggaaccatggaaaccccngcgcagcttctcttcctcctgctactctggcctccagatacccaccggagtaaatttgtgttgacgtcagtcctccgaggcctacccgtgttctttcgtacgtaccgaggggtaaacncgcctacgtcttccgtccgtacgcgacgggtccagtcaggtacgttcttacgcaacgtactaaccgttacggttcgccgtaggtaaccaaacgaacgtaaccgtcggaccgtacggtcccgtcccggtcttcctacgtacttcgtaacgttcggtaactacgttcggtaccgtacggaccgggtaccctacggttaccggaccgttaacccgtaccccggaacggttaaacccggttacgggtttacccgtaaggggggtccggtaaccggttaacggggggttccgggttaaccgggttaaccggggaaccgtttaaccggttaacccttttacccggaaccccgtttcccgttaaccgtaaccggtaaccgttaccggtaacggaaccggttaaccggtaaccggttacgggtaccgttacggttaaggttaacggttaggtttaaccggtacggttacggtttaacgtttaacgtttacgtttacgttaccgtaacggttaacgtttaaccgggtaaggtttcggttaaccggtacggttaaccggggttacgggtttaaccggtttaccggggaccggtttaacgggaaccgttacgggtcggttaacggacgttaacgtaacggtaaccgttaacggtcggttacgtaccgtaccggtaccttaccggtagttaccgttacgttccgttaacccg

SEQ ID NO: 38696 - DNA, 758 bp, Homo sapiens
  misc_feature: GYAE6OF01DHOZ8.10.79.H02.1.454.CMB.1.raw
  modified_base (432)..(432): a, c, t, g, unknown or other
  misc_feature (432)..(432): n is a, c, g, or t
tcagcatagtagtgcacgaccggtgctcgatttagtgtcacacgaagggaaagggggagctctgggagaagagccccagccccagaattcccaggagtttccattcggtgatcagcactgaacacagaggactcaccatgggagtttgggctgagctgggttttcctgttgcttattataaaaggtgtccagtgtcaggtgagctggtggagtcgtgggggaggtcttggtcaagccgtgggacgggtccctggacgactctcctgtgcagcctctgggacttccggccttcgtgggtatttgaacgttctaggtgaacctactaacgattcggacccggttcggggtcccgaccgacgggccttacgggaaggggggtaacggggtctagggtaggttgggtttcaagtactatttacgtcttaggtggtntaactactatatacgtcgatacgtacttcgtagtacgggaacgggtcctaattccaaccacttcccgtaccggaagggaacccaaaccggacccgaaacgtaactaccgtaaccttagttaaccgttttagaaccgttaaaacgtcgtaaaacccctacccgttacggaccggggtacggtaacccgggaacgggtaacccgtaacccgggtaccgtttaaacgtttagtttaaccggttacggtacgggacggttaaaaccggtaaaccggtttaacccccggttacggttaccccggtttagggttttaaccgttttaacccgg

SEQ ID NO: 38697 - DNA, 824 bp, Homo sapiens
  misc_feature: GYAE6OF01ESATL.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggcctccagactaccaccggagtaaattgtgttgacgcagtctccaggccacccttgttctttgtcctaccgaaggggaaagcgccgacgcttcctccgtgcgagggccagtcagtacgttcttagacacgactaaccgttacggtttcgaccggttacgtaacccaaaccgaacgtaaaaccccgtcgggacccgaacgggtcccgttccccggggtaccttccccgttacgtaacttccgttaagtacgggtacctacgttaccggtacgaccggtaccgggccctaggtcggtacctacgtaccccgaaggtaccgtagggttccgacggtcggacgtagggttcgggtcgtacgggaactacggtacttccgtaccgtctacccgaacacgtccgacgtacgacgtacggtacgggtactcgtaaagttacgttacgttttacggacgtaaggttttacggttaatttaccggtttagacccgtaaggcccgttacgggtaacgggtttacggaccggtttaacggggtttccgtttaaccccgttttccggtaaccccggggttttccccgggggaaccccggtaaggtaaaacgggttacgggtaaactaacccggtaaacggtacgttcgggtacggtacgcgtaaccgaccgttacttcgttaacgttcccttaacgtcgttcccccg

SEQ ID NO: 38698 - DNA, 693 bp, Homo sapiens
  misc_feature: GYAE6OF01BB0A1.10.79.H02.1.454.CMB.1.raw
  modified_base (182)..(182): a, c, t, g, unknown or other
  misc_feature (182)..(182): n is a, c, g, or t
  modified_base (600)..(600): a, c, t, g, unknown or other
  misc_feature (600)..(600): n is a, c, g, or t
  modified_base (666)..(666): a, c, t, g, unknown or other
  misc_feature (666)..(666): n is a, c, g, or t
tcagcatagtagtgcacgaccggtgctcgatttagtgtcacacgaagggaaaggggtctgggagaagagccccagccccagaattcccaggagtttccattcggtgatcagcactgaacacagaggactcaccatggtagtttgggctggagcggtggtttcgtgtagctatagtaaaggtntccagtgtcaggtgagtcgtggtgagtcgtgggggaggtcttgggtcaacgtccgtagggtacgggtccctagacgactcgtcctgtcgcacgtcctcgtaggtcgtccgtcctgtggtattacggtacgtttcaggttcaacttacactacgtcggtacccgtcggggtacccgccgtaggacccgttaccggagggggtaacgggtcgtgggtaagttgggttaccagttacgtaacttttcgtcgttaggttggtacgtaactaacctaataacgtacctaggtacaacgtcgtaccgtaggtacggaacgggtcctaacgttacccgaaccgtactaccgaccgtaaccggggaactaacccgagaaaccgtacctcgtaactaggtaccttgaaacctaataccgacgtaccngacacggacgacggacccacgtaccgtatactacgtacggaggtacaacggtaacttaccccggtntacccggttagttacctccgtgtaccg

SEQ ID NO: 38699 - DNA, 1194 bp, Homo sapiens
  misc_feature: GYAE6OF01D0S4Y.10.79.H02.1.454.CMB.1.raw
tcagcatagtagtgcacgaccggtgctcgatttagtgtcacacgaagggaaaggggagctctgggagaagacgccccacgccccagaacttcccaggtagtttccagttcggtgatcagcactagaacacgagacgactcacctagtggtaggtttggctgagttcgttgggtttttccttggttcgtactttaatttaagtaaaacggttcgtaccgtagttgtacgagggtagtaaggtcgttggggttaggaggggttcgggtagggggggtacgttcgtttcgggtaacgtaaacggtcccggtacggggtaccgggttccctaggacggttaccttccgttccgtacggtcgtaccgtacccgttccgttacggttacggttaccttttcccggcctttacggtacggggtttaatttccgggtaccgtttacggtacggtttaccggttaaccttaccgttaacttacggtaccgggttacccggtcccggggggtaccctaccggacgggtacccgttacgggggaaacggggggtacgggtccgggtttagggttacggggtttaccggtttaactaacgttttaacgttacgttttaaccgtttaccgggttagggttaacggtttaccgtaaaccgtttaacgtaaacgttttaaacccgttaaccgggtaacccggtacgggttaaacggtttacccggtttacgggttaaaccggggtttaaccgggggtaaaaccccggggtttaccggttttaaaacccctttaccccgaaaccccggttttaaccggtttaaccccccggaaaccggggggtaaaacccccgggtaaacccccggtaaaaccccgggtttaaaaccccgaaaaaccccggggttttaaaccccctaaacctttttaaccgggtttaaccttttaaaccctttaacccggaaaacgtttaaacccggtaaacccgtaaacccccgttaaccgggacgggttaaccccggaaacccggggaaccccggttaacgggtaaaccccggttaaaccgggtttaacccttttaaaggttttacccggtttaccggtaaggtacccggggtaaaaccccgtaaacgggttttaaccccccgtttaaccccggggtttaacccgttacccggttttttaaacggtttttaaaccccgttacccgggg

SEQ ID NO: 38700 - DNA, 768 bp, Homo sapiens
  misc_feature: GYAE6OF01A1G30.10.79.H02.1.454.CMB.1.raw
tcagcatagtagtgcacgaccggtgctcgatttagtgtcacacgaagggaaaggggagctctgggagaagagccccagccccagaattcccaggagtttccattcgtgatcagcactgaacacagaggactcaccatggtagtttgggctgagtcttgggttttcttgttgctattaagtaaaggtgtccagtgtcaggtgagctggtggagtcgtgggggagtcgttggtcgaagccgtgggacgggtccctggacgtactcgttcctggtcgccagccctcgtggtacctttccgcccttcgtaggtacgtttgaccggtttacagttcgaaccttacgtactagtccggacccgttcggggtcccgacccgacgggtcctaccggaagggggacggggtcgtagggtacggttcggggtttactacgttacttatttacgtaccgtttaggtagttacgtaactacctattaacgtaccgtacgacctacgtaccttcgtacggtacgggaacggtccgtacttaccgacctacgttacccgtaccgaccggtaaccaaccgtaccgtaacgtaactccgaaccgttagttaccgtttaggaacctaaacggtcgaaacccctacgtcggtacccgacggttacccgggaaacgtacccgtaccgggtaaccgtttaacttacgtttaaccggcgggtaaccggaccgttaaaccggttaccgtaaccccggtttccgaaccgttttagttaaccgtttaccccg

SEQ ID NO: 38701 - DNA, 764 bp, Homo sapiens
  misc_feature: GYAE6OF01AXA8J.10.79.H02.1.454.CMB.1.raw
  modified_base (277)..(277): a, c, t, g, unknown or other
  misc_feature (277)..(277): n is a, c, g, or t
  modified_base (371)..(371): a, c, t, g, unknown or other
  misc_feature (371)..(371): n is a, c, g, or t
tcagcatagtagtgcacgaccggtgctcgatttagtgtcacacgaagggaaagggtagctctgggagaagagccccagccccagaattcccaggagtttccattcggtgatcagcactgaacacagaggactcaccatggagtttgggctgagcgttgggtttttccttgttgcttattaataaaaggtgtccagtgtcaggtgaagcgtggtggagtcgtgggggagtcgttggtcaagccgtggacgggtccctgagtctctcctgtgcagcctntggcttccgcctcgtggattcgtacgttcaggtcgacttactacagtcgaccgtcgggtccaccgaggcctaccggaggggtacggcgtagggnggttcgggttcagtacttacgtttactccgtaggtcggtagacttaacgtattaacgttacgtaccggactaagaccgttcgttaggtacgggtaaacgggccttaactacccgaccgttaacgtccccggtaacccgtaacggggaaacccaaacccggacccgaaaacgtaacccctcggtaaacccgtttaggttacctttaacgggaaactaaaccgttaccgaaaaccccgttccccgagggtaacccggtaaccggacccgggtaacggacccgggttaaccccgggtaccgtttaaacgttaccgttaacggtggaacccggtacgtaaacggtaaacccgtttaccccgtacggtcccgttttaacggtttaacgtttaccccgg

SEQ ID NO: 38702 - DNA, 667 bp, Homo sapiens
  misc_feature: GYAE6OF01CD6UN.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggctccagataccacggagaaattgtgttgacgcagtctccaggcaccctgtctttgctccgaggggaagacgccacgctctcctgcagggccagtcagagtctagcagcaacttacgttgcctaggtaaccaacaacgaaaccgtggaccacggccgtcccgggctccgtcacttctcgtggtcgactacgttccgttacggacggcctacggttcggtccgtccccgaaggtcccgtaggtttaccgaggttcggccgtagggtcggggttactaacgggaactacggtacgttccaacgtcctaccaaccgtatccgaacgtccgtcccgtagccgtagttcgtaaggttaaacgttcgttttgacctttaagttttacttaacgttcgtactaagtactaagttactaagtcgtttacgtttaggttttacctcgttaccgtttcggaccgttaggaccgtaagttcgtattaccgagtaccgttagtggtacgcgtacgacctacgttcttcgttacgttcttcgtcttccccg

SEQ ID NO: 38703 - DNA, 804 bp, Homo sapiens
  misc_feature: GYAE6OF01DNCU4.10.79.H02.1.454.CMB.1.raw
  modified_base (770)..(770): a, c, t, g, unknown or other
  misc_feature (770)..(770): n is a, c, g, or t
  modified_base (776)..(776): a, c, t, g, unknown or other
  misc_feature (776)..(776): n is a, c, g, or t
tcagcatagtagtgcacgaccggtgctcgatttagtgtcacacgaaggggaaagggggagagctgctcagttaggacccaggagggaaccatacggaaaccccagcgcagcttctcttcctcctgctactctcggcctccagactaccaccggaagtaattggtgttgacgctacgtcctcgacggcctacccttgttcgtttcgtccgtaccggaaggggaaacgacgaccgacgtcctcctccgtcggaccgacggtaccgtacgtacgaggtacgttacgttacggcctaacggtaccttaacgttaccggtttcgtacccggttaacgggtaaaccctaaacggtaaaccggtaaccggtacgggtacccggtaacgggtccccggttcccggggtacccttacccgtacggtaacctttacggttaacggttaccggttaacctaccggtttaccgtaacgggacccgggtaacccgggtaccgtaaccggttaccgggacccttaacccgggtaccccgtaaacgggtaccggttaccggttacggtacgggtacggtacgggtacgggttcggggtacgtacgggtaacgtacgtacttcgtacctacgaccacgtactacgtaacgccgtaggtcgaggttacgtcgtaagttacgttaggttcacggttagttattaagttcgtagtaccggaatagttactaggtcggtaactcggtacgtggtactcggacgtaggctgtgacgtagaacctacgtagngttcgngccgtatcgtactatgttacccgtgtcc

SEQ ID NO: 38704 - DNA, 501 bp, Homo sapiens
  misc_feature: GYAE6OF01BGD9U.10.79.H02.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctccgggctccncatctatggtacatctagcagggccatggcatcccagacagttcagtgcagtgggctgggacagacttcactctcaccatcagcagactgagtctgaagattttgcagtgtaattattgtacagacaatagtgtaggtcacctgggtacttttggcgagggaccaagctggagatacaaagtaactgtaggctagcaccatctgtcttacg

SEQ ID NO: 38705 - DNA, 749 bp, Homo sapiens
  misc_feature: GYAE6OF01DGSCM.10.79.H02.1.454.CMB.1.raw
  modified_base (630)..(630): a, c, t, g, unknown or other
  misc_feature (630)..(630): n is a, c, g, or t
tcagcatagtagtgcacgaccggtgctcgatttagtgtcacacgaagggaaaggggagctctgggagaagacgccccagccccagaacttcccaggtagtttccattcggtgatcagcactgaacacagaggactcaccagtgggtagtttggctgaggtcgtttgggttttccttgttgtcttaattaagtaaaaggtcgtccagtgtcgaggtgagcgtgggtggtagtcgggtgggggtagtcgttggtacgaacggtccgtgggacggttccctgacgtcctcctccgtgtacgcacgtcctcgtcggtacttccgccgttcgtggttacttcggaccgttctaggtacgtaaccttactaactggtaccgtacccggtcgggtcccgaccgacgggtcccgtacgggagggggtacggtcggtgggttagtttcggttactattaaccgtttatttacgtccgttaaggtggtaatactaccttagttaactacctacggctacgtacctgtacggtacggacggtccttatacccgactctacccgacgaacgtaaccgaacccgtaacaaacgtacctacacggtttaacgaccgtttacgaacttaacgtaccgtaaacccncggtacgaccggtaccggaccggtaacgcccggtaaacgtcgtttaaactcccggttagtcgtaccggaacggttaccgtaaaccgttacccgtgtttacgtttacgttaaccgttccg

SEQ ID NO: 38706 - DNA, 663 bp, Homo sapiens
  misc_feature: GYAE6OF01EOPMG.10.79.H02.1.454.CMB.1.raw
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaagngccacgctctcctgcagggccagtcagagtctagcagcaacgttacgtcnccgtaggtaccaacacgaaacctcggccaggccgtcccgggctcctacactctagtacggtactactcgtagccgacgggaccacgtggacacgtccccagtacgtacggttacaggtcggacgtagggtgggtcgtaggggactacgtacttacgacctctaccgaacctactcgacgtacgacgtacgttagggagttacgtagtaagttacgtttaggacttaggttagtttagtttagtttacgtacgtagtaacgtaagttaggttaggttacggttaccgtaccggtttacggggttaccgttttcgggaccggtaacgggtaccgtaaggtcggtaggtacgtaacgtaaccgaaacggtacgttaggtcggtctcgacctacgtattccgtcgttcgttaccg

SEQ ID NO: 38707 - DNA, 743 bp, Homo sapiens
  misc_feature: GYAE6OF01EJOC9.10.79.H02.1.454.CMB.1.raw
  modified_base (341)..(341): a, c, t, g, unknown or other
  misc_feature (341)..(341): n is a, c, g, or t
tcagcatagtagtgcacgaccggtgctcgatttagtgtcacacgaagggaaagggagctctgggagaagagccccagccccagaattcccaggagtttccattcggtgatcagcactgaacacagaggactcaccagtggagtttgggctgagcgttgggttttccttgttgcttaattaagtaaaaggtgtccaagtgtcgaggtgaagcgttggtggagtcggtgggggagtcgttggtcgaaacgtccgttgggacgggttccctaggacgtaccttctccgtgtcgcagtccctcggacttcgcctcgtggattcgtacgttcagtcgtactatacngtcgaccgtcggtcccgcgaggcgtacgagggtagggcgtgggaggtttcgggttactagtacctagttttacgtaccgttaggtcggtagtaccttacgtaaacgttacttaccgtaacgactaagtaccgttgtaggtacggaacggtccgtaactttcccgaaccgttacctcgtaacccggaacgggtaaaccaacccgtaaccgaaacgtaacctaccgtaactacgttacgtttagaacctaaataccgaaccctacccgtacgccggtaaccggccggaaccggaacccgtaccggtaaccgttacgtaacgttacgttagggtaccgtacgtaaacgtaaacccgtttaccccggttacgttacccgtttaggtttaacccgttccgttaacgg

SEQ ID NO: 38708 - DNA, 825 bp, Homo sapiens
  misc_feature: GYAE6OF01B4TIG.10.79.H02.1.454.CMB.1.raw
  modified_base (321)..(321): a, c, t, g, unknown or other
  misc_feature (321)..(321): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgttgggttttcctgttgcttattaagtaaaggtgtccagtgtcaggtagagcgtggtggagtcggtgggggagtcgttggtaccaaggccgtgggacgggtccctgacgtacttctccgtgtcgcacgtcctcgtggtacttccgcctcgtggtactttgtacgttnagtagtactactactgtacggtaccgtcggggtcccgccgacggtcccgtacccgggaagggggaacggggtccgtaggggtacggtttcggggttttactaacgttacgttaacgttttaaccgttccgtttaagggttacgggttacgtaaccttaccgtaaattacgttaacccgtaccgtaacgtacgtaccgttacggtttacggttacgggaaccggggttcccgtaacgtttacccgaacccgttacttaccccgtaccggaaccggggtaaacccaaacccgacccgaaaccgtaacccttaccgtaaccgtttacgttaaccgtttaagaaccgttaaagtacccgtaaaccctacccggtagacccggaccggacccgggaacggtaaccggtacccgggtacgttaacttacgtttacggtcggtcggaaccgttaacgtaaccccgtttaacccggttccgtacccggttttaggtttaacccgttacccgg

SEQ ID NO: 38709 - DNA, 831 bp, Homo sapiens
  misc_feature: GYAE6OF01DILER.10.79.H02.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcacacgaaagggaaagggggagagctgctcagttaggacccagagggaaccatggaaaccccagcgcagcttctcttcctcctgctactctggctccagataccacggagtaattgtgttgacgcagtctcaggcacctgtctttgtcctaccgagggaaagngccacgctctcctgcgagggccagtcagagttctagcagactaactacgtacgcctaggtaaccaacgaacgtaaaccgtcggaccacgggacccgtcccggggtaccttcccgtactacgtttccgtttaggtaacgtttccgtacttttaccgaaaccggtaccgggtcccccgttacggtcccgtacccgacgggtccgttaacgggttccacgggttcggacggttaagggttcggggttccgttacgggggaacctaacggttaccgtttaccgaccttccctaacacccgtactaccggtaacgtccgaacggttaccgtaacgtaccgtaccgttaaggttaacgtttacgttttacgtacgtttaagttttaacgttcgttacgtcacggtacctaggtccggtttaccgacccgtttcgggtttaccgggcgggttaccgggttaccgttacccgggtttaccgggttacgggggtaaccgggtaaaccgggtaacgtaaaaacggtacgggttaaacggtaaaccggtaaacgtaacgggttcggttacgggacgttccggaaccgttacctacgtttccgttacgttctttaacccggttcgttcccggttaacccccg

SEQ ID NO: 38710 - DNA, 616 bp, Homo sapiens
  misc_feature: GYAE6OF01EE5D7.10.79.H02.1.454.CMB.1.raw
  modified_base (186)..(186): a, c, t, g, unknown or other
  misc_feature (186)..(186): n is a, c, g, or t
  modified_base (405)..(405): a, c, t, g, unknown or other
  misc_feature (405)..(405): n is a, c, g, or t
  modified_base (518)..(518): a, c, t, g, unknown or other
  misc_feature (518)..(518): n is a, c, g, or t
tcagcatagtagtgcacgaccggtgctcgatttagtgtcacacgaagggaaaggggagctctgggagaagagccccagcccccagaattcccaggagtttccattcggtgatcagcactgaacacagaggactcaccatggagtttgggctgagctgggttttccttgttgctattataaaaggtntccagtgtcaggtgaagctggtggagtcgtgggggagcttggtcaagcctggacgggtccctgacgactctcctgtgcagcctcgtggacttccgcctctggtattgacgttcagtgactactacagtcgaccgtcgggtcccgccgtagggcctccggaaggggaacggggtcgtgggtaggttggggtttacagttactatttacgtcgtagtggtnataccatactactacgcacgactcgtgtacgaacgggcctattcacctatccgtccgaacggaccaaccgacaacgtacctacacgtgtaactttcgaactaagtacgaaccnccgtgacggacgccgacggaccgaccggtctaagttacttacgtggtacgacgaaacgtaaccttaacccgttcgtaccgtttaggttacttacccgg

SEQ ID NO: 38711 - DNA, 744 bp, Homo sapiens
  misc_feature: GYAE6OF01A6Q6O.10.79.H02.1.454.CMB.1.raw
  modified_base (263)..(263): a, c, t, g, unknown or other
  misc_feature (263)..(263): n is a, c, g, or t
  modified_base (331)..(331): a, c, t, g, unknown or other
  misc_feature (331)..(331): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtgggacggtccctgacgactctcctgngcagcctgtggtacttcgcctcgtggtattgacgttcagtcgactactacatcgaccgttgggtcccnccgaggcctaccggaagggggacgggtcgtgggaggttcggggtttacaagttaacgttagttttaacgtccctttaaggtggttagaaccttaacctaagttaccttaaccgtacggacgaacgtaccgttcgttacggtacgggaacggggtacccgtacttacccaacctagttccccgacccggtaacgggaaaccctaaaccggaacccaaacggtaaccttccaacgtttcgtaacttttcgaaaccaaagttaccgaaacccgtacccgtcggaccgaccggtacccgaacgggtaccgaacccggggtactttaaagttacccgttaacggttcggtaccgaacgttaaaccggttaacccgtaccccggtttcggtacccgttttaggtttaacccttacccgg

SEQ ID NO: 38712 - DNA, 810 bp, Homo sapiens
  misc_feature: GYAE6OF01EBKD7.10.79.H02.1.454.CMB.1.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttggctgagtcgttgggttttccttgttgctaattaataaaaggtgtccagtgtcgaggtgagctggtggagtcggtgggggagtcttggtcaagtccgtgggacggtccctgacgactctccgtgtgcagcctgtggtacttccgcctntgattgactnagtnactactacagtcgaccgtcgggtcccncgacggccgtacggaaggggacgggtcgtgggtacggttcggtttacaagttacttacgtttacctccgttaggttacggtacgaactaaccgtaattaacttaaaccgtacgacgtaacggttaccttaccgttagggtaacgggtaaccgggtacccgttaacgttacccgaaccctaccgtttaccccgtaacccgggtaaacggggtaaacccccgaaaacccggtaacccctaaaaccgtaaccccttaaccgtaaccctttacggtaaaccgttttacgaaacccgtaaaacgtaacccgaaaccctaccccggtaggaacccggaccggtaacccggaacggtaaacccggacccggttaaccggttaaactttacgtttacggtccggtaaccgtacggtaaaccgttaaaccccgtttaaccccggttacccggttaccgttttacggtttaaccgtttaaacccgg

SEQ ID NO: 38713 - DNA, 727 bp, Homo sapiens
  misc_feature: GYAE6OF01BZFPA.10.79.H02.1.454.CMB.1.raw
  modified_base (671)..(671): a, c, t, g, unknown or other
  misc_feature (671)..(671): n is a, c, g, or t
tcagcatagtagtgcacgaccggtgctcgatttagtgtcacacgaagggaaaggggtctgggagaagagccccagccccagaattcccaggagtttccattcggtgatcagcactgaacacagaggactcaccatggagtttgggctgagcgttgggttttccttgttgcttattaagtaaaaggtgtccagtgtcaggtgagcgtgggtggagtcggtgggggaggtcgttggtacaagccgtgggacgggtccctagacgaccttctcctggtcgctacgccttcgtcggtacgttcccgccttcgtaggtacgtttcggtaccgttctaggtacgtaaccttacctactacgtccgtaccggtccgggtcccgccgaggccgtaccggaggggagggtcgtagggtacggttcggttacattaccgttatttacgtaccggttagtcggtacgtaacttacctaagttactacgtacgactagtacttcggtacgtaggggtaaccggtcctaacttacccgaaccgttacctccggaaccggaacgggtaacccaacggtaacccaaagtccctacgtaacgttacggtaacttaggaaactaaacgtcgaaaccctcccggtagacccgaggacggaacgactccgggtaacttaatcgttacggngtacggtacgaaagtacccgtacgttctacgtttaggtacctttcgtacggtacgg

SEQ ID NO: 38714 - DNA, 656 bp, Homo sapiens
  misc_feature: GYAE6OF01C6TA2.10.79.H02.1.454.CMB.1.raw
  modified_base (254)..(254): a, c, t, g, unknown or other
  misc_feature (254)..(254): n is a, c, g, or t
  modified_base (575)..(575): a, c, t, g, unknown or other
  misc_feature (575)..(575): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagttgggctgagcttggtttccttgttgctattataaaaggtgtccagtgtcaggtgaagcgtggtggagtcggtgggggaggtcgttggtacaaggtccgtggacgggtcccngacgtactcgtccgtgtcgcacgtcctcgtggtacttccgccttcgtggtattacggtacgtttaccgaggttcgtaaccttaactactatcggtaccgtcggggtcccgaccgacggccgtacccgggaagggggaacgggtcgttgggacggtttcgggttacaagttacgttactttacgtccgtaggttggtataacgtactattactacctacgactagaccttcgtaggtacggaacggccgtaattccgaacttagcccgtaccgaaggaaccaacgcaagactcagtcgtaccttgaacctaagtcaaacccncgtgcgtacgacgtacggaccgacgtcgtatatcgtggactacgaacttaccgtacccgttgtaccgttgttaacgttccg

SEQ ID NO: 38715 - DNA, 649 bp, Homo sapiens
  misc_feature: GYAE6OF01E3WBF.10.79.H02.1.454.CMB.1.raw
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (526)..(526): a, c, t, g, unknown or other
  misc_feature (526)..(526): n is a, c, g, or t
tcagcatagtagtgcacgaccggtgctcgatttagtgtcacacgaagggaaaggggagctctgggagaagagccccagcccccagaattcccaggagtttccattcggtgatcagcactgaacacagagactcaccatggagtttgggctgagtcgttggttttccttgttgctattaataaaaggtcgtccagtgtcaggtgagctggtggacgtcgtggggagcgttggtcagccgtggacggtccctgagacctctccgtgtcgtcacggccttcgtggtacttccgccttcgtgtattcgtacgttcgagttgacctacgtanagtcgacgtcggtccncgaggctccgaaggggaggtctagggagttcggttacagtactagtttcgtacgtagggttgtagaactttaccctagttaacctacgttaacgcgtaacgtacgtccggtaggtacggtaacgggtaccttacgttaaccaccgtatacccgtaccgtaacggaacccaacgaacccgtaanaacgtacacgttacgacgtttacgaacttaacgacgtaaccaccgttaggaccgacggccgaagaccgacgtacgtacttatacgtcgtgacgaacgtactaccgtcgtcgttgtacgttacg

SEQ ID NO: 38716 - DNA, 751 bp, Homo sapiens
  misc_feature: GYAE6OF01E41BA.10.79.H02.1.454.CMB.1.raw
tcagcatagtagtgcacgaccggtgctcgatttagtgtcacacgaagggaaagggggagctctgggagaagagccccagccccagaattcccaggagtttccattcggtgatcagcactgaacacagaggactcaccatggagtttgggctgagtcttgggttttccttgttgctattataaaaggtgtcagtgtcaggtgaagctggtggagtcgtgggggaggcttggtcaaggccgtgggacgggtccctggacgacttccgtccgtgtcgccacggtcccttcgtcggtacttccgcccttcgtggtattcggacgttcaggtcgtactactacagtcgaccgttcggggtcccgccgaggtccgtacccggaaggggggtaacggggcgtaggggtaggtttcgggggtttacaacgttaacgttattttacgtaccgtttagggttggtagtaacttaaccgtattaacttaacgtaccggactaacgtacctcgtaggtacgggaacggggtccgtaacttacccgaaccgtacttcccgtaccgaagggtaacccaaaccggtacccaagtaacccttactaccgttacgtaaccgttttacgaacctaaacgttacgaaccctacccgtcggaccggaacggacccggaacggtacccgaaccggtacggttacttacgttacgtcgtacgaccgaacgtaaccgttaccccggttcgtccgtttacggttaaccttaccgg

SEQ ID NO: 38717 - DNA, 852 bp, Homo sapiens
  misc_feature: GYAE6OF01BHT5I.10.79.H02.1.454.CMB.1.raw
  modified_base (187)..(187): a, c, t, g, unknown or other
  misc_feature (187)..(187): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggcctccaggtaccaccggagagattgtgttgacgcagtcgccagccacctgtcttttcncgagggacagagtccaccctctcctggtacggcctagtttacgtgggttcgtttgggccgtacctttaattttaaaaccgtcgggttaaccaaacgtaacggtaaaacggttcgggacccgaacgggcccttaccccgagggtcccttcccgttacctaacgttccgttaaaccggaaacgtccctaacgttacccccgaacccggaacgggggtaccccaacggttccggggtaccccgttaccccgaacggtacccggtaacgggtttccggaacgttcgggaccggtaagggttcggggttaccgtcggggaacctaacggttacctttaccgaaccgttcctaccgaacccgattaccgacgtaccgacggtcccgttagggacctaccggttaagaacgttacgttacgtttacggacgttttaagttttattaacgttcgtacgtacgtacgtacggtacgtacggtaccgtagggtccgtttacctttaccggtaaccggtttccgggaacccggtaacgtaacggtaacggtaaactacgaaaccgtacgtcggtacgtctaccgaaccgtaccgtaacgtccggtttaccgttacctttaccgtaacctttccccggttacccctcgttaacgttcccgtacgtacgttaaacccg

SEQ ID NO: 38718 - DNA, 764 bp, Homo sapiens
  misc_feature: GYAE6OF01BO6F5.10.79.H02.1.454.CMB.1.raw
  modified_base (288)..(288): a, c, t, g, unknown or other
  misc_feature (288)..(288): n is a, c, g, or t
tcagcatagtagtgcacgaccggtgctcgatttagtgtcacacgaagggaaaggggagctctgggagaagacgccccagcccccagaacttcccaggagtttccattcggtgatcagcactgaacacagaggactcaccagtggtagtttgggctggagtcgttgggttttccttgttgcttattaataaaggtgtccagtgtcaggtgagtcgtggtggagtcggtgggggagtcgttggtacaacggccgtgggacgggtccctggacgtctccgtcgtgtcgacncgtcctcgtggtacgttccgccgttcgtggtacttcggtacgtttcgagttacgaacctacgtactgtccggtaccggtcgggtcccgaccgacgggctaccgggaagggggtacgggtcggtgggtaggtttcggttaactacgttacttatttacgtcgttaggtcggtacgtactaacctattaacttaccgctacgacgtaccgtcgttagggtacggaaccgggtcccttactacccgtactactcccgtacggaaccggtacccaccgtaacgaacgtaccctactacgtacttaacgttacaacttaaccgaaccgtaacccgcccggtacggacccggaacggtaccggaaccgggtacccgggtaccggtacctttaaagttaccgttgtcgggtacgtaaaccccgggtaacgttaacccgttaccccggttacgtttacccgtttacgggtttacttaaccccgg

SEQ ID NO: 38719 - DNA, 955 bp, Homo sapiens
  misc_feature: GYAE6OF01B32LO.10.79.H02.1.454.CMB.1.raw
tcagcatagtagtgcacgaccggtgctcgatttagtgtcacacgaagggaagggggagagctgctcagttaggacccagagggaaccatacggaaaccccagcgcagccttctcttcctcctgcttactcttcgcctacccgagactaccgacggaagtaaactttgtgttacggacgctacgtcctccgaggtcctacccgtttgttccgttttcgtccgtaccggaaaggggtaaacgacgcccacgtccgttccgttccgtacggaccgaccgggtccctaaggtaccgaaggttacgtttccgttaacggaccaacggtaaccttaaccggttacggttccgttacccgtaacggtaaacccaaacggaaccgtaaaccggttcggacccgtacgggtcccggtacccggtccttacccgtacgtaccgtttacgtacggtaacggttaacctacggttaccgtaaccggaccggtaacccggggtacccgtacggttccggaccttaacccgtaaccccggaagtaaccggtttacgggtactacgggggttaccggtacggttacggggtacgggttccggtaaagggacccgttaaccgttaacgttaccctacgtaccgtacctaacgtacgtaccgtaacgacgtaacggtacggttaggtaaccgttagttaacggttaacgtttagtttacgaacgttttaagtttaacgttacgtacgtaacgtacggtaactacggttccggtacgttaacccggttcgggtttaccggacggttaacggttacccgggtaccgtttaaccgggttccgggaaacgggtaaaccggtaaaaccggtaaaggtaaccgggttaaccggtaaaccggttaaacccgttagggttccgacgttaccgaaccgttaacgaccctttacgttcgttaaccgttcccgtttaaacccg

SEQ ID NO: 38720 - DNA, 805 bp, Homo sapiens
  misc_feature: GYAE6OF01ERO0A.10.79.H02.1.454.CMB.1.raw
  modified_base (242)..(242): a, c, t, g, unknown or other
  misc_feature (242)..(242): n is a, c, g, or t
tcagcatagtagtgcacgaccggtgctcgatttagtgtcacacgaagggaaagggggagagctgctcagttaggacccagagggaaccatacggaaaccccagcgcagcttctcttcctcctgctactctggcctccagactaccacgggataaattgtgttgacgcagtctccgagccaccttgtctttgtcctacggaaggggaaagacgccacgtctctccgtgcgacggcctagcagngtcttagacacgtactaacgttcgttcgccttaggtaaccaacgtaacgaaaccgtcggaccgtacgggcccgtcccgggtctcctctactcttaacgtggtacctatacgtacgcggacggtccacgtcggacctacgtccgaacggtacctagggttcaggtcggcgtagggtcgggtcgtcgggaactacggtacctccgtaactcccgtacaaccgtatacggaccgacgtaacggtaccggtagggttaacgttagttaacggttaacggtttagttttacggacgttaggtttaaggttttatttaacggtttcgtaactaaggtaaacgttaacgtttagggttaccgggttaaccgggttaccgttaacggggtttaccgggttttaccggttttaacggggggttaacccgggaaacggggttaaccgtaagggttaccgggtaagggttaaacccggttaaagtaaaaccccgggtaacgggttaagttccggggtacggtacccttacggggaaccttaccgttagtttccgtttccggtaactttaccccg

SEQ ID NO: 38721 - DNA, 593 bp, Homo sapiens
  misc_feature: GYAE6OF01ED9QZ.10.79.H02.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccacgctctcctgcaggccagtcagagtctagcagcaactacgttgcctggtaccaacagaacctggccaggcctccggctcctcatctatggtacatctagcgagggccacgtggaccacgtccccagtaccgtaggttccaggtcggctagggttcgggtcgtgggaacagtacttcgactctccaccatcgagcagacgtaggagttcgtagtaagtagtttgacgtagttagttattagttgtcgtaagtactaagtagtgggttagtcgtaccgttgggttacgttttcgggaccgtacgggtaccgaaggtcgtaggtagtaacgtacgaaacggtacgttggtacggtctacggtacctaaccgtacttcgttcgttcgttaccg

SEQ ID NO: 38722 - DNA, 779 bp, Homo sapiens
  misc_feature: GYAE6OF01EY368.10.79.H02.1.454.CMB.1.raw
  modified_base (258)..(258): a, c, t, g, unknown or other
  misc_feature (258)..(258): n is a, c, g, or t
  modified_base (361)..(361): a, c, t, g, unknown or other
  misc_feature (361)..(361): n is a, c, g, or t
  modified_base (386)..(386): a, c, t, g, unknown or other
  misc_feature (386)..(386): n is a, c, g, or t
tcagcatagtagtgcacgaccggtgctcgatttagtgtcacacgaagggaaagggggagagctgctcagttaggacccagagggaaccatcggaaaccccagcgcagccttctcctttccgtcctagcttactcgtcggcctccagactaccgacggagtaagttgtgtacgacgcagtcctcgacgctaccgtgttcttgccgtacgaagggaaagcgaccgtactcgtcgtcgcgacgcggacagtcgaagtcgtntacgacgagaccgttaacgtacgttccgaccgttaacgaaaccaacgtaacgtaaaccgtcggacccgaccggtccgtcccggtactcccgtatacgtcgtancgacgtactcgacggacgcgtaccncgtagcctaacgtcccagtaacgtcggttacggcgtaaggcgtcgggttcgggtaccggaacggtactaccgtaccttacgtacccaccgtttaatacccgagttacaaccggtagaacccggtacgttacgacgttacggtaacggttaagttaccgtttaggtaccggttagtttaaccgttaagtttcgtaacgttacgtaacgtaacttaaagttcgggttaacgttaaccggtccggttaccgggttcggtttaaaccggttcgggtaacccggtaacggtacgtaaacggtacgaagggttaaccgaaacggtaaacgtaaggggttaacgtcggtaaccggttcacgggtaaccttcttaacgttcgttaccgttacgttacccgg

SEQ ID NO: 38723 - DNA, 723 bp, Homo sapiens
  misc_feature: GYAE6OF01ERYHP.10.79.H02.1.454.CMB.1.raw
  modified_base (666)..(666): a, c, t, g, unknown or other
  misc_feature (666)..(666): n is a, c, g, or t
tcagcatagtagtgcacgaccggtgctcgatttagtgtcacacgaagggaaaggggagctctgggagaagagccccagccccagaattcccaggagtttccattcggtgatcaacactgaacacagaggactcaccatggagtttgggctgagtcgttgggtttttccttggttgacttattaagtaaaaggtgtccagtgtcaggtgaagcgtggtggaggtcgtgggggagtcttggtcaagccgtggacggtcctgacgctctcctgtcgcagcctcgtggtacttcgcctgtcggtatttcggacgtttcagtcgtactactacgtacttcggaccgttcgggtcccgccgacgggtctacccggaaggggacgggtcgttacgggtaggtttcgggtttaccaaggttaccttagttttacgtccgtttaagggttggtacgtaacgttactacgttaactaaccgtacgactaacgtacgttacgtagggttacgaacgggtccgtaactttaccaaccgtactcccgtaccggaaacggtacccgaaacgtaccgaaacgtaccaacgtacgtctacgttacgaactaaacgtccgaaacctcccgtagggacaccggtacggaaccgaacggcccgggtacttaagttccgttaacgngtccgaacgtacgtaacccttaccgggttcaccggtttaagttcttaccgttaacgg

SEQ ID NO: 38724 - DNA, 821 bp, Homo sapiens
  misc_feature: GYAE6OF01C4RY7.10.79.H02.1.454.CMB.1.raw
  modified_base (231)..(231): a, c, t, g, unknown or other
  misc_feature (231)..(231): n is a, c, g, or t
tcagcatagtagtgcacgaccggtgctcgatttagtgtcacacgaaagggaaaggggagctctgggagaagagccccagccccagaatcccaggagttccattcggtgatcagcactgaacacagaggactcaaccagtggtagtttgggctgagcttgggttttccttgttgacttaattaataaaaggtgtccagttgtacgaggtgaacgcgttggtaggtagtcggnggggtagcgttgggtacaaggccgtagggacggtccctggacgacctctcgtgtcgcaacggtcctcgtcggaacttccgccttcgtaggacgtttcgtaaccgttgaggttcgtaaactaaccgtaactagtacgacccggttacggggaccccgacgaccgggtaacgtaccccgggaaaggggggtacgggccggttagggtaacgggtttacgggggtttacctaattaacccgttaaagttttaaccttaccggttaaggtttcgggtattaaaccggtaaccttaataaacgttaaccgttaacgaccgtaaagtacgttctaccgggtaaggtaacgggtaccggtaacttaccgaacccgtaactaccgttacccgaaacgggaacccaaaccggaacctaaacggaacttaccaacgttacgtaacgttttaacgaactaaaacgtccgtaaacgaacccctaggaccgtaacccgccggaaacgggtaccaccgggtaccgtaaacttacgttacggttcgaacggagtaaacccggtaacttaaacccggttccgtacggttagttaccgtttaacccg

SEQ ID NO: 38725 - DNA, 775 bp, Homo sapiens
  misc_feature: GYAE6OF01BFYNA.10.79.H02.1.454.CMB.1.raw
  modified_base (755)..(755): a, c, t, g, unknown or other
  misc_feature (755)..(755): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattaataaaggtgtccagtgtcaggtgagctggtggagtcgtgggggagcttggtcaagccgtggacgggtccctggacgacctctccgtggtcgcacgtccctcgtgggtactttccgccttcgtggactttgtaccgtttcgagttcgaaccttaacctacgtagtccggtacccgtggggtccccgaccgacgggtccctaccgggaaggggggtaacggggtccgttaggggtaggtttcggggttttacaattaacgttaagttttaccgtaccgttaagggttggtcgaacttacccgtattaacgttaaccgtaccggctaacggtaaccttcgtaggtacgggaacgggtcccgttaattacccgaacctacgttacccgtacccgggagggaaacccaacccggaacccaaagtaacctccgtaacctaggttaaccctttaggaaccttaaaacgtccgtaaacccgtacccggttacgggacccggtaacggccccggtaagggacccgtaaccgggtacccttagttaacgttacgtggtaccgacgtaacggtaaccttaccccggttntaccgttggttaccttacgg

SEQ ID NO: 38726 - DNA, 735 bp, Homo sapiens
  misc_feature: GYAE6OF01DUO8J.10.79.H02.1.454.CMB.1.raw
  modified_base (504)..(504): a, c, t, g, unknown or other
  misc_feature (504)..(504): n is a, c, g, or t
tcagcatagtagtgcacgaccggtgctcgatttagtgtcacacgaagggaaaggggtctgggagaagagccccagccccagaattcccaggagtttccattcggtgatcagcactgaacacagaggactcaccatggagtttgggctgagtcttgggtttttccttgttgcttattaataaaaggttgtccaggtgtcaggtgaaggcttgggtggagtcgtggggggagcttggtacaagccgtgggacggtccctggacgtaccttcctctggtcggcacggtcctcgtggtacttccgccttcgtgtacgttgtacgttcaggtgaccttacgaactagtacggtaccggtcggggtacccgccgacgggtaccgtccgggaaaggggttaacggggcgtaggggtacggtttgggtttaccaagtttaccgttatttacgttaccgtaggttcgggttagtaactaccgtaactacttacgtaccgtacagtcttacggnggtacggaacgggtctatcccaactactcgtacgacggtaaccaacgtaccaacgtactctacgtcgtacttgaacaatacccgaaccctacgtcggacccggaggtacccggagggacccgaacggtccgttaagttacgttaacgtcggtaacggaccgtaaacgttacccggttaacccgttccgggttaacgttaccggtttttaaccttccgttacggtaacccgg

SEQ ID NO: 38727 - DNA, 784 bp, Homo sapiens
  misc_feature: GYAE6OF01BMCHQ.10.79.H02.1.454.CMB.1.raw
  modified_base (350)..(350): a, c, t, g, unknown or other
  misc_feature (350)..(350): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgttgggttttccttgttgcttattaataaaaggtgtccaggtgtcgaggtgaagtcgtggtggagtcggtgggggagtcgttggtcaaggccgtgggacgggtcccctggacgtactctccgtgtgctacgtccttcgtggtacttccgcccttcgtgggtactttcggacgtttcgagtcgtaaccttactaacngttacgaccggtcgggtcccgcgacggtccgtacccgggaagggggtaacggggtcgttaggggtacggtttacggggttttacaacgtttaacgtacgtttttaacgtccgtttaagggttcgggttactaacttaaacccgtaagttaacctaaccgtacgacgtacgtaccttcgtacggtaggaaccgggtctacgtacctaccgtactcccgtaccgaacggtaaccgaacccgtaccgaaacgtaacccttaccgtaacgttacgtaccgtttaagaaccgtaaaacgtaccggaacctaccggttaccgacggaaccggtacccggaacggaccgacccgggttaccgtaagttacgttacgtacgtacggaacgtaaccggtaacttaccccggttacgttaccgtttaggtttaccgtttaaccg

SEQ ID NO: 38728 - DNA, 803 bp, Homo sapiens
  misc_feature: GYAE6OF01AEG5S.10.79.H02.1.454.CMB.1.raw
  modified_base (134)..(134): a, c, t, g, unknown or other
  misc_feature (134)..(134): n is a, c, g, or t
  modified_base (155)..(155): a, c, t, g, unknown or other
  misc_feature (155)..(155): n is a, c, g, or t
tcagcatagtagtgcacgaccggtgctcgatttagtgtcacacgaagggaaaggggagctctgggagaagagccccagccccagaacttcccaggagtttccattcggtgatcagcactgaacacagaggactnaccatggagtttggctgagtnttgggtttccttgttgactattaactaaaggtgtccagtgtcgaggtgaagtcgtgggtcggaaggttcgtaggggggtaggtcgttggtacgaaggcccgtagggacgggttccctggaacgtaccttccgtaccgttggcgcgtacgtcccgtacgtggtactttcccggacctttcgtacgtaacgttttggaaccgtttcgaggttaccgtaacctttaactaccagttaccggaccggttcccggggtacccacccggtaacggtcccgttaacccggggaaggggggtaacgggggtccgttaacggggtacggttttacggggtttaccacggttaaaccgtttattttaaaccgccggtttaaggtggttacggtaaccttacggtaaatttacgtaacccgtaactcgtaacgtacgttccgtaggttacgggtacggtacctacgtacctacctagttaccctacggaccggaaacaacccgacctaaccgtaactccgtaagtcttaacgtctaacgtaattaacccaccgtaccgtaccgaggaccgaccgggacgaccgtacggtcgttaacgtactcgtgtacgtaagaactaaccgttaccccgttgtacccgtttagtttaaccgttaccgg

SEQ ID NO: 38729 - DNA, 780 bp, Homo sapiens
  misc_feature: GYAE6OF01CS0N5.10.79.H02.1.454.CMB.1.raw
  modified_base (269)..(269): a, c, t, g, unknown or other
  misc_feature (269)..(269): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatgggagtttgggctggagtcgttgggttttccttgtttgcttaattaagtaaaaggtgtcagtgtacgaggtgaagcgtggtggagtcggtggggggagtcgttgggtacaaggtccgtggggcggttcccngacgacctcctctgtacgcagtccctcgtggtacttccgcccttgtggtattcggtaacgtttgagtcgaaccttacgtacacgtcggaccgttcgggtcccgacgtacgggccttaccgggaaaggggacggggtccgttaggggtaggttccgggtttacaacgttaactttacgttttaactacccggtagggttaggtacgtaacttacccgtaatttaactaaccgtaccgtcgaagtaccgtacgtagggtacggtaagggcccgttaacttaccgaaccttacgtaccctacggaaccgggaacgtaaacccgaccgaaacgtaacctcctaacgtaggttaccttagtaaccgtaaatacgaacctacccaggtaccggaacgtacccgggaacggaaccgtaccggtaccgttaaacgttacgttacggtagttacgacccggttaaagtaacccttaaaccccgggtttcgttaacccggttggttttaacttaaccccgg

SEQ ID NO: 38730 - DNA, 789 bp, Homo sapiens
  misc_feature: GYAE6OF01EZE3A.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggaggtttggctgagcgttgggttttccttgttgcttattaataaaaggtgtccagtgtcaggtgagtctgggtggagtcgtgggggagtcttggtacaagtccgtgggacgggtccctgagtacctctccgtgtacgcacgtccttctcgggtacttccgccttcgtggtattggtaccgttcaggtctactactactagtcggacccgttgggcccgccgacggtcctaccgggaggggtacgggtcgtgggtaggttcgggtttacacgttactacgttttcgtaccgtttaggtggttactaacttaacccgtatttaacgtacctaaccggactaacgtaccttcggtaggttaacgggacgggtaccgtaacttaccgaacctacgtaccgtacccggaacgggtaacccaaccgaaccctaaacgtaacccgttacccgaaccgtttaacgggtacccttttaacggaacctaaacgtaaccgtaacccctaacccgtaggaaccccggtacgaccccggggtaaacgaccccggtaaccggggtaccctttaaacgttaagttaccgttgggacccgtaaacggtacggtaaacccgtttaaccccggttccgttaccggtttaaggttacccgtttaacccg

SEQ ID NO: 38731 - DNA, 737 bp, Homo sapiens
  misc_feature: GYAE6OF01CTXRU.10.79.H02.1.454.CMB.1.raw
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagtcgtgggttttccttgttgctattataaaaggtgtccagtgtcaggtgaagctggtggagtcgngggggagcttggcagccgtggcggtccngacactctcctgtcncacgcctgtggtacttcccgtccgttcgtggtattcggtacgttcgagttcgtaacctactacagttcggaccgttcgggcccgcgacggtccgtccgggaaggggacgggtcgtagggaggtttcggtttacagttacttatttactaccgttaggttcggtataactactaatacgttaacctcgactagttaccgttcgtaggtacgggtaacgggtcctacgttaccacctacgttcccgtaccggaacgggtaacccaaccgggacctaacggaacccttactaaccgttacgttactttacgaacctaagtaaccgaaccgtccccgtaggaccggtaccggaccggtaacgggtacccggaccggttaccgtttaacgttacgtttaaccggtcgggtaaccgtacggtaaacgttaacccggtttaccccggttacggtttacccgtttagttttaaccgttaacccgg

SEQ ID NO: 38732 - DNA, 807 bp, Homo sapiens
  misc_feature: GYAE6OF01DOI8M.10.79.H02.1.454.CMB.1.raw
  modified_base (357)..(357): a, c, t, g, unknown or other
  misc_feature (357)..(357): n is a, c, g, or t
  modified_base (535)..(535): a, c, t, g, unknown or other
  misc_feature (535)..(535): n is a, c, g, or t
tcagcatagtagtgcacgaccggtgctcgatttagtgtcacacgaagggaaaggggagctctgggagaagagccccagcccccagaattcccagggagtttccattcggtgatcagcactgaacacagaggactcaccatggagtttggctgagcgttgggttttccttgttgcttaattaagtaaaaggtcgtcctaggtgtacgagggtgaaggtgtagggtggacggtcgggtggggggagtcgttcgggtctaacggccgtagggggaccgggtccctaggtacgtaccttccgtccgtgtcgcgtacggtcctacgtggacttccgccgttcgtaggtattcgtaccggttntaacggtgtaactaccgtagtacgttacggtacccggtcgggtcccgtaccggacggtccccggtaacgggaggggggtaacgggtcgtaggggttagggttcgggtttaactaagtttaaccttaagtttacgtaccgttaggtgtacgtaacgttactaaatacctaacggtaacncgtaagtactacggttggtaacgggtaacggtaccgttaacgttcccaactcgttaacccgaccgggaacggtaaacccaccgtaaccaaacgtactaactacgtcggttaacttacgtaaacaaacgtccgtaaccctaaccgtcggaccgaacggaccggtaacgggacccggtacggtaacggttaacttagttactggttaccggaacggtttaaacccgtaaccggttaaccccggttgtaacccggttttacgttacgttaacccg

SEQ ID NO: 38733 - DNA, 846 bp, Homo sapiens
  misc_feature: GYAE6OF01AR221.10.79.H02.1.454.CMB.1.raw
tcagcatagtagtgcacgaccggtgctcgatttagtgtcacacgaagggaaaggggagctctgggagaagagccccagccccagaacttcccaggagtttccattcggtgatcagcactgaacacagaggactcaccatggaggtttggctgagtcgtgggttttccttgttgcttattataaaaggtcgtccgagtgtcgaggtgaagcgtggtggagtcggtggggagtcgttggtacacgccgtggacggtcccctagacgaccgtctccgtgtcgcgacgtcctcgtacggtacttccggccttcgtggtactttacggtaccgttctacgttacgtaccttaacgtacgagttccgtacccggttcgggtccccgaccggtaccgggtcccgtaccggggtaagggggtaacgggtcggttacggggtaacgggtttcgggttttaccgtaacttaacggttaacttttacgttacccgtttagggttaggttactaaccgttaaacctaagttaaccttaaccgtaccggtaccgtacgttaaccttacggtacgggttacggaacccgggtacgttaaccgtttacccgtaacggtaccttcccggtaaccggtaaccggggaaacctaacccggaaccgtaaacgtaacccgttccgttaacgttacgttaacgttaccggaaaccgtaacgttaaaccgtaccccggacccgtaaccggtcggaaccggtacgggaccgtaaccgtaccccggtacgttaacgttacttaccggtcgtacggaccggtaaccttaacccgttacccgtttagtcctttacccggttagtttacccgg

SEQ ID NO: 38734 - DNA, 758 bp, Homo sapiens
  misc_feature: GYAE6OF01CL6FX.10.79.H02.1.454.CMB.1.raw
  modified_base (209)..(209): a, c, t, g, unknown or other
  misc_feature (209)..(209): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggcctcccagatacccgaccggagtaaattgtgttgacacagtctccagccacgtctgttcttgtctccgaaggggaaacncgccacccttctccgtagccgacgggccctaggtccaaggtacgtttcggttccgaccttacgttttcgggtttaaggggtcgtactaccgaaaatacgttaaaacgttcccgggaccgtaggccctacccgtacggtccttaccctacgtacttttcgttacgtagttccggttaccttttaccgaaccggtacccggggtccccttacgggtcccgtaacccggagggtaccgtaacggtttaccggaggtcgggtacgtacgggtcggggtacgtacggggacacggttaacccttcaacttccgtcaacccgtntacccgngtaccgacgtccgtaagcgtaccgtaagtaagtttactttagactttaacgtttattacgtgtacgacgtacgtcgtcgtacgtccttaacggttcggcggtacggttcgccgttacggttcgggacggaacgtaacgtaaggtacgtacggtacgtaaacgtacgtgtacgtgtacgtaacacgtactcgttaccgtacttacctacccttccgtcctacccg

SEQ ID NO: 38735 - DNA, 939 bp, Homo sapiens
  misc_feature: GYAE6OF01AG0PO.10.79.H02.1.454.CMB.1.raw
tcagcatagtagtgcacgaccggtgctcgatttagtgtcacacgaagggaaaggggagctctgggagaagacgccccagccccagaattcccaggagtttccattcggtgatcagcactgaacacagagactcaccatggtagtttgggctgagtcgtttgggttttccttgttcgtacttaattaagtaaaaggtcgtccgtagtgtcgaggtagaagtcgttgggtggtaggttcgggtgggggagtcgttgggtcgaaggtccgtaggggtacggtcccgtggtacgtaccttccgtccgttggtcgaccgtacgtcccgtacgttacggtaccttccgtcccgttcgtaggtacttacggtacttcgtacggttcgaaccttaactacgtagttaccggtaccggtccgggtacccgccggtacggccccggtaacggggaagggggacgggtcggttacggggtcgggtttacgggtttaacctaagttaaccgtttagtttaaccggtcggtttaaaggttcggtagttaaaccgttaactaacttaaccgttaaaccgttacgaccgttaacgtaccgttaacgggtacggtaaccggggtaaccgggtaccttaccgttaccctaacctaccgttaccgaacccgggtaacggtaaccccgaaaccgtaacccggtaaaccgggtaccttaccggtaaccgtttaacgtttcgttaaaccgtaaccgtaaacgtaccccggtaaacccgtccgtaacggtaccccgggaacggaacccgggtaacggaaaccccggttacccgggttaactttaaacggttcccgtttaaacggttccgggtaaaccggtaaaccgggtttaaaccgttaaaccccggttacccgggtttacccgtaccggtttaaacgtttttaaccccgttaacccggg

SEQ ID NO: 38736 - DNA, 915 bp, Homo sapiens
  misc_feature: GYAE6OF01AJ9ZG.10.79.H02.1.454.CMB.1.raw
  modified_base (204)..(204): a, c, t, g, unknown or other
  misc_feature (204)..(204): n is a, c, g, or t
tcagcatagtagtgcacgaccggtgctcgattttagtgtcacacgaagggaaagggggagagctgctcagttaggacccagagggaaccatggaaaccccagcgcagcttctcttcctcctgctactctggcctccagataccaccggagtaaattgtgttgacgcagtctccaggcaccctgtctttgtctccgaggggaaancgccacgcttctcctgcgacgggccagtcagtatctagcacgactaacgttacgttcgccgttacggtaccaaacgacgtaaacccgtcgggaccacgggtccctcccggggtccttacccgtactacgttacctaaggttcggtaacctacgtaccgtacgccggtacgggtaccctacggtacggtacctacccgtaccccgaaggtaccggttacgggtttacgaaggggttcggtaccggtaacgggggttcggggttaccgggtacggggtaaacctacgggttaccctttaccgacccgtttaccctaccccgtaaccgttaacctcggaaacccggtccgaacgggttaccggttaggggtaaccgttacggtttaacgttaaacggtttttaacgtttcggtaaacggtttgggtttttaaacgtttacgttttaacgtttacggttaaccgtaacggtttacgttaaaacgggttttagggttacgggtttaacccggttaccggtttacccggggttttacggggttttaaaccggttttccgggggaaaccccggttaacggggtaacccaagggttaccgggtacgggtaaaccgtaacggttaaacccggtaaaccgggttacggttgggtacccgtactttacccgggaacccttaccggtttaaccttttcggtttacccttcccgtttaacccgg

SEQ ID NO: 38737 - DNA, 758 bp, Homo sapiens
  misc_feature: GYAE6OF01BUEHL.10.79.H02.1.454.CMB.1.raw
  modified_base (292)..(292): a, c, t, g, unknown or other
  misc_feature (292)..(292): n is a, c, g, or t
  modified_base (319)..(319): a, c, t, g, unknown or other
  misc_feature (319)..(319): n is a, c, g, or t
  modified_base (735)..(735): a, c, t, g, unknown or other
  misc_feature (735)..(735): n is a, c, g, or t
tcagcatagtagtgcacgaccggtgctcgatttagtgtcacacgaagggaaaggggagctctgggagaagacgccccagccccagaacttcccaggagtttccattcggtgatcagcactgaacacagaggactcaccatggtagtttggctgagtcgttcgggtttttccttgttgacttaattaagtaaaaggttgtccgagttgtcgaggtgaagcgtgggtggtagtcggtagggggagtcgttggacaagccgtggacggtccctagacgtctccgtctggtacgcngtcccgtgtggtaccttccgccgttgnggttattggaccgtttcagttcgtaacttacctagtatcgtaccgtccgggtccgcgacggccgtacggaacggggagggtctggggttagttcgggttactaagtaccttaagtttacgtcggttaggttaggtacgtaacttaacctaagttacctaaccgtaacggtaccgtaagtttcctggtaacggtacgggtaaccgggtccttacttacccaaccgttacgttccgaacgggtaacgtaacccgaacgtaccgaataccctagaaccgttcttaacgttagaacctaacgggtacctaaaccctccggtacggacccgtacggaaccggttaaacgacccgggacgttaccgtaagtttaatcgtagggtaccaacggttaaacgtttacccgaccccgggttttacncgttttaaacggttcttacccgg

SEQ ID NO: 38738 - DNA, 891 bp, Homo sapiens
  misc_feature: GYAE6OF01BI4XR.10.79.H02.1.454.CMB.1.raw
tcagcatagtagtgcacgaccggtgctcgatttagtgtcacacgaagggaaagggggagagctgctcagttaggacccagagggaaccatcggaaaccccagcgcagcttctcttcctcctgctactctggcctccagactaccaccggataattgtgttgacgcgagtctccaggccaccttgttctttgtacctccggaaggggaaacgacgccacgtccttcctcgtgcgacggcctagtcagtacgttctacgacgacgtacctaacgttacgttcgaccgttacggtaacccaacgaaaccggtaaacccgtccgggacccggtaccgggtacccggttccccggggtaccttcccacctacttaccgttaacggttacggttaaccgtacgttaccgtaacggacccggaccgggtacccgtaacggtaccggaccctaaccgtaccccggaaggtaccggttacggtacgtaggttacgggacgtaggggttacggggtcggtacggggtaaccgtaccggtacctttaccctccgtacctacccgaaccctacgtaccgtaacggaccggtaacggtacggttacgggtaacggtttacggttaaacgttaaggtttacgtttacggaccgttaaggtttaggtttaacgtttacggtaggttaaccgtaagttaacggtttacgggtaacgggtttaccgggttaccgtaaccgggttttcggggtttaaccggttttaccgggaaccggggtaacgggaccgttgggtaccggtagggtaaccgtacggttaaaaccgaaccggtttacggtcggaccggttacgtacccgtaccgtaaccggttacttacccggtttacgttcccgttaacccgttcccg

SEQ ID NO: 38739 - DNA, 488 bp, Homo sapiens
  misc_feature: GYAE6OF02JAI00.10.79.H02.1.454.CMB.1.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggntcctcatctatggtacatctagcagggccactggcatcccagacaggttcagtggcagtgggtctgggacagacttcactctcaccatcagcagactggagtctgaagatttgcagtgtattattgtcagcaatatggtagtcactggactttggcagggacaagctggagagtcaacgactgtgctgcaccatctgtcttc

SEQ ID NO: 38740 - DNA, 495 bp, Homo sapiens
  misc_feature: GYAE6OF02GNTZL.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattatgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcactggtacttttggccagggaccagctggagagtcaaacgactgtggctgcaccatctgtcttc

SEQ ID NO: 38741 - DNA, 514 bp, Homo sapiens
  misc_feature: GYAE6OF02HOT1Q.10.79.H02.1.454.CMB.1.raw
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
  modified_base (487)..(487): a, c, t, g, unknown or other
  misc_feature (487)..(487): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgacctggtccncaggctcgagggagggctggagtgggttcatacatttancctagtggtgataccatatactacgcagactctgtgaaggccgattcaccatctcagggacaacgcaagaactcactgactttgacaaatcgaacacctgcgagccgagacacggcgtaatatactgtagngagactacccgtcgcgtgttattaccg

SEQ ID NO: 38742 - DNA, 517 bp, Homo sapiens
  misc_feature: GYAE6OF02HTBBD.10.79.H02.1.454.CMB.1.raw
  modified_base (201)..(201): a, c, t, g, unknown or other
  misc_feature (201)..(201): n is a, c, g, or t
  modified_base (514)..(514): a, c, t, g, unknown or other
  misc_feature (514)..(514): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggctcctcatctatggtacatctagcaggccatggcatcccagacaggttcagtgcagtgggtctgggacagacttcactctcaccatcagcagactggagtctgaagtatttgctagtgttatttattgttcggtactaatagtggtaggtacgtaccgtgggtacttttggccgtaggggacaagcgtggagatacgaaacgacgtagtggcgtgcacatcgtgtctntac

SEQ ID NO: 38743 - DNA, 547 bp, Homo sapiens
  misc_feature: GYAE6OF02FWSVF.10.79.H02.1.454.CMB.1.raw
  modified_base (289)..(289): a, c, t, g, unknown or other
  misc_feature (289)..(289): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaagagccacgctctcctgcagggccagtcagagtcttagcagcaactacgttgcctggtaccaacagaaacctggccaggctccgggctccncatcttgattctttcaacacgggccctggccgtccaggcaggttcagtggcagtggtctgggacagacttcactctcaccatcagcagcctagacgcctgaagtatttgactagtttattactgtcagtcagcgtgccctatttcgggcggtaggtcgccgtacgtttcgggcggtagggaacctaaaagtaggaggtaccaacgacgtggtcggactggccacctatccgtggttaccttcacttccgttcccgacc

SEQ ID NO: 38744 - DNA, 525 bp, Homo sapiens
  misc_feature: GYAE6OF02JFV8S.10.79.H02.1.454.CMB.1.raw
  modified_base (374)..(374): a, c, t, g, unknown or other
  misc_feature (374)..(374): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttgggtcaagcctggagggtccctgagactctcctgtgcagcctctggattcgcctctggattgacattcagtgactactacatgacctgggtccgccaggctccgagggaaggggctgggagtgggtttcatacatttatcctagtggtnataccatatactacgcagactctgtgaagggccattcaccatctccaggacaacgccaagactcactgactttgacaaatcgaacaccctgccgagccgaggacacggccgtatacttactgtgcgagactaacccgttcgcctggttaac

SEQ ID NO: 38745 - DNA, 505 bp, Homo sapiens
  misc_feature: GYAE6OF02GIN9J.10.79.H02.1.454.CMB.1.raw
  modified_base (501)..(501): a, c, t, g, unknown or other
  misc_feature (501)..(501): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccatggcatcccagacaggttcaggtggcaggtgggtctgggacagtacttcactctcaccatcagcagactggagtctagaagtatttgcagttgttattattgtcagtcaatagtggtagtcacgtggtactttcggcgagggacagctggagagtacaaacgactgtgcgtgcaccatctcgtnttac

SEQ ID NO: 38746 - DNA, 426 bp, Homo sapiens
  misc_feature: GYAE6OF02FGGS3.10.79.H02.1.454.CMB.1.raw
  modified_base (421)..(426): a, c, t, g, unknown or other
  misc_feature (421)..(426): n is a, c, g, or t
tcagcatagtagtgcacgaccggtgctcgatttagtgtcacacgaagggaaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaactaacccgttcgcctggttatacctgacacttggggccagggaccctggtcaccgtctcctcagcctccaccaagggccccatccggtcttccccctggccgccctgctccaggagcacctccgagagcacgagcggccctgggctgcctggtcaaggactacttcccatactatgctgagcgggctggcaaggcgcatagnnnnnn

SEQ ID NO: 38747 - DNA, 535 bp, Homo sapiens
  misc_feature: GYAE6OF02GOH6B.10.79.H02.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaangccacgctctcctgcagggccagtcagagtcttagcagcaactacgttgcctggtaccaacagaaacctggccaggctccccgggctcctcatctatggtacatctagcagggccatggcatcccagacaggttcagtggcagtgggtctgggacaggacttcactctcaccatcagcagactggagtctagaagtatttgctagtgttattactgtcagctagtataatagctcggcccgcgtacgttcggaccgaagggaccgagggtacggaagttacgaaacggtaacgtaggtacggcgtggacaccgtagttcgtcgttccttctaccg

SEQ ID NO: 38748 - DNA, 507 bp, Homo sapiens
  misc_feature: GYAE6OF02FJRSA.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagtatttgctagttgttattattgtcagtcaatagtggtagtcaccgtgggtactttggccgtagggaccagctggagagtacaacgaacgtgtaggctgcaccgatctgtcttc

SEQ ID NO: 38749 - DNA, 509 bp, Homo sapiens
  misc_feature: GYAE6OF02HO8W2.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagtatttgctagtgttatttattgtcagcaatatggtaggtcacctgggtacttttggccgagggaccaagctggagtatacgaaacgactagtggcgtgacacatctgtcttacg

SEQ ID NO: 38750 - DNA, 563 bp, Homo sapiens
  misc_feature: GYAE6OF02HADFA.10.79.H02.1.454.CMB.1.raw
  modified_base (468)..(468): a, c, t, g, unknown or other
  misc_feature (468)..(468): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttccttgttgctattataaaggtgtccagtgtcaggtgaagctggtggagtcgtgggggaggcttggtcaagcctggagggtccctgagactctcctgtgcagcctctggattcgcctctggattgacgttcagtgactactacatgacctgggtcccgccaggcctccgaggggaagggctgggagtgggtttcagtacatttactcctagtggtgataccatatactacgcagactctgtagaagggccattcaccatcctcagggacaacgccaagactcactgtactttcgactaaatcgaaccncccgtagccgagcccgaaggaccacgggccgttaatacgttacgtgtcgacgaacgtaacgttaaccccggttcgaccgttaggttaccttaccg

SEQ ID NO: 38751 - DNA, 535 bp, Homo sapiens
  misc_feature: GYAE6OF02G0PVV.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttcctgttgctattataaaggtgtccagtgtcaggtgaagctggtggagtcgtgggggaggcttgggtcaagcctggagggtccctgagactctcctgtgcagcctctggattcgcctctggattgacgttcagtgactactacatgacctgggtccgccaggcctccgagggagggctgggagtgggtttcatacatttatccgtagtggtgataccatatactacgcagactctgtgaaggccgattcaccatcctcgaggacaacgcaagactcactgactttgactaaatgaaccaccctgcgagccgaggacacggaccgtatattacgtgtagacgagtaacgtacccgttcgccgttaggttacttacg

SEQ ID NO: 38752 - DNA, 516 bp, Homo sapiens
  misc_feature: GYAE6OF02FUHN5.10.79.H02.1.454.CMB.1.raw
  modified_base (513)..(513): a, c, t, g, unknown or other
  misc_feature (513)..(513): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccatggcatcccagacaggttcagtggcagtgggtctgggacagacttcactctcaccatcagcagactggagtctagaagtatttgctagttgttattattgtcagactaatagtaggtaggtctacgttggtacgttttggccgtagggaccaagcgtaggagagtacaaacgtactgtagcgtgcacctatctgtntac

SEQ ID NO: 38753 - DNA, 543 bp, Homo sapiens
  misc_feature: GYAE6OF02GZENV.10.79.H02.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagccaactacgttgcctggtaccaacagaaacctggccaggcctcccgggctcctcatctatggtacatctagcagggccactggcatcccagacaggttcaggtggcaggtgggtctgggacagtacttcacttctacaccatcagcagactggagtcgtagaagtatttgctagttgttatttattgtcagtactaattagtggttaggtcctacgttgggttacgttttggccgtagggaaccaagtcgtaggagtagtaacgaaacgtacgtggtacgtcgtcgctacctatctgtcttacg

SEQ ID NO: 38754 - DNA, 522 bp, Homo sapiens
  misc_feature: GYAE6OF02I7WUK.10.79.H02.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccacgctctcctgcagggccagtcagagtcttagcagcaactacgttgcctggtaccaacagaaacctggccaggctcccgggctcctcatctatggtacatctagcagggccactggcatcccagacaggttcagtggcaggtgggtctggggacaggacttcactctcaccatcagcagactggagtctagaagtatttgctagttgttatttattgtcagctaatagtggtaggtcaccgttgggtacttttggccgacgggaccaagcgtaggagagtacgaaacgtacgtgtaggcgtgcaccatctgtcttac

SEQ ID NO: 38755 - DNA, 533 bp, Homo sapiens
  misc_feature: GYAE6OF02F34T4.10.79.H02.1.454.CMB.1.raw
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccagatctcctgcagggccagtcagagtctagcagcaactcgtgcctggtaccaanagaacctggccaggctcccgggntcctnatctatggtacntctagcagggccagtggcatcccagacnggttcagtgcagtggtctgggacngtacttcactctcaccatcagcagactggagtcgtagaagtatttagcgtagtgttattattgtcgtataatagttggtaggttcacgttagggtacgtttcggccgtagggacctaagtcgtaggagacgtacgaacgtaacgtggtcgtcgtagacacgtactcgtacgttacttctaccg

SEQ ID NO: 38756 - DNA, 614 bp, Homo sapiens
  misc_feature: GYAE6OF02IE8XR.10.79.H02.1.454.CMB.1.raw
  modified_base (322)..(322): a, c, t, g, unknown or other
  misc_feature (322)..(322): n is a, c, g, or t
  modified_base (364)..(364): a, c, t, g, unknown or other
  misc_feature (364)..(364): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtagtcaggtgaagctggtggagtcgtgggggaggcttggtcaagccgtggagggtccctgagactctcctgtgcagcctcgtggattcgcctctggattgacgttcagtgactactacatgacctgggtccncgaggctccgagggaagggctggagtggttcagtacatttancctagtggtagataaacattaatactacgcgaagtactctggtaggaagggcccgtattccacatctaccgaagggacaaacgccaaagaacctcgactgtaacctttagacctaaaagtcgaaaccctaccctaggaccgaacggtacccggaacggtacccgaccgggtaccgtaattacttaaccgtggtacgacggtaacgtaaaaccttaaccccggttcgcccgtttaggttacctttaacccg

SEQ ID NO: 38757 - DNA, 545 bp, Homo sapiens
  misc_feature: GYAE6OF02H22DQ.10.79.H02.1.454.CMB.1.raw
  modified_base (269)..(269): a, c, t, g, unknown or other
  misc_feature (269)..(269): n is a, c, g, or t
  modified_base (320)..(320): a, c, t, g, unknown or other
  misc_feature (320)..(320): n is a, c, g, or t
  modified_base (361)..(361): a, c, t, g, unknown or other
  misc_feature (361)..(361): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctggggggaggcttggtcaagcctgggagggtccctgagactctcctgtgcagcctntggattccgcctctggattgacgttcagtgactactacatgacctggtccncaggctcgagggagggctgggagtggttcagttacatttancctagtggtgataccatatacacgcagactntgtgaaggccatcacntctcgaggacaacgcaacgactcactgacttgactaagtacaaccacctgacgacgccggaacgaccgaccggccgtaatactttacgtgtagcgtaacgaaccgttaacccgttcgtaccttaggttactttaccg

SEQ ID NO: 38758 - DNA, 529 bp, Homo sapiens
  misc_feature: GYAE6OF02FJXMM.10.79.H02.1.454.CMB.1.raw
  modified_base (317)..(317): a, c, t, g, unknown or other
  misc_feature (317)..(317): n is a, c, g, or t
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
  modified_base (406)..(406): a, c, t, g, unknown or other
  misc_feature (406)..(406): n is a, c, g, or t
  modified_base (486)..(486): a, c, t, g, unknown or other
  misc_feature (486)..(486): n is a, c, g, or t
tcagcatagtagtgcacgaccggtgctcgatttagtgtcacacgaagggaaaggggtctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtggggggaggcttggtcaagcctgggagggtccctgagactctcctgtgcagcctctggattcgcctctggattgacgttcagtgactactacatgacctgggtccnccgaggctccgagggagggctggagtgggttcatacattactcctagtggtnataccatactactacgcagactntgtgaggcatcacntctcaggacaacgccaagactcactgtacttgacaatcgaaccacctgacgagccgaagaccacggccgtatacttacgngtgcgaagtacgtacccgttcgaccgttgttacttacctgacg

SEQ ID NO: 38759 - DNA, 550 bp, Homo sapiens
  misc_feature: GYAE6OF02F58MZ.10.79.H02.1.454.CMB.1.raw
  modified_base (199)..(199): a, c, t, g, unknown or other
  misc_feature (199)..(199): n is a, c, g, or t
  modified_base (404)..(404): a, c, t, g, unknown or other
  misc_feature (404)..(404): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcacctgtctttgtctccaggggaangccacgctctcctgcagggccagtcagagtcttagcagcaactacgttgcctggtaccaacacgaaacctggccaaggcctccccgggctcctcactctatggtacatctagcagggccacgtggcatcccagacaggttcagtgcaggtgggtctgggacagtacttcactctacacctatcagcagactggatcgtagaagtntttgactagtttactactgtacagctagtatcgttacgtcccgtggtaccgttcggaccgaagggaccgaaggtcggacaacgtaccgaaccgtaacgtggtcgacgtacgcctacctacttctgttcttctacgttccctacccg

SEQ ID NO: 38760 - DNA, 548 bp, Homo sapiens
  misc_feature: GYAE6OF02JRZCL.10.79.H02.1.454.CMB.1.raw
  modified_base (322)..(322): a, c, t, g, unknown or other
  misc_feature (322)..(322): n is a, c, g, or t
  modified_base (377)..(377): a, c, t, g, unknown or other
  misc_feature (377)..(377): n is a, c, g, or t
  modified_base (517)..(517): a, c, t, g, unknown or other
  misc_feature (517)..(517): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttcctgttgctattataaaggtgtccagtgtcaggtgaagctggtggagtcgtgggggaggcttgggtcaagcctgggacgggtccctgagactctcctgtgcagcctctggacttcgcctctggattgacgttcagtgactactacatgaccgtgggtcccncgagcctccgaggggagggctggagttgggttcatacgatttagcctagtggtanataccatatactacgcagtactctgtagaacgggctattccacctatcctaccgaggaccaacgacaagaactcactgacttgactaaatcgaaccacctgacgagccgagacacggtcgtaatactcgtgtgacgtaanaacgtacccgttcgacgttaggttacttacg

SEQ ID NO: 38761 - DNA, 530 bp, Homo sapiens
  misc_feature: GYAE6OF02H1D29.10.79.H02.1.454.CMB.1.raw
  modified_base (201)..(201): a, c, t, g, unknown or other
  misc_feature (201)..(201): n is a, c, g, or t
  modified_base (518)..(518): a, c, t, g, unknown or other
  misc_feature (518)..(518): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcaggccactggcatcccagacaggttcagtggcagtgggtctgggacagacttcactctcaccatcagcagactggagtctgtaagtatttgctagtgttatttattgtcgtataatagtggtagtctacgtggtactttacggccgtagggacaagtcgtaggacgtagtacgaaacgtacgtggtacgtcgtagacacctagttcgtnttccttactacc

SEQ ID NO: 38762 - DNA, 537 bp, Homo sapiens
  misc_feature: GYAE6OF02G4PD3.10.79.H02.1.454.CMB.1.raw
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (460)..(460): a, c, t, g, unknown or other
  misc_feature (460)..(460): n is a, c, g, or t
  modified_base (502)..(502): a, c, t, g, unknown or other
  misc_feature (502)..(502): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctggagggtccctgagactctcctgtgcagcctctggattcgcctctggattgacgttcagtgactactacatgacctgggtccgccaggctccgagggagggctgggagtgggtttcagtacatttancctagtggtnataccatatactacgcagactctgtgaagggccgattcacatctccagggacaacgccaagactcactgtactttgactaaatgaaccnccctagcagccgaggacacggaccgtatacgttactgtacgngaacgtaacgtaccggttcgcgttggttattaccg

SEQ ID NO: 38763 - DNA, 556 bp, Homo sapiens
  misc_feature: GYAE6OF02IM6KQ.10.79.H02.1.454.CMB.1.raw
tcagcatagtagtgcacgaccggtgctcgatttagtgtcacacgaagggaaaggggagctctgggagaagagccccagcccccagaattcccaggagtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggcccgccaggcctccgaggggacggggctgggagtgggtctcgagttatagaacagatggcactacatattattctgtactccgtgaacgggtccgttcaccctctccagacgacacttacaaacaacattcttagttatcctttacaacatcgcaactaatctagagagtacgaacgaccaccggcctaaccttattactggtcgccgcgaacatacgacctacgtcctacgtaacttccggtaggggaccg

SEQ ID NO: 38764 - DNA, 567 bp, Homo sapiens
  misc_feature: GYAE6OF02IP7X6.10.79.H02.1.454.CMB.1.raw
tcagcatagtagtgcacgaccggtgctcgatttagtgtcacacgaagggaaaggggtctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctggaggtccctgagactctcctgtgcagcctctggattcgcctctggattgacgttcagtgactactacatgacctgggtcccgccaggctccgagggaacggggctgggagtgggtttcagtactatttaactcctagtggttagataccatatacctacgcagtactctgtagaaggccattcacatctccaggacaacgccaagaactcaactgacttgactaaatgaaccaccgtgacgacgccgagacgacggacctatacgtactgtaggacgtaagaaacgttaccccggttcgtaccgttacgggtttaactttaccgttagtaacccg

SEQ ID NO: 38765 - DNA, 539 bp, Homo sapiens
  misc_feature: GYAE6OF02HOOD9.10.79.H02.1.454.CMB.1.raw
  modified_base (318)..(318): a, c, t, g, unknown or other
  misc_feature (318)..(318): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgacctgggtccncaggctccgagggaagggctggagtgggtttcagtactatttatcctagtgtgataccatatactacgcagactctgtgaaggcgattcacatcncaggacaacgccaagaactcactgactttagacaaatcgaacctacctgacagaccgaggaccacggtcgtaatcttaacgtgtagacgagaacgtacccgttacggcctttaggtactttaaccg

SEQ ID NO: 38766 - DNA, 525 bp, Homo sapiens
  misc_feature: GYAE6OF02HFHBM.10.79.H02.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcagggccactggcatcccagacaggttcagtggcaggtgggtctgggacagacttcactctcaccatcagcagactggagtctagaagtatttgcagttgttatttagttgtcggtactaatagtggtaggtctaccgttgggtacgttttggccgtaggggaccaagtcgtggagagtacgaaacgtactggtggtctgcacatctgttcttctac

SEQ ID NO: 38767 - DNA, 564 bp, Homo sapiens
  misc_feature: GYAE6OF02H3WS5.10.79.H02.1.454.CMB.1.raw
  modified_base (202)..(202): a, c, t, g, unknown or other
  misc_feature (202)..(202): n is a, c, g, or t
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccacgctctcctgcagggccagtcagagtcttagcagcaactacgttgcctggtaccaacagaaacctggccaggctcccgggctcctcatctatggtacatctagcagggccacgtggcatcccaagacaggttcagtggctagtgggtctgggacagcttcactcncaccatcagcacgcctagngcctagaagtatttgactagtttattactgtcagcagccgtgccgtacgtttcggcggtaggtcgtccgtacggtttcggacggtacgggaaccaaagtacggaacggtacgaaaaccggtacgttggtacggtaccgtacgacctaaccgtaagtccgttacgttacttaccg

SEQ ID NO: 38768 - DNA, 524 bp, Homo sapiens
  misc_feature: GYAE6OF02GBCL4.10.79.H02.1.454.CMB.1.raw
  modified_base (305)..(305): a, c, t, g, unknown or other
  misc_feature (305)..(305): n is a, c, g, or t
  modified_base (363)..(363): a, c, t, g, unknown or other
  misc_feature (363)..(363): n is a, c, g, or t
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
  modified_base (487)..(487): a, c, t, g, unknown or other
  misc_feature (487)..(487): n is a, c, g, or t
  modified_base (508)..(508): a, c, t, g, unknown or other
  misc_feature (508)..(508): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtctgggggaggcttggtcaagcctggagggtcccctgagactctcctgtgcagcctctggattcgcctctggattgacgttcagtgactactacntgacctgggtccgccagggcctccgagggaagggctggagtgggtttcatacatttancctagtggtgataccatatactacgcagctntgtgaaggccgattcaccatcncagggacaacgcaagactcactgacttgcaaatgaacacctgcgagccgagacacggccgtaatacttacngtagcgagaactaccggttcnccttaggtattacccg

SEQ ID NO: 38769 - DNA, 501 bp, Homo sapiens
  misc_feature: GYAE6OF02F95QE.10.79.H02.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccacgctctcctgcagggccagtcagagtgttaaacacaactacttagcctggtaccagcagaaacctggccaggctcccaggctcctcatctatgatgcatccagcagggccactggcatcccagacaggttcagtggcagtgggtctgggacagacttcactctacaccatcagcagactggagcctagaagtatttgctagtgttattactgtcagcagtatggtcgcccggcgctcgtagttcggcggagggaccaggtgagatacgaaacgacgtgtcggctgactaccatctcg

SEQ ID NO: 38770 - DNA, 637 bp, Homo sapiens
  misc_feature: GYAE6OF02IO27S.10.79.H02.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcacacgaagggaaagggggaaggagctgctcagttaggacccagagggaaccatggaaaccccagcgcagcttctcttcctcctgctactctggcctcccagataccaccggagaaattgtgttgacgcagtctccaggcaccctgtctttgtctccaggggaaangccacgctctcctgcagggccagtcagagtcttagcagcaactgttcgctggtaccaacagaaacctggaccaggcctccccgggctcctcatctatcggtacatctacgctacgggcctacgtggaccactcccaaggtactaggttccaagtggcctagggttcgggtctgggaacagtacttcgaactcctacgacctatcacgacacgtacgtggtacgtcgtagtaagtacgtttggactagtcggttaatttagttagttacgagtacaagttacgttaggttacggttacgtaccggttagggttaccgtttgggtaccggtagggtaaccgtaacggtaccgtaggaacgtagtaaccgtaaacggtaacgttagggtacgtacgtacggtacctaccgtaacgttccgttagttcctttaaccg

SEQ ID NO: 38771 - DNA, 532 bp, Homo sapiens
  misc_feature: GYAE6OF02G8Z98.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccgagggaggggctgggagtgggtttcatacatttatcctagtggtgataccatatactacgcagactctgtgaagggccattcacatctccgaggacaacgccaagaactcactgactttgacaaatgaacaccctgcgagccgaggacacggccgtatacttactgtgacgagtaacttaacccgttcgaccgttggttattaccg

SEQ ID NO: 38772 - DNA, 543 bp, Homo sapiens
  misc_feature: GYAE6OF02I3JKS.10.79.H02.1.454.CMB.1.raw
  modified_base (324)..(324): a, c, t, g, unknown or other
  misc_feature (324)..(324): n is a, c, g, or t
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (466)..(466): a, c, t, g, unknown or other
  misc_feature (466)..(466): n is a, c, g, or t
  modified_base (505)..(505): a, c, t, g, unknown or other
  misc_feature (505)..(505): n is a, c, g, or t
  modified_base (526)..(526): a, c, t, g, unknown or other
  misc_feature (526)..(526): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggacttccgccttctggattgacgttcagttgactactacatggaccctggggccnccaggcctccgaggggagggctgggagtgggtttacatactatttatcctaggtggtnataccatataacctcgcagactctgnggaaggctatcacntcnccgaggacacgcaacactcactgacttagactaatgaaccnccgtgcgagccgaagcgacgccggtaatacgttactggngcgaagtaaccgttacccgtnccgtttagtacttaccg

SEQ ID NO: 38773 - DNA, 562 bp, Homo sapiens
  misc_feature: GYAE6OF02GDR27.10.79.H02.1.454.CMB.1.raw
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagcctggagggtccctgagactctcctgtgcagcctctggattcgcctctggattgacgttcagtgactactacatcgacctgggtccncaggctcgagggagggctggagtggttcatacatttacncctagtggtgataccatatactacgcagactctggtagaacggggcctattccaacctatcctccgagggaccaacggccaaagacctcactgacttgacaaatcgaacctccgtgacgacgccgaggaccacgggtccgtaatacttacgnggtacgacgtaagtaaccttaccccggttgacccgtttaggttacttaccgg

SEQ ID NO: 38774 - DNA, 543 bp, Homo sapiens
  misc_feature: GYAE6OF02GNADL.10.79.H02.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctagtaagtatttgactagttgttaatttattgtacagtactaattagtaggtaggtctaccgttgggtacgttttggaccgagggaccgaagtcgtaggagtacgtacgaaacgtacgtggtaggcgtacgctaccgtatcgttcgtcttacg

SEQ ID NO: 38775 - DNA, 582 bp, Homo sapiens
  misc_feature: GYAE6OF02GXS9P.10.79.H02.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggctccncatctatggtacatctagcagggccactggcatcccagacaggttcagtgcagtgggtcngggacngacttcactctcaccatcagcagactgggagtcgtgaagtatttgacgtagtgttattagttgtctagtactaatagttaggtacggttcgtaccgttgggttacgttttcgggaccgtaacgggtaaccgaaggtaccgtagggaagtacggtaaccgaaaaccggtaacgtaggtacggtacgttacggacctaccgtacttacgttacgttaccgtttaccg

SEQ ID NO: 38776 - DNA, 581 bp, Homo sapiens
  misc_feature: GYAE6OF02HMX9F.10.79.H02.1.454.CMB.1.raw
  modified_base (267)..(267): a, c, t, g, unknown or other
  misc_feature (267)..(267): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtggggggagcttggtcaagcctggacgggtccctgagactctcctgtgcagcctntggacttcgcctcgtggattgacgttcagtgactactacatgacctgggtccgccaggctccgaggggagggctgggagtgggttcagtacatttatccgtagtggtgactaccatatactacgcagactctggtagaagggcctattcacctatccaccgagggaccaaccgaccaacgaacctcactgtacctttgactaaatcgaacctaccctggacgacgccggaggaccgaccggccgttaatacgttacgtgtcggacgtaaggtaaccgtaaccccggttcggtaccgttaggttactttaacccg

SEQ ID NO: 38777 - DNA, 784 bp, Homo sapiens
  misc_feature: GYAE6OF02HZ18U.10.79.H02.1.454.CMB.1.raw
  modified_base (197)..(197): a, c, t, g, unknown or other
  misc_feature (197)..(197): n is a, c, g, or t
  modified_base (262)..(262): a, c, t, g, unknown or other
  misc_feature (262)..(262): n is a, c, g, or t
tcagcatagtagtgcacgaccggtgctcgatttagtgtcacacgaagggaaagggggagagctgctcagttaggacccagagggaaccatggaaacccagcgcagcttctcttcctcctgctactctggctcccagataccaccggagaaattgtgttgacgcagtctcaggcaccctgtctttgctcaggggaaangccagctctccgtagcagggccagtcagagtctagcagcaacttgtgctagtatacaacaaagcnggcacggctacccagactcctacactcctactggtcgacagttccgttcggaacgggccctaacgtcgggtccggttaccccaggtacccgtaagggtttcaacgggttcggtacgtaacgggtcggggttaccgtaagggtaacgaaagggttcggtttacccaacggttccgttaacccgaaccgttagtaccgtaacgggccccggtacccggttacggacgtaacggttaccgttaagggtaaacgttacggtttttacggtaccgttaaacggttttaacgttttaaccggttaggtaaccgttaacgggtacctaaaagggttttaaacttaaacggttaacgttacgggttttaagggttttttacgttaccttttaaccgttttcccggggtaacccgttaacgggggtaaaccttaaacggggttaggtttaacgttttacggaaggttaaaccgtacgttacgggttacgacgttacggtacctaccgttacgttacgtttcgtactttacg

SEQ ID NO: 38778 - DNA, 695 bp, Homo sapiens
  misc_feature: GYAE6OF02GQHCY.10.79.H02.1.454.CMB.1.raw
  modified_base (322)..(322): a, c, t, g, unknown or other
  misc_feature (322)..(322): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggaggcttgggtcaagcctgggagggtccctgagactctcctgtgcagcctctggattcgcctctggattgacgttcagtgactactacatgacctgggtccnccaggcctccgaggggaggggctgggagttggggtttcagttactatttactcctaggttggtgtaacttaacccattaacttaccgtaccgcaacgtaccttacgtggttaggaaacggggtcccgtaattccaaccctattccctacccgaacgggaaccaaacccggacccaaaacggaaacctaccgaaccttacggtaaccttttacggaacctaaaattacgaaaccctaccccgtaggaccgaacggtacccggaacgggacccgaccgggtacccgttaattaaccgtttaccgtaggttacggacggaaggtaacccttaaccccgggtttcccgtacccgtttacgggtttactttaacccgg

SEQ ID NO: 38779 - DNA, 866 bp, Homo sapiens
  misc_feature: GYAE6OF02FJM5M.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagtctgggttttcctgttgctattataaagtgtccagtgtcaggttgagtcgtggtggtagtcgtggggtagcttggtcagcctggacgggtccctgacgtactctccgtgtcgcgacgtccctcgtggtactttccggcccttaccgtgggtactttcggtaccggttaccgattaccggtaaccttaacctactacgttcggtaccgttcgggtacccgtccgaacgggtccctaccgggtaacggggtaacggggtccgttagggtacgggtttagggttttaccaacgttaacctattttacgtacccgtttaggtagggttacaacttacccgtattaccgttaccgtaccgtctaacgtaccgttcgtacggtacgggaaccggtcctaacgttaccaacccgtccgttaccctaccgggaacggtaacccaacccggtaccctaaacgtaaacccttcgtaaccgtttaacggtaaccctttacggaaccttaaaaaccggttacccgaaaaacccccttcccgggttaacggaaacccgggtacccggtaaccccgggtaagggtacccggtaacccggttaccgggttttaaaacttaccggttaaccggttagggttaccgtaaccggtaaacccggttaaccccgttttaacccccggtacggtttaaccccgtttacggggttttttaacccttaaccccggg

SEQ ID NO: 38780 - DNA, 651 bp, Homo sapiens
  misc_feature: GYAE6OF02G7C98.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaagcctgggacgggtccctgacgactctcctgtgcagcctcgtggattccgcctcgtggattgacgttcaggtgactactacatcgaccgtcgggtccgccaggcctccgaggggagggctgggagttcgggtttcagtactatttactccgttaggtggtgacttaccattactacgtacgcagtacctcgtgtaggaacgggtcccgtattccgaacctacttcctaccgaacgggaaccaaccgaccaaagaaccctcgaaccttcgtacctttacgaacctaaaagttccgaaaccctacccgttggaccgaaccggcccggaaggacccgaccggtacccgtaattacgttacgtaggtacgacgaacggtaaccgttaaccccggttcgtacccgtttaggttactttacccgg

SEQ ID NO: 38781 - DNA, 731 bp, Homo sapiens
  misc_feature: GYAE6OF02HLRL5.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtgggggaggcgttggtcaagccgtggagggtccctgagactctcctgtcgcagcctctggattcgcctctggattgacgttcagtgactactacatcgaccgtgggtccgccgaggcctccgaggggaagggctgggagttgggtttcagttactatttactccgttaggtggtagtactaaccattactactacgctaacgacttctaggtaggaacgggcccgtattccgaacctagttcccgtaccgaaggggtaaaccctaaccggacccgtaaaacggaacccttaccgaaccgttacggttaacccgttttacggaaccgtaaaaacgttccggaaaaccctaccccgttaggacccggaacggtaccccggaagggtaacccgaaccggggtaccccgttaaagttaacccgtttaacgtacggtaccggtaaccggtaaacggttaaacccggtttaaacccccggtttcccggtaccgttttacgggttttaacctttaaccccggg

SEQ ID NO: 38782 - DNA, 594 bp, Homo sapiens
  misc_feature: GYAE6OF02F342Z.10.79.H02.1.454.CMB.1.raw
  modified_base (201)..(201): a, c, t, g, unknown or other
  misc_feature (201)..(201): n is a, c, g, or t
  modified_base (373)..(373): a, c, t, g, unknown or other
  misc_feature (373)..(373): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtctagcagcaactacgttgcctggtaccaacagaaacctggccaggcctcccgggctcctcatctatggtacatctagcagggccacgtggcatcccagacaggttcaggtggacaggtgggtctgggacagtactcacttcnccacatcagcagactggagtctagaagtatttgactagttagttaattagttgtactagtactaaagttagttaggtaaggttccgtaccggttagggttacgttttcgggaccgtacggggtaacctaaggtcgttagggaacgtacgtaacgaaacgtaaccggttagggtacggtaccgtaggaccgtaacccgtacgttccgttacgttccttaccg

SEQ ID NO: 38783 - DNA, 570 bp, Homo sapiens
  misc_feature: GYAE6OF02IN2O2.10.79.H02.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcacacgaaggggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctccccgggctcctcactctatggtacatctagcagggccactggcactcccagacaggttcagtggcagtgggtctgggacagacttcactctcaccatcagcagactggagtctagaagtgtttgctagtgttatttagttagttcagtactaattagtaggttaaggtcgtacgttcgggttacttttgggaccgtacggggaaccgtaagtaccgtagggacgtagtacgtaaaaccggtacgttggtacggtcgtacgaccgtaccgtattccgttagttcttaccg

SEQ ID NO: 38784 - DNA, 576 bp, Homo sapiens
  misc_feature: GYAE6OF02IF3LY.10.79.H02.1.454.CMB.1.raw
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggacgggtccctgagactctcctgtgcagcctctggattccgcctctggattgacgtttcagtgactactacattgaccctggggtccnccaggctccgagggacggggctgggagttgggttcatacatttacncctaggtggtgactaccattatacacgcagactctgtgaacgggcgtattcacctatctaccgaggaacacgaccaagaactcactacgactttacgactaaatgaacacccgtgaccgacgaccgacggacgaccggaccgtaatacttacgtgtacgacggtagaacgttaacccgttacgtccgttacggttacttacccg

SEQ ID NO: 38785 - DNA, 637 bp, Homo sapiens
  misc_feature: GYAE6OF02H1PBW.10.79.H02.1.454.CMB.1.raw
  modified_base (414)..(414): a, c, t, g, unknown or other
  misc_feature (414)..(414): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctccagataccaccggagaaattgtgttgacgcagtctccaggcaccctgtctttgtctccgaggggaaagagccacgctctcctgcagggccagtcagagtctagcagcaactacgttcgcctaggtaacccaaacgacgaaaaccgtcggaccaacgggcctaccccgggctccctcatactagtggtacacttctagcgacgggccacgtcggcactcccagacgtaggttcaggtggcgtaggtggtcgtgggacagtaccttcactctaccacatcgancacgacgtaggacgtcgtagtaagttagttcgacgtagttagtttatttagtttgtacgtagtactaagttagttagggttacggttaccgtaccggttagggttaccgttttcgggaccggtacgggaaccgaaggtacgtagggtaacgtacgtaacgtaaaccggtaacgtaggttacggtcgtacgaccgtaccgtagttaccgttcgttacgttaccg

SEQ ID NO: 38786 - DNA, 566 bp, Homo sapiens
  misc_feature: GYAE6OF02II825.10.79.H02.1.454.CMB.1.raw
  modified_base (413)..(413): a, c, t, g, unknown or other
  misc_feature (413)..(413): n is a, c, g, or t
tcagcatagtagtgcacgaccggtgctcgatttagtgtcacacgaagggaaaggggagctctgggagaagagccccagcccccagaattcccaggagtttccattcggtgatcatcactgaacacagaggactcaccatggagtttgggctgagctgggttttccttgttgctattataaaaggtgtccagtgtcaggtgaagctggtggagtctgggggagcttggtcaagcctggaggtccctgagactctcctgtgcagcctctggattccgcctctggattgacgttcagtgactactacatgacctgggtccacaggctcgagggagggctggagtggtttcatactatttatcctagtggtgataccattatactacgcagactctgtggaacgggcctattcaccntccaccgagggacacgccaaagactcactgacctttgactaaatcgaaccacccgtgaccgtaacgcccgaaggacgaccggtaccgtataacgttacgtcgtcgtacgagaaccttaaccccggtcgtacccgtttaggttaacttacccgg

SEQ ID NO: 38787 - DNA, 633 bp, Homo sapiens
  misc_feature: GYAE6OF02IQ9DB.10.79.H02.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtctagcagcaactacgttgcctggtaccaacagaacctggccaggctcccgggctctcatctatcggtacatctagccagggccactgcactcccagacaggttcagtcggcaggtcgggtctagggacacggtacttcaccgtctaccacctatcgagaccgagtaccgtggacgtcgtaggtaacgtagtttacgaccgtagttagttatttagtttgttacgtagtacctaacgttagtagggttaacggtccgtacccgttagggttaccgttttacgggtccggtaaacggggtaacccgaaggtcgtagggtaacgtaacgtaaccgaaaaccggtaacgttagggttcggtacgtacggaccgtaccgtaacgtccgttacggttaccttacccg

SEQ ID NO: 38788 - DNA, 681 bp, Homo sapiens
  misc_feature: GYAE6OF02H0K9A.10.79.H02.1.454.CMB.1.raw
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
  modified_base (392)..(392): a, c, t, g, unknown or other
  misc_feature (392)..(392): n is a, c, g, or t
  modified_base (522)..(522): a, c, t, g, unknown or other
  misc_feature (522)..(522): n is a, c, g, or t
tcagcatagtagtgcacgaccggtgctcgatttagtgtcacacgaagggaaaggggagctctggagaagagcccagccccagaattcccaggagttccattcggtgatcagcactgaacacagaggactcaccatggagttggctgagctgggtttccttgttgctattataaaaggtgtccagtgtcaggtgaagctggtggagtcgtgggggaggtcttgggcaaggccgtgggtaggggtccctagaggtacctctccgtaggtgcaggccctcgtggattcgcctcncggtattgacggttcagttgactacacatgaccgtggtcccncgacggctaccgagggtaacggggctaggggagttggggttacagttaactagtttacnccgttagtggtagtactaaccgattactacgtacgactacgtaactgtacggtaggaacgggtccagttaccaccatccgtaccgaacgggactaaccgacaaacgtactacgacctagttaccgtttanacctaaagtaccgaaccaaccctcggaacggtaaccgaccggtaacgacgacccgggtacccgttaagtaaccgttacaacgggttacaccgggttaaacgtaacccgttaacccccggtttaaccgggacccttttacgggttaactttaacccccgg

SEQ ID NO: 38789 - DNA, 593 bp, Homo sapiens
  misc_feature: GYAE6OF02FUD4Z.10.79.H02.1.454.CMB.1.raw
  modified_base (202)..(202): a, c, t, g, unknown or other
  misc_feature (202)..(202): n is a, c, g, or t
  modified_base (363)..(363): a, c, t, g, unknown or other
  misc_feature (363)..(363): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccacgctctcctgcagggccagtcagagtcttagcagcaactacgttgcctggtaccaacacgaaacctggccaggcctcccgggctccctcactctatcggtacatctagcgacgggccacgtgcactcccgagacaggttcaggtggcaggtggtcgngggacacgtacttcacctctaccgacctagtcagcaagacgtggtacgtcgtagtaagtatttaggacgtagttagtttattagtttcgtactagtactaagtagtacggtaggtctacgttacgggtacgtttacggtaccggtaagggtaccgtacgtacgtaggacgtaacgtaacgaaacgtacgtaggtcgtacgtcgtactaccgtatcgttacgtcgttaccg

SEQ ID NO: 38790 - DNA, 522 bp, Homo sapiens
  misc_feature: GYAE6OF02F7EB8.10.79.H02.1.454.CMB.1.raw
  modified_base (262)..(262): a, c, t, g, unknown or other
  misc_feature (262)..(262): n is a, c, g, or t
  modified_base (373)..(373): a, c, t, g, unknown or other
  misc_feature (373)..(373): n is a, c, g, or t
  modified_base (501)..(501): a, c, t, g, unknown or other
  misc_feature (501)..(501): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaagagccacgctctcctgcagggccagtcagagtcttagcagcaactacgttgcctggtaccaanagaaacctggccaggctcccgggctcctcatctatggtacatctagcagggccatggcatcccagacaggttcagtggcagtgggtctgggacaggacttcactctcaccntcagcacgacgtggagtcgtagaagtatttgctagtgttattattgtcagtctaatagttaggtaggtctaccgtggtacgttttggccgtagggactagcgtaggagacgtacaacgaacgtgtggngtcgcaccgatcgtgtcttcg

SEQ ID NO: 38791 - DNA, 522 bp, Homo sapiens
  misc_feature: GYAE6OF02F34AD.10.79.H02.1.454.CMB.1.raw
  modified_base (199)..(199): a, c, t, g, unknown or other
  misc_feature (199)..(199): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtcttgtctccaggggaangccacgctctcctgcagggccagtcagagtcttagcagcaactacgtgcctggtaccaacagaaacctggccaggctccccgggctcctcatctatggtacatctagcagggccactggcatcccagacaggttcagtcggcaggtgggtctgggacagacttcactctcaccatcagcagactggagtctgaagtatttgctagttgtatttattgtctagctaatagtggtagtctacgttggtacgtttggaccgtagggacctaagcgtaggagagtacgtaaacgaagtgtgacgtcgaccaccgatcgtgttcgttc

SEQ ID NO: 38792 - DNA, 543 bp, Homo sapiens
  misc_feature: GYAE6OF02GEVTF.10.79.H02.1.454.CMB.1.raw
  modified_base (320)..(320): a, c, t, g, unknown or other
  misc_feature (320)..(320): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggagggtccctgagactctcctgtgcagcctctggattcgcctctggattgacgttcagtgactactacatgacctgggtccnccaggctccgaggggagggctggagtgggttcatacatttancctagtggtnataccatatactacgcagactctgtgaaggccatcacntcncaggacaacgcaagactcactgactttgacaaatacgaaccacccgtgacgacgccgaggaccgacggaccgttaatacttactggtagacgagtaacgtaaccccggttcgaccttaggttacttaccg

SEQ ID NO: 38793 - DNA, 753 bp, Homo sapiens
  misc_feature: GYAE6OF02HTN4M.10.79.H02.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccactggagaagtagtgatgacgcagtctccagccaccctgtctgtgtctccgaggggaaacngccaccctctcctgcaggccagtcagagtgtggcngcaggttagctggtaccagacagaacgtggccacggctcccgaggcctcctgtatagtggtcgcactccaccgagggccctagttggtactctacgaggccgtacggttcccggtaggctagggttcgggtcgttacgggactaggtagttccacgttcggttacccaccgtacttcgaacgtccgaacggtccgttacggaccgtacggttacgtacgggtaaacgtttacgtttttcgtacgtttaacggttttttaacttactttcgggttaccgtaaggtaccttaaaggtttaaactttaaacggttacggtacccgttaacccggggtaccccggtaccgggtttaaccccggggtttaccgggaaaccccggggtaaagggggttaccccgggtaaggggttaccggttaaaccggtttaaaccgaaaaccggttaacgggttcggtacggtaccgttacggacccgtaaccgttacggtttaccgttccggtttacccttaacccgg

SEQ ID NO: 38794 - DNA, 421 bp, Homo sapiens
  misc_feature: GYAE6OF02IS14F.10.79.H02.1.454.CMB.1.raw
  modified_base (321)..(321): a, c, t, g, unknown or other
  misc_feature (321)..(321): n is a, c, g, or t
  modified_base (412)..(412): a, c, t, g, unknown or other
  misc_feature (412)..(412): n is a, c, g, or t
  modified_base (417)..(421): a, c, t, g, unknown or other
  misc_feature (417)..(421): n is a, c, g, or t
tcagcatagtagtgcacgaccggtgctcgatttagtgtcacacgaagggaaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccaggggaaccctggtcaccgtctcctcagcctccaccaagggcccatcggtcttccccctggcnccctgctccaggagcacctccgagagcacagcggccctggctgcctggtcaaggactacttcccatactatgctgagcgggctggcaggcnatagnnnnn

SEQ ID NO: 38795 - DNA, 716 bp, Homo sapiens
  misc_feature: GYAE6OF02FH47F.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggacgggtccctgacgactctccgtgtgcagcctctggacttcgcctcgtggattgacgttcatcgactactacatgacctgggtccgccaggctaacgagggaacgggtctgggagttgggtttacagttacatttactccgtaggtggtgaactaccgtaatactaccgtacgcaacgtactcgtaggtacggaacgggtcccgtattaccgaccctactccgtacccgaagggtaaccaacccggacccaaacgaaccttccaaccgttacgtacctttacggaacctaaaagtccggaaacccgtaccccgtagacccgggtacgaccccgggaacgggtacccgtaaccgggtacccgttaaagttaaccgttaaccggttacgggtaccggaaccgggttaaacggttaaaacccgtttaacccccgggttttaccgaccccgggttttacgggtttttaaccctttaaccccggg

SEQ ID NO: 38796 - DNA, 681 bp, Homo sapiens
  misc_feature: GYAE6OF02J2PQE.10.79.H02.1.454.CMB.1.raw
  modified_base (198)..(198): a, c, t, g, unknown or other
  misc_feature (198)..(198): n is a, c, g, or t
  modified_base (337)..(337): a, c, t, g, unknown or other
  misc_feature (337)..(337): n is a, c, g, or t
tcagcatagtagtgcacgaccggtgctcgatttagtgtcacacgaagggaaaggggagctctgggagaagagccccagcccccagaattcccaggagtttccattcggtgatcagcactgaacacagaggactcaccatggagtttgggctgagctgggttttcctgttgctattataaaggtgtccagtgtcaggtnaagctggtggagtctgggggagcttggtcaagcctggacgggtccctgagtactctccgtgtgcagcctcgtggattccgacctcgtggtattgacgttcagtgactactacagtcgaccgtgggtcccgccaggtccnccggtaaggggacgggtctgggtaggttcggggtttcaattaccgtatttactccgtaaggttcggtagtactaccgaattacgtaacctaccgtcaacgtattcccgtaggttaacggaaacggggcccgtattaccgaaccctattcccgtaacccgagggaaccctaaccggacccaaacgtaacctccgaaccgttgtaaccgttttcggaactaaacgttcggaaaccctacccgtggaccgaacggcccgaagggacccgacggtaccgttaattacgtcgttagacgaccgaacgttaccgtaacccgttccggttcgttacggttaccttaaccgg

SEQ ID NO: 38797 - DNA, 563 bp, Homo sapiens
  misc_feature: GYAE6OF02F5UO9.10.79.H02.1.454.CMB.1.raw
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
  modified_base (380)..(380): a, c, t, g, unknown or other
  misc_feature (380)..(380): n is a, c, g, or t
  modified_base (546)..(546): a, c, t, g, unknown or other
  misc_feature (546)..(546): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccacgctctcctgcagggcccagtcagagtcttagcagcaactacgttncctggtaccaacagaaacctggccaggcctcccgggctcctcatctatggtacatctagcagggccactggcactcccagacctaggttccagtggctaggtgggtctggggacacgacttcacttcnccaccatcagcagactgggatcgtagaagtatttgacgtagttggttatttagttggtacggacttaaatgttaggttacggtctacgttggggttactttcgggaccgtaggggacctaaggcgtagggagacgtacgaaacgaacgtgtacggctacgcacctntcgtcgttctactcccg

SEQ ID NO: 38798 - DNA, 696 bp, Homo sapiens
  misc_feature: GYAE6OF02IBXE1.10.79.H02.1.454.CMB.1.raw
  modified_base (327)..(327): a, c, t, g, unknown or other
  misc_feature (327)..(327): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttggctgagctgggttttcctgttgctattataaaaggtgtccagtgtcaggtgaagctggtggagtcgtgggggaggtcttggtcaagccgtggagggtcctgagactctcctgtgcagcctgtggacttcggcctctggatttggacgtttcagtgacttactacatgacccttgggtcccnccgtaggcctaccgagggggaacggggtcgttgggaacggtttggggtttaccaagttacgtagtttttactccgtttaagggtggtagactttaacccatttaactacgtacgctacgtacttcgtaggttcggaagggtccgtattccacctacgttcctaccgacggggtaaccaaccgtaccgaaacgtaaacctccaaccgttggtaaccttttagacctaaaagttcgaaacccttaacccgtcggaacgaccgaccggaacggacccgtaccggtaccgttaattaccgttacgtcggtacgaccggtaacgttaacccgttaacccggtttccggtaccgtttaggtttaaccctttaccg

SEQ ID NO: 38799 - DNA, 758 bp, Homo sapiens
  misc_feature: GYAE6OF02IN91B.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtgggtttccttgttgctattataaaaggtgtccagtgtcaggtgaagctggtggagtcgtgggggaggcttggtcaaggcctgggagggtccctgacgactctcctgtgcacgcctcgtggattccgccttcgtggattgacgttcagtgactactacatcgaccgtgggtccgccgaggccgtccggaaggggacgggtcgtgggtacggttgggtttcaagttactatttactaccgtaggttcggtagtactaaccattactaacgtacgctacgtaccttcgtaggtacgggaaacgggtcccttaacgttttacccacgttccctaaccggaacggggtaaacccaaaccgtacccgaaaacgtaacccttacgtaaccgttacgtaacgttttagaaccctaaagtttaccgaaacccgtacccgtacggaacccgggaacggaaccccgggaacggtaacccggacccgggttaaccgtttaacgttaaccgttttaacggtcggttaaccggaaccgggtaaacgtaaaccccgtttaaccccgggttacccggttacccgtttaacggggttttaaccttacccccgttaaggg

SEQ ID NO: 38800 - DNA, 533 bp, Homo sapiens
  misc_feature: GYAE6OF02GFKR9.10.79.H02.1.454.CMB.1.raw
  modified_base (373)..(373): a, c, t, g, unknown or other
  misc_feature (373)..(373): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctgggtccgccaggcctccgagggagggctgggagtgggttcatactatttatcctagtggtnataccatatactacgcagactctgtgaagggcgattcacatctcagggacacgccaagactcactgtacttgactaancgaacncctgcgagccgaggaccacggccgtaatacttactgtagcgagaactaacccgttcgcccgttaggttacttaccg

SEQ ID NO: 38801 - DNA, 512 bp, Homo sapiens
  misc_feature: GYAE6OF02FI4PX.10.79.H02.1.454.CMB.1.raw
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
  modified_base (429)..(429): a, c, t, g, unknown or other
  misc_feature (429)..(429): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaatagttttgacgcaatctccagccaccctgtctgtgactccaggtgagagagccaccctctcttgcagggccagtcaggggatcagcagcaaatttagcctggtaccaacagaagcctggccaggttccccagacctcctcatatatgaacgcctacttccacgggccactggacgtcccagccaggttcagcggcgtgggtctgggacagcttcnctctcacatcacgcagcctgcngtctgagcttggtatttatacttgtcagcagtatcatacnggcctcgtggtcgttcggcgaaggacaggtcgactacgaacgagtgtagcgtagactaccagtctcgtcttcactccttcccg

SEQ ID NO: 38802 - DNA, 537 bp, Homo sapiens
  misc_feature: GYAE6OF02FNBRL.10.79.H02.1.454.CMB.1.raw
  modified_base (319)..(319): a, c, t, g, unknown or other
  misc_feature (319)..(319): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgctctggattgacgttcagtgactactacatgacctggggtccncgaggcctccgaggggacgggctgggagtgggttcatacatttactctagtggtnatacatatactacgnagctntgtgagggcatcacatctcgagggacaacgcaagactacactgacttgacaatcgaacctcctgacgacgaccgaggaccacggtccgtaatacttacgtggtgtacgacgtaacttacccgttcgccttaggttacttaccg

SEQ ID NO: 38803 - DNA, 563 bp, Homo sapiens
  misc_feature: GYAE6OF02FFC69.10.79.H02.1.454.CMB.1.raw
  modified_base (317)..(317): a, c, t, g, unknown or other
  misc_feature (317)..(317): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttgggtcaagcctggaggtccctgagactctcctgtgcagcctctggattcgcctctggattgacgttcagtgactactacatgacctgggtccncaggctccgagggaagggctggagtgggttcagtacatttatcctagtggtgataccatatactacgcagtactctgtgaaggccgatcaccatcnccgaggacaacgccaagactcatgactttgactaaatgaaccacccgtgaccgagacccggaaggaccgaccggcccgtaatacgttaccgtgtcgaccgaacggtaacttaaaccccggtttcgacccgttagggtttactttaacccg

SEQ ID NO: 38804 - DNA, 1157 bp, Homo sapiens
  misc_feature: GYAE6OF02FN5US.10.79.H02.1.454.CMB.1.raw
tcagcatagtagtgcacgaccggtgctcgatttagtgtcacacgaagggaaagggggagagctgctcagttaggacccagagggaaccatggaaaccccagcgcagctctcttcctctgctactctgcctccagactaccgaccggaagtaattgtgttcgacgctagtcctccgaggcctaccgtgttctttgtcctacggaaggggaaagcgccacgcttcctccgtcgcgacgggcctagtccgaaggtacgttcgttacggactacggacctaaaccgtttaccggttcgcccgttacggtaacccaacgaaaccggtaaacccgtcgggacccgaacgggtcccggtacccccggggtccttccccgtacgtacttccgttaagttacgggtacctaagttccgtacgaccggtaccggggaccctacggtccgggacctaacccgttaccccgaacggtaaccgttaccggggtttaccgacggggttaccgggaacgtacgggggtttccgggggttaccggtacggggggtaaccctaacgggtttaccctttaccgaaccccgttttcccgttacccgtaaacccgtaccgtttaaccgaacggtacccgtaaacgggtaccggtttacggggtaaccggttttaaccggtaacgggttaaaacgtttttacgggtttttaaccgggttaacggttaaacgggtttttaacggtttttaaacggtttttaaccgggttttttaacgggttaaacccgggttaaaccgggttaaaccctttaaaaggttttttaaacggggtttaccgggggttttaaacggggttttaccccccggttaaaacccgggggttttttaccggggggttttttaaacccgggttttttttaccccgggggggtaaacccggggttaaacccgggggggggttaaaaccccttaaccggggggttaccggggttttaaccgggggaaacgggtttaaaccccggttttaaaaaacccggggaaaaacccgggggtttaaaccccgggtttttaaaggggtacccggggtttaacccgtacccgggtttaaaccccggttaaacccccggtttaaccgttttcccgggttttaacccgttttccccggtttttaaaccccgg

SEQ ID NO: 38805 - DNA, 628 bp, Homo sapiens
  misc_feature: GYAE6OF02G062C.10.79.H02.1.454.CMB.1.raw
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctgggtcccncaggctccgagggagggctgggagtgggtttacagtactatttacncctaggtggtgtataccgattaactacctacgcaacgtaccttcgtggtacgggaaacggggtcccgtaatttccgaaccctaattccctacccgaaggggaacccaaaccggacccaaagtaacctaccaaccgttcgtaaccttttacgactaaaatcgaaaccacccgtaggccgaacgccgaaggaccaccgggtaccgtaattacttacgtgtcgacgtaacgtaacttacccgttcaccgttggttactttacccg

SEQ ID NO: 38806 - DNA, 701 bp, Homo sapiens
  misc_feature: GYAE6OF02J3IBG.10.79.H02.1.454.CMB.1.raw
  modified_base (353)..(353): a, c, t, g, unknown or other
  misc_feature (353)..(353): n is a, c, g, or t
  modified_base (432)..(432): a, c, t, g, unknown or other
  misc_feature (432)..(432): n is a, c, g, or t
  modified_base (678)..(678): a, c, t, g, unknown or other
  misc_feature (678)..(678): n is a, c, g, or t
tcagcatagtagtgcacgaccggtgctcgatttagtgtcacacgaagggaaaggggagctctgggagaagagcccagccccagaattcccaggagtttccattcggtgatcagcactgaacacagaggactcaccatggagtttgggctgagctgggttttcctgtgctattataaagtgtccagtgtcaggtgaagctggtgagtcgtgggggagcttgggtcaagtccgtgggacgggtccctgacgtacttcgtccgtgtcgcacggtccctgtacggtcgttccgcccgttacgtgggtacttggaccgtttcaaggtcgacctactacgatcgacccgttgggtcccncgtaggtcctacggaggggacgggtcttgggaggtttcgggttccagtaccgtattttaacgtcccgtaagtcggttanacttacccgtaattaccgtacgtacgctaaggtaccttcgtaggttagggaacgggtccctaatttcccgaaccgtacttccgtaccgaagggaaccctaacccgggaccctaaaggtaccctcgaaccgttggttacctttaggaacctaaattcgaaaaccctccgtgtaccgaacgtcccgaaggcccaacggtaccctaatcgttaactcggagaaccgtaacggtaaccttaccccggttntaccgttggttttaactacccgg

SEQ ID NO: 38807 - DNA, 533 bp, Homo sapiens
  misc_feature: GYAE6OF02FNED5.10.79.H02.1.454.CMB.1.raw
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
  modified_base (466)..(466): a, c, t, g, unknown or other
  misc_feature (466)..(466): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (519)..(519): a, c, t, g, unknown or other
  misc_feature (519)..(519): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgaccctgggtccnccaggcctccgaggggaagggctggaggtggggtttcatacatttactcctagtggtgataccatatactacgnagactctgtgaacgggcattcacatctccgaggacaacgccaagaactcactcgacttgacctaaatcgaacncccgtgcgagccgagaccacggccgtaatattacngtncganactacccgttnccttggttattccg

SEQ ID NO: 38808 - DNA, 550 bp, Homo sapiens
  misc_feature: GYAE6OF02HR7E9.10.79.H02.1.454.CMB.1.raw
  modified_base (201)..(201): a, c, t, g, unknown or other
  misc_feature (201)..(201): n is a, c, g, or t
  modified_base (379)..(379): a, c, t, g, unknown or other
  misc_feature (379)..(379): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggcctcccggctcctcatctatggtacatctagcgaggccacgtggcatcccagacaggttcagtggcaggtggtctgggacagacttcactctcaccatcgancagtactggagtctagtaagtatttgcgtagtgttattagttgtctagtataatagtggtaggtcgtaccgttgggtacgtttcggaccgtagggaacctaggtcgtaggacgtacgtaacgtaaacgtaacgtgtaggtcgtacgacctacctagtcgttcgttcttacg

SEQ ID NO: 38809 - DNA, 910 bp, Homo sapiens
  misc_feature: GYAE6OF02F683Q.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaggtgtccagtgtcaggtgaagctggtggagtcgtgggggagcttggtcaagccgtgggacgggtccctgagactctcctgtgcagccctcgtggacttccggccttcgtggatttcggtacgttcagtcgactactacagtcgacccgttggggtcccgccgaggtcctacccggaagggggtaacggggtcttaggggtaggttcggggttttacaagttacgtaattttaccgtccgtttaagggtcggttagtaacttaaccctaattaactaccgttaacgacctaaggtaccttcgttaggtacgggaaacggggtcccgtaactttaccgacccgtaacttcccgtaacccggaaggggtaacccaaacccgggtaacccgaaaacggtaaacccttcccgtaaaccgttcggttaaacccgttttacggaaacccgttaaaaacgttaaccggtaaaacccccgttaacccccggttacggaaaccccggggtaaccgggaacccccggggtaaccgggggtaaccccgggtaaaccccggggggttaaccccgttttaaaccggttttaaaaccgtttttaaccccgggttaacggggttaaccggggtaacccgggttaaaacccgggttaaaacccggtttttaacccccccggggttaaccggtttaacccccgggttttttaccggggtttttaaaccccttttttaaacccccggg

SEQ ID NO: 38810 - DNA, 591 bp, Homo sapiens
  misc_feature: GYAE6OF02JVHHI.10.79.H02.1.454.CMB.1.raw
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (321)..(321): a, c, t, g, unknown or other
  misc_feature (321)..(321): n is a, c, g, or t
  modified_base (410)..(410): a, c, t, g, unknown or other
  misc_feature (410)..(410): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggagcttggtcaagcctggagggtccctgagactctcctgtncagcctntggattcgcctctggattgacgttcagtgactactacagtcgacctggggtcccnccgaggcctccgaaggggacggggtctgggagttggggttacagtactatttactccgtaggttggtgacttaccgattatacctacgnacgactcgtgtaggaacgggcctattccaccatccacgaggacacgacaacgactcactgtacttnactaaatcgaaccnccgtgaccgacgaccgaacggaccacggtacccgtaattaacttacgtcgtagacgtaacgtaaccttaacccggttcgtaccgttaggttaaccttaccg

SEQ ID NO: 38811 - DNA, 548 bp, Homo sapiens
  misc_feature: GYAE6OF02HVZKZ.10.79.H02.1.454.CMB.1.raw
tcagcatagtagtgcacgaccggtgctcgatttagtgtcacacgaagggaaaggggagctctgggagaagagccccagcccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgaccgtgggtccgccaggctccgagggagggctggagtgggtttcatactattatctagtgtgataccatatactacgcagactctgtgaaggccgatcacatcctaccaggacaacgaccaaagaactcactgtaactttgactaaactgaaccaccctagacgacgaccgaggacacggaccgtaagttaacttacgtgtgacgaacgaactaacccgttcgacccttggttattaccg

SEQ ID NO: 38812 - DNA, 612 bp, Homo sapiens
  misc_feature: GYAE6OF02GHA2O.10.79.H02.1.454.CMB.1.raw
  modified_base (322)..(322): a, c, t, g, unknown or other
  misc_feature (322)..(322): n is a, c, g, or t
  modified_base (346)..(346): a, c, t, g, unknown or other
  misc_feature (346)..(346): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtcccctgagactctccgtgtgcagcctctggattcgcctctggattgacgttcagtgactactacatcgacctcgggccnccaggctccgagggagggctgggngtgggttcagtactatttatccgtaggtggtgaactacccgaattactaacctaccgctacgtaaccttcgtggtacgggaacgggtccgtacgttccaccgtactcccgtaccgaaggaaccaacgaccaacggaacctcctaactcgtacttagacaacgtacgaaccacccgtagcgacgccgaggaccgacggtaccgtaattacttaacgtgtagacgaacggtaacctaacccgttcgtaccgttacggttacttacccg

SEQ ID NO: 38813 - DNA, 605 bp, Homo sapiens
  misc_feature: GYAE6OF02GCLPK.10.79.H02.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccagccaccctgtctgtgtctccgaggggganagagcccaccctctcctgcagggccgtcagaatattgctaccaacttagcctggtatcaacaaaagcctggccaggctcccagacctcctcatctctggtncattccttcggacgggccacgtggtcgtcccagcctaggttcaggtcggcaggttggggtctggaacaggtagttcactctcaccatcgagccggctgctagtctagagtnttttgcttagtttattacgttgtacgagtctaagttattaagtcgtacgtttgggtttttacttcgtaccgtttccggacccgttgggaaaccctaaaggttcggtaactttcgaaggtaaccgtaacgttgggtcggtacgttgaccctaccgtacgttccgttacggtttacccttcgtacctttccccg

SEQ ID NO: 38814 - DNA, 625 bp, Homo sapiens
  misc_feature: GYAE6OF02H4TGQ.10.79.H02.1.454.CMB.1.raw
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (323)..(323): a, c, t, g, unknown or other
  misc_feature (323)..(323): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaaggcctggagggtccctgagactctccngtgcngcctcgtggatcgcctgtggtattgcgttcagtgacctactactatcgacctcgggtcccnccgaggcctaccgaaggggaacggggcgttgggtacggttggggttacagttactagtttactccgttaggtggtagtactacctagttactaacgacgtacagtaccttcgtggtaggaacgggccgtattccactactctacccgaggaccaacgccaaacgactcaactcgtacttagactaaagtcaacctaccgtgacacggaccgacggaccgaccggtacgttacttaacgttcgacggttacgacggtacgtaacccgttacccggttaccgtcgtttacggttacttaacccg

SEQ ID NO: 38815 - DNA, 640 bp, Homo sapiens
  misc_feature: GYAE6OF02ITVQQ.10.79.H02.1.454.CMB.1.raw
  modified_base (298)..(298): a, c, t, g, unknown or other
  misc_feature (298)..(298): n is a, c, g, or t
tcagcatagtagtgcacgaccggtgctcgatttagtgtcacacgaagggaaaggggtctgggagaagagccccagccccagaattcccaggagtttccattcggtgatcagcactgaacacagaggactcaccatggagtttgggctgagcttgggttttccttgttgctattataaaaggtgtccagtgtcaggtgaagcgtggtggagtcgtgggggaggcttggtcaagccgtgggacgggtccctgagacctctcctgtgcagcctcgtgacttccgcctcgtgattgacgttnagtgactactacatcgaccgtcgggcccgccgaggcctccggaaggggacggggcgtgggaggttcgggttacagttactattactcgtaggtgtagataccatactactacgcagtactcgtggtacggaacgggtcctattccaacctctccgtaccgaacgggaccaacgccaaagacctcaactcgtacttgactaaatcgaaacctcccgtggaccgacggacccgaacgaccgaccgggtacttaactaacgtttacgacggtacggaacggtaacgttaacccgttaaccccgttcgtacccgttagggtttaaccctttacccgtagtaacccg

SEQ ID NO: 38816 - DNA, 663 bp, Homo sapiens
  misc_feature: GYAE6OF02IZKJJ.10.79.H02.1.454.CMB.1.raw
  modified_base (270)..(270): a, c, t, g, unknown or other
  misc_feature (270)..(270): n is a, c, g, or t
  modified_base (321)..(321): a, c, t, g, unknown or other
  misc_feature (321)..(321): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatgggagtttgggctgagctgggttttccttgttgctattataaaaggtgtccagtgtcaggtgaagctggtggagtcgtgggggaggcttggcaagccgtggagggtccctgagactctcctgtgcagcctcnggattcgcctctggattgacgttcagtgactactacatgaccgtgggtccnccaggcctccgaggggagggctgggagtgggtttcatactattanctagtggtnatacatatactacgacagactcgtaggtaggaacgggtccgtattaccacctacttccgtacccgtaagggaaccaaaccggaccaaacgtaaccttaccaaccttacgtaccgttttaggaaccttaaaacgttaccgaaacctaccccgtaggaccgaacggacccggaacgggacccgaaccgggtacccggttaacttaacgtttaaccgtcggttacgaaccggaacggtaaacctttaacccccgggttcggttacccgttacgggtttacctttaacccgg

SEQ ID NO: 38817 - DNA, 562 bp, Homo sapiens
  misc_feature: GYAE6OF02J0HLN.10.79.H02.1.454.CMB.1.raw
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtctgggggagcttggtcaagcctggaggtccctgagactctcctgtgcagcctcgtggattcgccttctggattgacgtttcagtcgactactacatgacctgggtccnccgaggctccgagggagggctgggagttgggttcagtactatttancctaggtggtcgataccattacgtactacgcagctctgtgaaggcctattccacatctacgagggacacgaccaagactacactgtacttgactaagtacgaacctaccgtgacgacgccgacggactacggtcgtaactacgttacgtgtagacgtaacgtaaccgtaacccgttcgaccgttggttaccttaccg

SEQ ID NO: 38818 - DNA, 593 bp, Homo sapiens
  misc_feature: GYAE6OF02F053E.10.79.H02.1.454.CMB.1.raw
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaagccgtggagggtccctgagactctcctgtgcagcctctggacttcgcctcgtggattgacgttcagtcgactactacatcgacctgggtccgccaggcctccgaggggagggcgtggaggttgggttcatacatttactcgtagtggtgtataccatatactacgnagactctgngaacggcctatccacatccacgagggaacaccgacaaacgactacacgtcgtactttgactaaagtacgaacctacccgtgacgtaacgacccgagggaccaccgggaccgttaagtaactttccgtaggtcgacggtaacgaacctttaaccccggttcgacccgtttaggttaccttacccgg

SEQ ID NO: 38819 - DNA, 765 bp, Homo sapiens
  misc_feature: GYAE6OF02JPYUO.10.79.H02.1.454.CMB.1.raw
  modified_base (326)..(326): a, c, t, g, unknown or other
  misc_feature (326)..(326): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagccgtggagggtccctgagactctccgtgtgcagcctcgtggacttcgcctcgtggattgacgttcagtgactactacatcgacctgggtcccnccgacggtcctaccggaggggaacggggtcgtacgggaggttggggtttacaagttacgtaattttacgtaccgtaggtcggtactaactaccgtaattaacgtacctacggactacgtacgttaccgtaggtaacggtaacggggacccgtaacgtttacccaacccgttaacgttcccgttacccaaacggtaaaccggtaaacccctaaccctttaaccccaaaaccgtaaaaccttaacctttaaccgtttaccgtttaaacctttcccgtttaacctaaccgttaattaacccggaactaaacccgtaacgtttaaccgtaacgttaacggtaaccggttaccggtaaaccccggtaaccgtaaccgggtaacccctaaccgtttactttaacgttcgggtaaccgtaccggtaccgtaacgtaccgttaacgg

SEQ ID NO: 38820 - DNA, 617 bp, Homo sapiens
  misc_feature: GYAE6OF02FGME4.10.79.H02.1.454.CMB.1.raw
  modified_base (334)..(334): a, c, t, g, unknown or other
  misc_feature (334)..(334): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagttgggctgagctgggttttccttgttgctattataaaggtgtccagtgtcaggtgaagctggtggagtcgtgggggagcttggtcaagcctgggacgggtccctgacgactctcctgtcgcagcctcgtggactttccgccttcgtgggtattggacgtttcagtcgaactactacatggacctggggtccnccgtaggcctccggaaggggacggggtctgggaggttgggtttacattacctatttactccgtaggtggtnactaccattactactacgcaagactngtgaacgggccgtattccacctatccacgagggacaacgccaagactcactgtacttagactaaatcgaacctcccgtgaccggagaccggaacggaccgaccggtaccgttaagtactttacgtcgtacggacgtaacggtaacccgttaacccggttccgtaccgttaggtttaccttacccgg

SEQ ID NO: 38821 - DNA, 677 bp, Homo sapiens
  misc_feature: GYAE6OF02IXWY7.10.79.H02.1.454.CMB.1.raw
  modified_base (283)..(283): a, c, t, g, unknown or other
  misc_feature (283)..(283): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcctgtgctatataaaggtgtccagtgtcaggtgagctggtgagtcgtgggggagtcttggtcaaggccgtggtacgggtccctggagtactctcctgtgcagcctcgtggattccggccttntggattggacgttcagtcgactactacatcggacctgggtccnccaggcctccgagggacgggntggagtggtttcatactagtttatcctagtcggtatacgtacctagttataaccgtacggactagtacctacttaggtaggtaacgggccggttaacttaccgacctacgttaccctaccgaacggggtaccaaacccggacccgaaacgtaaccgtacccaacgtacgtaccgttttacgacgtaaacgtacgtaaacctacccgtcggaccggacgaccggacggaccgaccgggtaccggttaacttaacgtttaccgtacgttacggaacgtaacggtaacttaaccccggttcggtacccggtttacggtttacctttaacccgg

SEQ ID NO: 38822 - DNA, 623 bp, Homo sapiens
  misc_feature: GYAE6OF02F6Q6F.10.79.H02.1.454.CMB.1.raw
  modified_base (577)..(577): a, c, t, g, unknown or other
  misc_feature (577)..(577): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggacgggtccctgagactctcctgtcgcagcctctggattccgcctcgtggattgacgttcagtcgactactacatcgacctcgggtccgccgaggcctccggagggggaacggggctgggaggttggggtttacagttacgtatttacgtccgttaggtcggtagactacctattatacctacgcacggacttcgtaggtacgggaacgggcctaattccaactactcctacccggaagggtaaccaaccgacccgaaagacctccacttcgtactttaggactaaagtcgaacctaccctggaccgacggaccgaggaccgaccggtcgttatattacgngtagacgaagtaccgtaacccgttgacccgtttagttacttacccg

SEQ ID NO: 38823 - DNA, 770 bp, Homo sapiens
  misc_feature: GYAE6OF02I6TXA.10.79.H02.1.454.CMB.1.raw
  modified_base (322)..(322): a, c, t, g, unknown or other
  misc_feature (322)..(322): n is a, c, g, or t
tcagcatagtagtgcacgaccggtgctcgatttagtgtcacacgaagggaaaggggagctctgggagaagagccccagccccagaattcccaggagttccattcggtgatcagcactgaacacagaggactcaccatggagtttgggctgagctgggtttccttgttgctattataaaaggtgtccagtgtcaggtgaagctggtggagtcgtgggggaggcttggtcaagcctgggagggtccctggagactctcctgtgcagcctctggacttcgcctgtggattggacgttcaggtgactactacatgacctgggtccnccagggcctcccggaaggggacggggctgggacggttgggtttacaattacgtaattttcgtccgtaaggtgggttacgaactaacccgtaattacgttaacctaccgggtactaacgggtaccttaccgttagggtacgggtaaacggggccccggttaactttacccgaacccctaagtttccccgtacccggaaacgggggtaaacccaaacccgggtaccccgaaaaggtaacccctaaccgtaacccgttaggttaacccgttttaacggaccgtaaaacgttaccggaaaccctaccccgtaggacccggaacggacccgggtaacgggacccgtaccgggtacccgttaattaacgtttaccggagttaccgggaccgttaacgtaaacccgttaaccccgggttacccgtacccgtttagggtttaaccctttaacccgg

SEQ ID NO: 38824 - DNA, 845 bp, Homo sapiens
  misc_feature: GYAE6OF02GFT3J.10.79.H02.1.454.CMB.1.raw
  modified_base (346)..(346): a, c, t, g, unknown or other
  misc_feature (346)..(346): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttgggtcaagccgtggacgggtccctggagactctcctgtcgcagcctcgtggacttccgccttcgtggatttggaccgtttcaggtcgtaaccttaactacattcgacccgttggggtcccnccgagggtcccgtacccgaaggggggtaacggggccgttaggggacggtttcggggttttaccaagttaacctaagtttttaactacccgtttaagggttcgggttacgtaacttaacccagtttaaccttaaccggtaaccggactaaacgggtaaccttaaggttacgggtaggtaaaccgggggtaccctaacgtttaccgaaacccctaggttaccccgttacccggaaagggggtaaaccccaaacccgggtaccctaaaaacggtaaacccttacccggtaaaccgttaccggttaaaccgttttacggaaaccgtaaaaacgttaccgaaaaccccgttacccgttacgggaaccggtaaccgggacccggtaagggaccccgtaaccgggtacccgttaaattaaccggtttaccgtggtaacggtaccgtaaacggttaaccttaaccccgggttcggtaacccggttttacggtttaacctttacccgg

SEQ ID NO: 38825 - DNA, 562 bp, Homo sapiens
  misc_feature: GYAE6OF02HJY0G.10.79.H02.1.454.CMB.1.raw
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccacgctctcctgcagggccagtcagagtcttagcactaacttgtctggtaccaanagaaacctggaccaggctcccaggcctcctcatctatgatgcatccacggaggccacgtggcatcccagccaggttcagtggcagtgggtctgggacagtctcactcacaccatccaccggcctacgaccctagaactagtttgactagtttactactgtactagtcagtacgtagctacgtctcggccccttcgtccctcgtaccgtttcgggaccggacggaccgtaagggtcggagtaacgtaacgaaaccgtacgtaggtacggtcgtacgacctaaccgtatctacgttccttactaccg

SEQ ID NO: 38826 - DNA, 715 bp, Homo sapiens
  misc_feature: GYAE6OF02JAS8C.10.79.H02.1.454.CMB.1.raw
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttccttgttgctattataaaggtgtccagtgtcaggtgaagctggtggagtcggtgggggagtcgttgggtcaagccgtgggacgggtccctgagacctctcctgtcgcagcctcgtggtacttccgccttcgtgggtatttcggacgtttcgaagttgaaccttactacngtcgacccgtcggggtcccnccgtaggccttaccggaggggaaggggcttaggggagttcggggtttcaattacgtatttactccgttaggtggtagtactaccgtattactacgtacgactagacctcgtggtacgaagggtcctattccgacctactcctaccggaagggacccaaccgaccgaaagtaaccctctaacgttacgttactttacgaaccttaaacgtccgaaaccctacccggtaggacccgaacgggtaccccgggaaggacccgtaccgggtacccgttaagtttaacgttaccgtggttaccgaaccggttaacggtaaccgtttaacccccggttacgtacccggtttaggtttaaccctttaacccgg

SEQ ID NO: 38827 - DNA, 604 bp, Homo sapiens
  misc_feature: GYAE6OF02GAWCB.10.79.H02.1.454.CMB.1.raw
  modified_base (378)..(378): a, c, t, g, unknown or other
  misc_feature (378)..(378): n is a, c, g, or t
  modified_base (580)..(580): a, c, t, g, unknown or other
  misc_feature (580)..(580): n is a, c, g, or t
tcagcatagtagtgcacgaccggtgctcgatttagtgtcacacgaaggggaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgaagctggtggagtcgtgggggaggcttgggtcaagcctgggagggtccctgagactctcctgtgcagcctcgtggtattcgcctctggattgacgttcagtgactactacatcgacctgggtccgccaggcctccgagggagggctggagttgggttcatactatttactctagtggtnactaccagttactacgtaccgactagaccttcgtggtaggaacgggtcctaattccaactatccgtaccgagggaaccaacggacccaaagtacctcacgtcgtacctttgactaaagtcgaacccaccgtgacgacgaccgaggaccgacggtccgtaatacgttcgtaggcgtaccggaacgtaaccgttaccccggttnaccgtttagggttactttacccgg

SEQ ID NO: 38828 - DNA, 634 bp, Homo sapiens
  misc_feature: GYAE6OF02FHL4I.10.79.H02.1.454.CMB.1.raw
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
  modified_base (355)..(355): a, c, t, g, unknown or other
  misc_feature (355)..(355): n is a, c, g, or t
  modified_base (406)..(406): a, c, t, g, unknown or other
  misc_feature (406)..(406): n is a, c, g, or t
tcagcatagtagtgcacgaccggtgctcgatttagtgtcacacgaagggaaaggggagctctgggagaagagcccccagcccccagaattcccaggagtttccattcggtgatcagcactgaacacagaggactcaccatggagttgggctgagctgggttttcctgttgctattataaaggtgtccagtgtcaggtnagctggtggagtcgtgggggagcttggtcaagcctgggacgggtcccngagactcctcccgtagtcggactacgcccgtcgtcggtactttccggcccttactgggacttttcggaccgtttcgaagtcgaaccttactacattgacctgggtaccnccgaggcctccggaaggggacgggtcttggaggttcggtttacacttacgntttacgccgtaggtcgtagacttaacccattaattacccgacgcaacgtactcgtagtcgtaacgggcctattccaccatcctacggacggacaccgacaacgactcgactcgtacttcgactaactagaaccctccgtagaccgagtaccggaagaccgaccggtactaacttactaacgtcgtcgacgaacgtaccttacccggtcaccggttagttaccttaccg

SEQ ID NO: 38829 - DNA, 690 bp, Homo sapiens
  misc_feature: GYAE6OF02IFEGN.10.79.H02.1.454.CMB.1.raw
  modified_base (202)..(202): a, c, t, g, unknown or other
  misc_feature (202)..(202): n is a, c, g, or t
  modified_base (338)..(338): a, c, t, g, unknown or other
  misc_feature (338)..(338): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcacctgtctttgcctccgaggggaaagngccacgctctcctgcaggccagtcagagtcttagcagcaacttcgtgcctaggtaccaacagaaacctggccaggccgtcccgggcttcctctatctagtcggtactatctaggcgacgggaccacgtggcctacncccagtacgtaggttacaggtcggacgagggttcggggtcgacgggactaacggcctttccgaacgtccttaccgaaccctacttaccgacgacgtaacggaccgtttagggaacgttccgttaggtaaacgtttagttttccggagtaggtttactttaacgtttatttaggaccttagaaaccttaagttaaggttcgggttaacgtcccgttacgggttacgggtttacgttttaccgggaaccgtaccggggtaaactagggtcgtacggggtaactaacggtaaccgtaaaccgtaagtccggggttactacgtcgacctaccgtactttacgttccttattacccg

SEQ ID NO: 38830 - DNA, 654 bp, Homo sapiens
  misc_feature: GYAE6OF02JX6ED.10.79.H02.1.454.CMB.1.raw
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
tcagcatagtagtgcacgaccggtgctcgatttagtgtcacacgaagggaaagggggagagctgctcagttaggacccagaggaaccatggaaaccccagcgcagcttctcttcctcctgctactctggcctcccagataccaccggagaaattgtgttgacgcagtctccaggcaccctgtcttgtctccgagggaaagacgccacggctcgtccgtgcagggccagtcagtagtctagcagcaactacgttncctggtaccaactagaaacctggaccaggccgtccgggctccctacngtactacgtaggtacacgttcgtacgcgtacggcctacgtggaaaccngtcccagtacnggtacaggtgcctaggtcgggtacgtcggggactacggtacgtacctacgtaccgtaccaccctaagtaccctaggaccacgtacccgtaggtaccgtacgtacgtaacgtttacgtttcgaactagttcggttaatttagtacgtgaacgtacgtaaagttcgtaggtcgaccgtaccgttaggttcgtttaccgacggtaacggtaccgagttcgtcgtaaagtcgtaaacgtaaccgtaagtccgtaaggcttaaccggtacgaaccgtacgtccgttaggtccttaaccg

SEQ ID NO: 38831 - DNA, 446 bp, Homo sapiens
  misc_feature: GYAE6OF02HKAZQ.10.79.H02.1.454.CMB.1.raw
  modified_base (316)..(316): a, c, t, g, unknown or other
  misc_feature (316)..(316): n is a, c, g, or t
  modified_base (338)..(338): a, c, t, g, unknown or other
  misc_feature (338)..(338): n is a, c, g, or t
  modified_base (349)..(349): a, c, t, g, unknown or other
  misc_feature (349)..(349): n is a, c, g, or t
  modified_base (419)..(419): a, c, t, g, unknown or other
  misc_feature (419)..(419): n is a, c, g, or t
  modified_base (425)..(446): a, c, t, g, unknown or other
  misc_feature (425)..(446): n is a, c, g, or t
tcagcatagtagtgcacgaccggtgctcgatttagtgtcacacgaagggaaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccagggcccatccggtcttcccccnggccgccctgcctccgaggacncacctccgagngcacagcggccctgggctgcctggcaaggctacttcccactactatcgctgagcgggctgggacaggcgnagtagnnnnnnnnnnnnnnnnnnnnnn

SEQ ID NO: 38832 - DNA, 601 bp, Homo sapiens
  misc_feature: GYAE6OF02JB5BN.10.79.H02.1.454.CMB.1.raw
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
tcagcatagtagtgcacgaccggtgctcgatttagtgtcacacgaaggggaaagggggagagctgctcagttaggacccagagggaaccatggaaaccccagcgcagcttctcttcctcctgctactctggctccagataccaccggagaaattgtgttgacgcagtctccaggcaccctgtctttgtcctcgaaggggaagngccacgctctctgcagggccagtcagagtctagcagcaactacgtncctagacaacagaacnggccagcctcccggctcctacntactatcggtacnttcgagcgacgggcctacgtggactacctccgacgacgtcgttcgaggtcggacgtgggttagggtcgtagggacacggtacttacactacgtccactataccagacagtacgtgagtactagtagttcgttancgtagtgttatnttcganagtactaagttagtggtacgtaccgtacgttcgggttactttacggggaccgacgggtaacgaggttcggtagtaacgtaacctaacgggaaaccttacgggttcggacggtcttaccgcttaaccggatttccggtatttcgtacccg

SEQ ID NO: 38833 - DNA, 694 bp, Homo sapiens
  misc_feature: GYAE6OF02I0ZS3.10.79.H02.1.454.CMB.1.raw
tcagcatagtagtgcacgaccggtgctcgatttagtgtcacacgaaggggaaagggtagctctgggagaagagccccagccccagaattcccaggagtttccattcggtgatcagcactgaacacagaggactcaccatggagtttgggctgagcttgggtttccttgttgctattataaaaggtgtccagtgtcaggtgaagctggtggagtcgtgggggagcgttggtcaagtccgtgggacgggtcccctgacgtacctctcctgtgcagcctctggacttccgcctacgtggattgacgttcagtcgaactacgtacagtcgaccgtgggtcccgccgaggccgtccggaaggggagggtcgtgggtaggttgggtttacagtacttactttacgtccgttaggttggtacgtaactaaccgagttaacttaaccgtaccgacgaacgttccgttaccgtagggtacgtaaccggggtcccgtaactttccgaaccctagtccccgtaccggtaacggaactaacccgacgtaaacgtaaccctcgtacgttacgtacgtttagaactaaacgtaccgtaaccacccgtgacccgaacggtcggaacgaccgtccggtaaccgtattaaccgtcgtgacgacggtaacgtaaccgtttaccccgtcggtaccgttaggttaccttaccgg

SEQ ID NO: 38834 - DNA, 710 bp, Homo sapiens
  misc_feature: GYAE6OF02FSSF5.10.79.H02.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaattgtgttgacgcagtctccaggcaccctgtctttgtctccaggggaaangccacgctctcctgcagggccagtcagagtctagcagcaactacgtgcctaggtaccaacacgaaacctcggccaggcctcccgggctccgtcactcgtatggtactatctagcgacgggccacgtggctactcccgagacgtacggttcaacggtcggcgtaggtcgggtcgtaggggacctagtacttccgaacttccgtaccgaaccctactacgacggtacgaacggtacgtaggtacgtacgtaggtaaacgttagttttcgacgtagtttaggttatttaggtttcgtacggtaactaagtttcggtaggttacgtaccgttacgggttacggttacgttttacgggtacccgggtaaggggtaacccgtaagggtacgttacggggtagtaaccgttaaccggtaaaaccggttacggttaaccgggtacgggttaccgttacggaacccctaacccgttaacgttcccggtttaccgttttaccgttacccgtttaccccgg

SEQ ID NO: 38835 - DNA, 700 bp, Homo sapiens
  misc_feature: GYAE6OF02H8MTA.10.79.H02.1.454.CMB.1.raw
  modified_base (362)..(362): a, c, t, g, unknown or other
  misc_feature (362)..(362): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtggggggagtcttgggtcaaggcctgggagggtccctggacgactcgtcctgtgcagtcctacgtggtacttccgccttcgtcgggtatttcggacgttttcaaggttcgaaccttaactaaccagttcggaacccggttcggggtcccncccgagggtcctacccgggaagggggaacggggtctaggggtagttcggggtttacaagttactatttacnccgttaggtggtanattaaccattactactacgacagtactcgtggtacggaacgggccgtaacttccgactacttcctacgaacggtaccaacgacaaacgtacctcaactcgtaactttacgactaaacgtacgaaccacccgtggaccgtaacggacccgaagacccgaccgggtaccgttaagttaaccttacgtggtaccggacgtaacgaacccgtttaaccccggttaccgtacccggtttacggttaacctttaacccg

SEQ ID NO: 38836 - DNA, 674 bp, Homo sapiens
  misc_feature: GYAE6OF02JHP4K.10.79.H02.1.454.CMB.1.raw
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
  modified_base (422)..(422): a, c, t, g, unknown or other
  misc_feature (422)..(422): n is a, c, g, or t
tcagcatagtagtgcacgaccggtgctcgatttagtgtcacacgaagggaaaggggagctctgggagaagagcccagccccagaattcccaggagtttccattcggtgatcagcactgaacacagaggactcaccatggagtttgggctgagctgggttttcctgttgctattataaaggtgtccagtgtcaggtgaagctgggtggagtcgtgggggagcttggtacaagcctgggacgggtccctggagaccgttctccgtgtaggcacgccttctggtacttcgcctcgtggtnttcgacgttcagttcgactactacngtcgaccgtgggtcccncctacggctcccgaaggggacgggtctagggacgttgggttacagtaccgtatttactccggtagtggtagacttacattacnctaacgcgtagacttctggtaggaacgggtccgtattcgaacctagtccgtaaccgtacgggaactacccggaacctaacgaaccgtccaaccgttcgtaaccttttacggaactaaacgttccgaaacccgtacccgttacggaacgggaccgtaccgggaacgggccctaaccggggaccttaacgttaactggttacgcgtacggaacgtaaccggttaacccgtcgaccctttacggtactttaaccg

SEQ ID NO: 38837 - DNA, 743 bp, Homo sapiens
  misc_feature: GYAE6OF02J1IVH.10.79.H02.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagagattggtgttgacacagtctaccagcccaccttgtctttgtcctacgagggaancgccaccctntcctgcagggcctagtccagtacgttggttacggccgaccttacgagcccgttggtaacccaaacgacgaaaaccccgttggacccacgggtccctaccccgacggtcccccctactacgttacctacgttgggttaccacttacccaaccgaaacgggtccgaccgttaccgggacctacgtaccccgtaccgaccggaccggttttaccgtacggtacgggtccgtcgaaacggttttcggggtaaccgtggggaaaccttcggtaaccctttcaccgtttcctaacaccctacgtccctaagtcccgtccggtcgttacggacgttaccgtagacgttagtcgttacgtacgttagtttaacttcgttaacgtactaaacctcggtaccgtaacggtcggttccgggcccggtcccggggttacccttaccgttccggtacccgtagggaacccgtaaggtacgtacacgtacgaaccgtgtcgtagctacgaccgtatacgttctccgtatactacctctacccg

SEQ ID NO: 38838 - DNA, 728 bp, Homo sapiens
  misc_feature: GYAE6OF02HNFG9.10.79.H02.1.454.CMB.1.raw
  modified_base (357)..(357): a, c, t, g, unknown or other
  misc_feature (357)..(357): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttggctgagcttgggttttccttgttgctattataaaggtgtccagtgtcaggtgaagcgtggtggagtcggtgggggaggtcgttggtacgaagccgtgggacgggtccctaggacgtaccttccttcctggtcgccacgtcccttcgtggtacttccgccttcgtggtattcgacgttcagtgactactacatcgaccgtcgggtccaccgngggtcctaccggaagggggtaacgggtcgtaggggtaggttcggggttacaacgttactagtttactccgttaggtcggtagtactaaccgtattaactaccgtacgaccgtaacggtacttcggttagggtaacggggaacggggtaccctaaagtttacccaaccgtacttacccgtacccggaaaggggaaacccctaaaccggaaccaaacgtaactaccgtaacgtgttaacctttacgaactaaaacgtcgaaacccgtcccacggacgaccgtacccgggagacccgaccggtacctaattaaccgtagtggacgtacgaacgtaacccgttacccggttcgtaccgttcggttaacttcccgg

SEQ ID NO: 38839 - DNA, 619 bp, Homo sapiens
  misc_feature: GYAE6OF02HQCL7.10.79.H02.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
tcagcatagtagtgcacgaccggtgctcgatttagtgtcacacgaaggggaaagggggagagctgctcagttaggacccagagggaaccatggaaaccccagcgcagcttctcttcctcctgctactctggctccagataccaccggagaaattgtgttgacgcagtctccaggcaccctgtctttgtcctccgaggggaaangccacgctctcctgcaggccagtcagatatcgcctaaccattgcctggtatacaacaaaacgcctggccaggcctcccagactcctacactcctctggtnctactcgttcggacgggccacgttgggtcgtcccgacgccgtaggttcaggtggactggtgggtctaggaactagtacgtcactctcaccntcgacgcgtctgcngtctagtattnttttgcgttatttagttacttcgtacagtactagttaatagtagttacgtttagggttttacttaccgtaccgttttaccggccggttaacgggaaacttaaacgggttacggttacttacgtaacgtaccggtaacgttggtacggtcgtacgtaccgtacctacgttacgttcggtttaccttacgtacctttccccg

SEQ ID NO: 38840 - DNA, 621 bp, Homo sapiens
  misc_feature: GYAE6OF02I37CV.10.79.H02.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagagattgtgttgacacagtctccagccaccctgtctttgtctccaggggaagngccacctctcctgcagggccagtcagngtgtggcgctacgagcctggtaccaanagaacctgccaggctcccaggccccctnatctatggtgacactccaacgngggcccacgtggccactccccagcccgaggttcacggtggacaggtcgggtctgggacaggacttcactctcaccatcactcacgcctggacgtccgtaggaagtattggtagacgtaagttttacttacgttcgtacaacgtagttaccgtaaccgtacggtcggtcccgggttaccggggtccctaccggtttacccggtacccggttaggaacccggtaaacggtagacgtacgtaaccgaacgtacgtacgggtcgtacgtacggacctaacgacgttcgtccgttacctaccgtacttcccgttaccccgg

SEQ ID NO: 38841 - DNA, 559 bp, Homo sapiens
  misc_feature: GYAE6OF02FGIHK.10.79.H02.1.454.CMB.1.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (392)..(392): a, c, t, g, unknown or other
  misc_feature (392)..(392): n is a, c, g, or t
tcagcatagtagtgcacgaccggtgctcgatttagtgtcacacgaaggggaaagggggagagctgctcagttaggacccagagggaaccatggaaaccccagcgcagcttctcttcctcctgctactctggctcccagacaccaccggagaaattgtgttgacacagtctccagccagctgtctttgctccaggggaaangccacctctcctgcagggccagtcagagtgttcgcacttcggttagggtggtatcaacataaactccggcaggctcccaggctccncattctttgatgctttcaancgggccctggccgtccaggcaggttcagtggcaggtggctgggacagacttcactctcacatcagcagcctagacgcctgtaagtnttttgctagtttacttacgtgtctagcgagtcgtcgccgtacgtttcggcgggtacggtgccgtacgtttcgggacgggtacggaacctaaagtaggaacggtacaacggtacgtggtacggcgtacggacaccgtatcgttacgttcttcacttccgttcccgtac

SEQ ID NO: 38842 - DNA, 548 bp, Homo sapiens
  misc_feature: GYAE6OF02IW1JH.10.79.H02.1.454.CMB.1.raw
  modified_base (324)..(324): a, c, t, g, unknown or other
  misc_feature (324)..(324): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (470)..(470): a, c, t, g, unknown or other
  misc_feature (470)..(470): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggtttccttgttgctattataaaaggtgtccagtgtcaggtgaagctgggtggagtcgtgggggaggcttgggtcaagcctgggagggtccctgagactctcctgtgcagcctctggattcgcctctggattgacgttcagtgaactactacatgaccgtggggtccnccgaggcctccgagggaagggctgggagtgggttcaatactatttactccgtagtggtgataccattatactacgcagactctgngaggccgatcaccatccncgaggacacgaccaagacncactnactttgactaatcgaaccncctgcgagccgagacgacggtcgtaacttatacgtgtagcgtagaaccttacccggtcgtaccgttagttacttaccg

SEQ ID NO: 38843 - DNA, 672 bp, Homo sapiens
  misc_feature: GYAE6OF02FZC04.10.79.H02.1.454.CMB.1.raw
tcagcatagtagtgcacgaccggtgctcgatttagtgtcacacgaagggaaaggggtctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgaactactacatcgaccgtggggtcccgccgaggtcctccgagggggaaggggcgtgggaggttgggtttcagttactatttactccttaggtggtgaactaccaatacttacgtacgctaacgctctgtaggaacggggtccgaattccaccctatccgtacccgaaggggaacccaacggtaccaaagtaaacctccaacttaggtaaccttttcgactaaatcgaaacccacccgtaggacccgaaggaccccggtaaggggaacccaacccggggtaccttaagtacgtttaacctggtacgggtaccaaaggtaaaccgtttaaacccccggttcgtacccgtttagggtttaactttacccgttagtaacccg

SEQ ID NO: 38844 - DNA, 626 bp, Homo sapiens
  misc_feature: GYAE6OF02HPWD9.10.79.H02.1.454.CMB.1.raw
  modified_base (471)..(471): a, c, t, g, unknown or other
  misc_feature (471)..(471): n is a, c, g, or t
  modified_base (519)..(519): a, c, t, g, unknown or other
  misc_feature (519)..(519): n is a, c, g, or t
  modified_base (578)..(578): a, c, t, g, unknown or other
  misc_feature (578)..(578): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggaggcttggtcaagccgtggacgggtccctgacgactctcctgtgcagcctctggacttcgccttctggattggacgttcaggtgaccttactacatcggacccgttggggtcccgccgaggccctaccggaagggggaacggggtctggggtaggttcggggtttacattacgtaatttactccgttaggtggtagtactacctatactacgtagcagtactcgtggtaggaacgggcctattccaaccnttccaccgaagggaccaacggaccaaagaacctccaatcgtaactttnaactaatacgaacctacccgtgacgacgccgaaggaccgacggtcctaataccgttagngtacgacgaacgtaaccgtacccgttcgaccgttttagtaccttaccg

SEQ ID NO: 38845 - DNA, 544 bp, Homo sapiens
  misc_feature: GYAE6OF02F3L6S.10.79.H02.1.454.CMB.1.raw
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (525)..(525): a, c, t, g, unknown or other
  misc_feature (525)..(525): n is a, c, g, or t
tcagcatagtagtgcacgaccggtgctcgatttagtgtcacacgaagggaaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaagcctggagggtccctgagactctcctgtgcagcctctggattcgcctctggattgacgttcagtgactactacatgacctgggtccnccaggctccgagggagggctggagtggttcatacattanctagtggtgataccatatactacgnagactctgtgaagggctattcaccatcctcgagggacacgccaaagactcactgacttgacaaatcgaacctcctgcgagccgaggaccacgggtcctaatacttaccgtggtacgacgaagtaaccttaacccggttcnccgtttaggttattacccg

SEQ ID NO: 38846 - DNA, 551 bp, Homo sapiens
  misc_feature: GYAE6OF02FST5L.10.79.H02.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
  modified_base (380)..(380): a, c, t, g, unknown or other
  misc_feature (380)..(380): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggccaccctgtctttgtctccaggggaaanagccacgctctcctgccagggccagtcagagtcttagcagcaactacgttgcctggtacccaacagaaacctggaccaggcctccccgggctccctnactctagtggtacatctaggcagggccagtggcactcccagactaggtcagnggcaggtggtctgggacagtcttcactcncactatcagcagacgtggacgtctagtaagtatttagctagttagttattattgtcagtactaattagtggtacgttcgtacgttgggttactttcgggaccgtacgggtaaccaggcgtaggagagtacgaacgtacgtcgtcgctcgctaccgtagtcgtcgtcttacg

SEQ ID NO: 38847 - DNA, 743 bp, Homo sapiens
  misc_feature: GYAE6OF02IVO6A.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctaattataaaaggtgtccagtgtcaggtgaagctggtggagtcggtgggggaggcgttggtcaagccgtgggaggtccctgagactctcctgtgcagcctctggtacttccgtcctcgtggtattggtacgtttcgagtcgtactacctacagttcggaccgtcgggtcccgccgacgggtcctaccggaagggggaacggggcgtaggggtacggtttggggtttacaagttaaccttagttttaacgtaccgttaagggttcgggttacgaaacgttaaccctaatttaacgtaacccgtaacggtacctaacgtaccttcgtacgggtaagggaaccggggtcccgttaacttacccaaaccgtacgttcccgtaacccggaaacgggaaacccaaacccggacccgtaaaaacgtaacctcctaacgttacgtaacctttaaggaacctaaagtaccgaaacctcccgtagacgaccggaaccgacggaccgtacggtaccttaagttacttaacggtgtacgagtaacgtaaccgttacccgttcgacgtttacggttacttaccg

SEQ ID NO: 38848 - DNA, 660 bp, Homo sapiens
  misc_feature: GYAE6OF02HD3PY.10.79.H02.1.454.CMB.1.raw
  modified_base (195)..(195): a, c, t, g, unknown or other
  misc_feature (195)..(195): n is a, c, g, or t
  modified_base (357)..(357): a, c, t, g, unknown or other
  misc_feature (357)..(357): n is a, c, g, or t
  modified_base (395)..(395): a, c, t, g, unknown or other
  misc_feature (395)..(395): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaattgtgttgacgcagtctcagcaccctgtcttgtctccaggggaanagccagctctcctgcaggccagtcagatctagcagcaactctgctgtacaacagaaacctggccaggcctacccgggctcctctatctactggtacactctaggcaagggccctagtggccatcccgagacacggtttcagtggctaggtgggtctgggacngtactcacgttcacaccatcagacagtcgtggacgttntaggaattcgtttggacttaggttactttaagtttagttttcggaacgtttaacgtacgtaaagttcgttaacgggtttacggttacctaacccggggtttggtttaccggtttttacggggaaccccgggtaagggggtaccccgtaaacgggttccggttagggtaaaccggtacgttaaccggtaaaaccggtaacgtttcggtacggttacggttacgtacccgtaccggtaagttttccccgttagttcccttaacccgg

SEQ ID NO: 38849 - DNA, 642 bp, Homo sapiens
  misc_feature: GYAE6OF02FP758.10.79.H02.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanagccacgctctcctgcagggccagtcagagtcttagcagcaactcgttgcctggtaccaacagaaacctggccaggcctccccgggctcctcactctagtcggtacactcgtagcgacgggccctacgtcggactactccccgaagaccgtaggttcgaggtcggtacgtaggttcgggtcgtagggactacggtacttcgactctaccacctatcgacgcacgacgtcggtagtcgtagaagttagtttagacgtagttagttaactttagtttcgactacgtactaattaggttaggttacgggtccgtaccggttgggttaccgttttgggaccggtaacggggtacctaacgggtcgtacgggaagtacgtaaccgaaacggtacgtcggtacggtaccgtacgacctaccgttagtaccgttcgttaccttaccg

SEQ ID NO: 38850 - DNA, 811 bp, Homo sapiens
  misc_feature: GYAE6OF02ISZ84.10.79.H02.1.454.CMB.1.raw
  modified_base (186)..(186): a, c, t, g, unknown or other
  misc_feature (186)..(186): n is a, c, g, or t
  modified_base (213)..(213): a, c, t, g, unknown or other
  misc_feature (213)..(213): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccagtggagtttgggctgagcttgggttttccttgttgctattataaaggtntccagtgtacaggtgagcgtgggtggngtcgtggggggagtcgttggtacaaggccgtgggacgggtccctggacgtaccttccgtccgtggttcgcctacgcccttacgtaggtactttcccgccccttacgtaggtattcgggtacgttcgaggttccgtaaccttactacctagtccggtaacccggttggggtcccccaccgtagggtcccctacccggggaagggggtacggggtcctaggggtaacgttcggggttttacaacgttaaccttagtttaccgtaccgtttaaggtgggttacgtaacttaccctaaagttacgtaattaccggactaacggtaccttcggttaggtacgggaaacgggtacccgttacgttaccaacccgttacgtccgtaacccggaggtaaacccgaacggaccctaaaccggtaacctaccgtacgtacgttacttacgaaccttaaactacgaaccgttccccgaggtacccgaaacggcccggtaaggtcccggaacggttaccggtaacgttaacggttacgttacgtacggtaacctaaccggttaaccttacccgggttccgtaccggtttacgttaccgttttaaccccgg

SEQ ID NO: 38851 - DNA, 173 bp, Homo sapiens
  misc_feature: GYAE6OF02FUZ6G.10.79.H02.1.454.CMB.1.raw
  modified_base (172)..(173): a, c, t, g, unknown or other
  misc_feature (172)..(173): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccnn

SEQ ID NO: 38852 - DNA, 666 bp, Homo sapiens
  misc_feature: GYAE6OF02IYFU2.10.79.H02.1.454.CMB.1.raw
tcagcatagtagtgcacgaccggtgctcgatttagtgtcacacgaaagggaaaggggagctctgggagaagacgccccagccccagaattcccaggagtttccattcggtgatcagcactgaacacagaggactcaccatggagtttgggctgagcttgggttttccttgttgctattataaaggtgtccagtgtcaggtgaagctggtggacgtcgtgggggagcttggtcaagccgtgggacggtccctgactctctccgtgtcgcacgccttcgtggacttccgctctggtattggtacttcagtcgactactacgacgtcgaccggtcgggtcccgaccgacgggtcctcggaagggggaacggggtcgtagggtacggttgggtttacagttacttagttactcggtagttcggtagtacttaacacttaacgtacgtaccgtacgtacggtaccgttcgtacggtacggaaccggtctacgtacgaccgtatacccgacgtaacggaaccaccgtaaccaacgtaacctccacgtacgttacgttacgactaagtcgaaccgtaccgcggacgtaccgacggaaccgtacgtaccggtcgttaacttatacgtcggtacgaccgtaagtaactttaccggacgtactttaggtactacgg

SEQ ID NO: 38853 - DNA, 694 bp, Homo sapiens
  misc_feature: GYAE6OF02G9D0K.10.79.H02.1.454.CMB.1.raw
  modified_base (350)..(350): a, c, t, g, unknown or other
  misc_feature (350)..(350): n is a, c, g, or t
  modified_base (524)..(524): a, c, t, g, unknown or other
  misc_feature (524)..(524): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggatttgggctgagcttgggttttccttgttgctattataaaaggtgtccagtgtcaggtgaagctggtggagtcgtgggggaggcttggtcaagccgtgggacgggtccctgagacctcgtccgtgtcgccaggccctcgtggacttcgcctcgtggattggtacgttcagtcactactacgactcgaccgtcggggtccgccgaggtccnccgaggggaagggtctagggagttgggtttacagtactatttactccgttaaggtggtacgataacccgtatattacctaccggctaacgtacttcgtaggtaggaacgggtccgtaacttcaaccgtactacccgtacccgaagggtaaccctaacggacccaaagtaaaccncctaagttacgtaacgttttcgaaactaaagtaccgaaaccctaccgttacggccgtaacggcccgaacgggtacacccggggtacttaaaccgttgtaaccgttgtacggaacctaacggttaacccgtaacccggtttcccgaccgtttaggtttacctttaacccgg

SEQ ID NO: 38854 - DNA, 677 bp, Homo sapiens
  misc_feature: GYAE6OF02HDTU3.10.79.H02.1.454.CMB.1.raw
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (375)..(375): a, c, t, g, unknown or other
  misc_feature (375)..(375): n is a, c, g, or t
tcagcatagtagtgcacgaccggtgctcgatttagtgtcacacgaagggaaagggggagctctgggagaagagccccagccccagaattcccaggagtttccattcggtgatcagcactgaacacagaggactcaccatggagtttgggctgagctgggttttccttgttgctattataaaaggtgtcagtgtcaggtgaagctgggtggagtcgtggggggaggtcttgggtcaagcctgggacgggtccctgacgactctcctgtgcagcctnggtactcgcctntggtatgtcgttcgagtgactactactagtcgaccgtgggtccgcaggctacgaggggagggctggagttggttcagtactatttacncctaggtggtcaacgtacaattacgaactacgctagacctgtacggttaggaaaccgggtccgttaacttaccgaacctatacccgtaccgaagggtacccaaacggaacccaaagaacctcaacgtacgttaactttacggaactaaactcgaaaaccctacccgttaggaccggaaccgtaccgggaaggtacccgaacggggttacccgttaaagttaacccgttaatcggggttaacgaccggtaaagtaacccgttaccccggtttacggtcgttttaacgtttagtttaaccccgg

SEQ ID NO: 38855 - DNA, 841 bp, Homo sapiens
  misc_feature: GYAE6OF02GUQKS.10.79.H02.1.454.CMB.1.raw
tcagcatagtagtgcacgaccggtgctcgatttagtgtcacacgaagggaaaggggagctctgggagaagagccccagcctcagaattcccaggagtttccattcggtgatcagcactgaacacagaggactcacagtggtagtttgggctgagtcgttgggttttccttgttgcttattaagtaaaggtgtaccagtgtcgaggtagaagcgtgggtggtagtcggtgggggaggtcgttgggtacgaacggtccgtgggacgggttccctaggacgtaccttccgtccgttggtcgccgacgtccttcggtggtacttccggccttgtggtacttcggaccgtttcgaagttcgaaccttaacctacgtacgttaccggacccggttcgggtcccccacggtacggcccgtaccgggaagggggaacggggtcggtgggtaggtttcggttacaagttactttagtttaacttcgttaggttggtacgtaaattaaactattaacttaacccgtagacgtactaccgtttcgtaagggtacgggtaaacccgggtaccgtaacttacccgaacccgtacgttacccgtaaccgggaacggtaaaccccgtaaaccgtaacccgtaaacgaaaccttcccgttaaacgttacgttaaaccgtttaacgaaaccgttaaaaccgtaaccggtaacccctaccggaccggtaacgaacccgggaccgtaacgggacccggtaccgggtaaccgtttaattaccggtttacgtacggtaccggtaaccgtaacggtttaacccgttaacccccgggttgttacccggtttacgttttaacccg

SEQ ID NO: 38856 - DNA, 639 bp, Homo sapiens
  misc_feature: GYAE6OF02JRJMR.10.79.H02.1.454.CMB.1.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
tcagcatagtagtgcacgaccggtgctcgatttagtgtcacacgaaggggaaaggggagctctgggagaagagccccagccccagaacttcccaggagtttccattcggtgatcagcactgaacacagaggactcaccatggagtttgggctgagctgggttttccttgttgcttattaagtaaaggtgtccagtgtcaggtgaagctggtggagtcgtggggggagcgttggtcaacggccgtagggacgggtccnggagactctcctgtcgcngcctctggnttccgcttcgtggtattcggacgtttcaagttcgacttactactatcgaaccgttcgggtccacgcggctccggaaggggaacgggcgtgggaggtttcggggttcattacgtaattttacgaccgtttggtacggtagtacgtaacctatagttaccctacgtcaagtaccttcgtaggtaggtaacgggcctagttacccactagtcctacggacgacgaccacaagacctacncgtntacttgactaaagtcaacccactgaccgaagcgacggaccgtacggtacgtacttagttacgcgaacgtggtaacgtaacccgtaccggttactccggttagttacctttaccgg

SEQ ID NO: 38857 - DNA, 710 bp, Homo sapiens
  misc_feature: GYAE6OF02JI5V3.10.79.H02.1.454.CMB.1.raw
  modified_base (67)..(67): a, c, t, g, unknown or other
  misc_feature (67)..(67): n is a, c, g, or t
  modified_base (344)..(344): a, c, t, g, unknown or other
  misc_feature (344)..(344): n is a, c, g, or t
  modified_base (614)..(614): a, c, t, g, unknown or other
  misc_feature (614)..(614): n is a, c, g, or t
tcagcatagtagtgcacgaccggtgctcgatttagtgtcacacgaagggaaaggggagctctggggngaagagccccagccccagaattcccaggagtttccattcggtgatcagcactgaacacagaggactcaccatggagtttgggctgagcgtggttttccttgttgctattataaaggtgtccagtgtcaggtgtaagcgtggtaggagtcgtagggggaggtcttggtcaagccgtagggacggtccctgacgactcctccgtgtgcacgtctcgtggacttcgacctcgtgattgtaccgttcagtcgaccttactactagtcgaccgtcgggtccncgacgggcttaccggaaggggacgggggtccgtagggtacgggttcgggtttactaacggtacgttacggttttaaccgtccggttaaagggttcggtagtaacgttaccccagtttaactaacccgtacgggtacctaacgtcccgttagtcgggttagggaaccggggtcctaacttacccgaccgtacttcccgtaccggtaggtaacccgaacggaccgtaaacgacctacgaccgtagttaccgttagaactaacgtacgaaccncccgtagacccgtagaccgagaccgccggtacttaatacgttccgtagtacgacgtaacgaaccttaccccgtcggactttcgggttaacttccgg

SEQ ID NO: 38858 - DNA, 542 bp, Homo sapiens
  misc_feature: GYAE6OF02IW724.10.79.H02.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (402)..(402): a, c, t, g, unknown or other
  misc_feature (402)..(402): n is a, c, g, or t
  modified_base (431)..(431): a, c, t, g, unknown or other
  misc_feature (431)..(431): n is a, c, g, or t
  modified_base (520)..(520): a, c, t, g, unknown or other
  misc_feature (520)..(520): n is a, c, g, or t
  modified_base (530)..(530): a, c, t, g, unknown or other
  misc_feature (530)..(530): n is a, c, g, or t
  modified_base (539)..(539): a, c, t, g, unknown or other
  misc_feature (539)..(539): n is a, c, g, or t
tcagcatagtagtgcacgaccggtgctcgatttagtgtcacacgaagggaaagggggagagctgctcagttaggacccagagggaaccatcggaaaccccagacgcaggcttctcttcctcctgctactctggctccagataccaccggagaattgtgttgacgcacgtctccaggctaccctgtctttgtctccaggggaacngccacgctctcctgcagggccagtcagctctagcagcaatcgtgcctgtaccanagaaccngccagctccggctcctcatctatggtactgtctagccgagggtcctacgtggcacttccccagtacacggttcaggttggacctaggttcggggtacctggggaccaggttaccttacgacgtctccgactatcgancgacgtactggactcgtagaagtactttnccgtagttgttaatttcgttagtcagtacatagtgtacgtcaccgtggttacttcggcgaggacaggctcggatacgtcgaacgagtgngctgccgtanctctacgtntac

SEQ ID NO: 38859 - DNA, 667 bp, Homo sapiens
  misc_feature: GYAE6OF02I1JZ9.10.79.H02.1.454.CMB.1.raw
  modified_base (378)..(378): a, c, t, g, unknown or other
  misc_feature (378)..(378): n is a, c, g, or t
tcagcatagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcacctgtctttgctccaggggaatgcctagctctcctgcagggtccagtcaggagtcttagcagcaacgtattgccttaggtaaccaacgtagaaacctcgggaccaagggtcctcccgggaccttccgtaccagttcctacgtcggtacactctaggccagggtcccagtcggactactccgaggactcgggttcaaggtcganagggtcggtctacggggacacggttacttcaacgttccgaacaccgacgttgaaccgtcgaacgtacgtacggacgttacgtgtaaacgtgtttacgacgtagttacttaagttattcgtacgtactaagtacgttacggttacgtacttaccggtcggttaacgttttcgggaccgttaacgggaaccgtaggtacgttgggtacgtacgttaacccggaaacggtacgttacggtcgtaaccgtcgaacgttaccggttactacggttccgttacgttcttaaccgg

SEQ ID NO: 38860 - DNA, 694 bp, Homo sapiens
  misc_feature: GYAE6OF02IPTEU.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggagcttggtcaagcctgggagggtccctgacgactctccgtgtcgcagtcctcgtggacttccgccttctggattggacgtttcagtgactactacagtcgaccgtcgggtcccgcgaggcctaccggagggggaacggggtctaggggtaggttggggtttaccaagttactatttactccgttaggtcggttagactaaccattaacttacctacgcagtacttcgtaggtcggaacgggccgtaattacccgacctaacgttccgtaccgaacgggaaccctaaccggacccaaacgtaacctaccaacgttacggtaccgttttagacctaaaactcggaaaccctacccgtggaccggtaaccggacccgaacggaccgaccggtaccgttaagttaacttaccggtgtacggacgtaacggtaaaccttaccccggttacggtacccgtttaggttaacctttacccg

SEQ ID NO: 38861 - DNA, 640 bp, Homo sapiens
  misc_feature: GYAE6OF02F8EDI.10.79.H02.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggccgtcccgggctcctcactctatggtacactctagcgagggccacgtcggcactcccagacgtaggttcaggtcggcgaggttcgggtcgtagggacacggtacttcactcctacctaccactcacgcgagacgtggacgtacgtagtaacgtagtttcggacgtaggttacgtttagtttagtttcggtacggtactaaagttacggttagggttacggttaccgtaccggttggggttaccgttttacgggaccggtaacgggtaaccgaacggtacgtacgggtagtaacgtaacgtaaaaccgtacggttaggtacggtcgtacggaccgtaccgtactcgtacgttccgttactaccg

SEQ ID NO: 38862 - DNA, 610 bp, Homo sapiens
  misc_feature: GYAE6OF02F92DW.10.79.H02.1.454.CMB.1.raw
  modified_base (333)..(333): a, c, t, g, unknown or other
  misc_feature (333)..(333): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttgggtcaagccgtgggacgggtccctgagactctccgtgtcgcagcctcgtggacttcgccttctgggattggacgttcaggtgactactacatgaccgtgggtcccncgaggcctccggaggggaacgggctgggaggttcgggtttcagttacatttactcctagtggtanataccatactactacgnagctctgtgaacgggctagttcacctatcctaccgagggaccaacgccaaagactcacgtagacttacgactaaagtcgaacctaccgtcgaccgacgccgaacggacgaccgggtacgttaattaacgttaccgtgtacgacggaacgtaaccgttaaccccgttgtacccggtttacggttaacctttaccgg

SEQ ID NO: 38863 - DNA, 593 bp, Homo sapiens
  misc_feature: GYAE6OF02I8VE1.10.79.H02.1.454.CMB.1.raw
  modified_base (205)..(205): a, c, t, g, unknown or other
  misc_feature (205)..(205): n is a, c, g, or t
  modified_base (319)..(319): a, c, t, g, unknown or other
  misc_feature (319)..(319): n is a, c, g, or t
  modified_base (380)..(380): a, c, t, g, unknown or other
  misc_feature (380)..(380): n is a, c, g, or t
  modified_base (506)..(506): a, c, t, g, unknown or other
  misc_feature (506)..(506): n is a, c, g, or t
tcagcatagtagtgcacgaccggtgctcgatttagtgtcacacgaaggggaaaggggagctctgggagaagagccccagccccagaattcccaggagtttccattcggtgatcagcactgaacacagaggactcaccatggagttgggctgagctgggtttccttgttgctattataaaggtgtccagtgtcaggtgaagctggnggagtcgtgggggagcttgggtcagcctgggacgggtccctggagactctcctgtgcagcctctggattcgcctctggattgacgttcagtgactactacatgacctgggtccnccaggcctacgaggggaacggggctgggtagtgggttcatactatttactcctaggtggtnataccattactactacgcagctctggtagacgggcctattacacctactcctccgagggacaacgaccaagacctcgactgtacttacgacatacgaacaccctaggcacgggaccgcgggaaccnccggtaccgtaacttaggttacctggtacggtacgacggttaacttaacccccgggttcgtaccgtttacgggtttactttaacccg

SEQ ID NO: 38864 - DNA, 809 bp, Homo sapiens
  misc_feature: GYAE6OF02IGMHN.10.79.H02.1.454.CMB.1.raw
  modified_base (163)..(163): a, c, t, g, unknown or other
  misc_feature (163)..(163): n is a, c, g, or t
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccacggataaattgtgttgacgnagtctccagccacctgtctttgctcgagggaacngccacgctctccgtagcgagggccagtcgaagtntccgttagctaagctaacgttacgttcgaccgttaggtaacccaaacgaacggtaaacctgggaccccgaaggtcccgttccccgggcttcccgtactacttccttaagttcggtaaactagttcctaggaccgtacgggaccctacgtcggacctaccgtacccgaaggtaccgtaggtttacacgggttcggacgtagggttcgggtcgtacgggtactacggtaacctttcgtaaccttccgtaccaaccctagtacccggaagccgtaaagggtaccgttagggtacgttacgttaggtaaaccgtttagtttacgaggtttaacgttgttttaaacgtttcgtttacgggttaactaacggtaattaaaacgttcgggttagggttaccggttaccgtcgggtttaacggggttttaccgtttaccggggaaccgtaacgggggttaacctaacgggttcggtaccgggtaaacgttacgtaaaaccgggtaaaccttaacgggttcggttaacgggacccgtttaccgaacgttaaaccccgtgtttaccgttccgtttacccgtttacccg

SEQ ID NO: 38865 - DNA, 589 bp, Homo sapiens
  misc_feature: GYAE6OF02FGL74.10.79.H02.1.454.CMB.1.raw
  modified_base (393)..(393): a, c, t, g, unknown or other
  misc_feature (393)..(393): n is a, c, g, or t
  modified_base (437)..(437): a, c, t, g, unknown or other
  misc_feature (437)..(437): n is a, c, g, or t
  modified_base (467)..(467): a, c, t, g, unknown or other
  misc_feature (467)..(467): n is a, c, g, or t
  modified_base (486)..(486): a, c, t, g, unknown or other
  misc_feature (486)..(486): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgagctggtggagtctgggggagcttggtcaagccgtggaggtccctgagactctcctgtgcagcctctggtacttccgccttctggatttggacgttcagtcactactacatcgacctcgggtccgccgaggcctccggaagggaggggtcctgggaggttggttcaagttactatttactcctaaggttggtanactacattatactacgcagactgtgtaggacggcattcacatcncgaggacacgacaagactcactagacttanacaaagtcaaccaccgtanaccggtagaccgtaggaccgacgggaccttaagttacttacgtggtaggaccgtaagtaaccgttaaccccggttcgtaccgtttaggtttaacctttacccg

SEQ ID NO: 38866 - DNA, 610 bp, Homo sapiens
  misc_feature: GYAE6OF02G7755.10.79.H02.1.454.CMB.1.raw
  modified_base (358)..(358): a, c, t, g, unknown or other
  misc_feature (358)..(358): n is a, c, g, or t
  modified_base (514)..(514): a, c, t, g, unknown or other
  misc_feature (514)..(514): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtggggggagcttgggtcaagcctgggacgggtccctggagactctcctgtgcagcctctggacttcgccttctggattgacgttcagtgactactacatgacctggggtccgccagggcctccgaaggggacggggcctgggnggttgggtttcagtactattactccgtagtggtgataccattactactacgcagactctggtaggaacgggtcctattaccacctatcctacccgaggggaaccaacccggacaaacgaacctacacttgtactttacgactaaatcgaacctccngccgagccgaggaccgtaccgggaccgttaatacgtttacgtggtacgacggaagtaaccgtaccccggttggtcccgtttaggtttacttacccg

SEQ ID NO: 38867 - DNA, 883 bp, Homo sapiens
  misc_feature: GYAE6OF02FN7Y7.10.79.H02.1.454.CMB.1.raw
  modified_base (264)..(264): a, c, t, g, unknown or other
  misc_feature (264)..(264): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtagctatataaaggtgtcagtgtcaggtgagctggtaggagtcgtggggagcgttggtcaagccgtggacggtccctagacgacttctccgtgtcgacncgtcctcgtggtactttccggccttacgtggtacttcggtacgttccgtagtcgtaactacttacgagttccggtaaccgttcgggcccgtaccgacggtccaccggaaggggacgggtcgttagggtacggtttcggtttacaacttacggttatttaacgtacccggtttagttacggggtacgttaaaccgttaacccggttacttaacccgtaacgtccggtaaggtaccctttggttacggtacgggtaaccgggtaccggttaacttttcccggaaaccgtttatccccggttacggaaaccggggttaacccgaaaccggtttaacccgaaaacggttaaccccgtctaaacccgtttgggttaaacccgtttacgggaaaccttaaaacggtcccgtaaaacccggtacccttaaaggggccccggttaacggacccccgggaaaggggtacccccgttaaccgggtacccggttaaacttttaacccgttaccggggtttaaccgggccggttaaaccccggtttaaagttaaacccccgggttttaccccggttagggtttaacccccgttttccggggtttttaaaaccttccccgggtttaaaccgg

SEQ ID NO: 38868 - DNA, 645 bp, Homo sapiens
  misc_feature: GYAE6OF02GRD9S.10.79.H02.1.454.CMB.1.raw
  modified_base (202)..(202): a, c, t, g, unknown or other
  misc_feature (202)..(202): n is a, c, g, or t
  modified_base (509)..(509): a, c, t, g, unknown or other
  misc_feature (509)..(509): n is a, c, g, or t
tcagcatagtagtgcacgaccggtgctcgatttagtgtcacacgaagggaagggggagagctgctcagttaggacccagagggaaccatggaaaccccagcgcagcttctcttcctcctgctactctggctcccagataccacggagaaattgtgttgacgcagtctccaggcaccctgtctttgtcctaccgaggggaaanagccaacgctctcctgcagggccaggtcagatctagcagcaactacgtgcctggtaccaactagaaacctggccaggcctcccgggcctcctgactctataggtacactcgtagcgagggaccctagtcggacactcccgaagaccgtaaggttcaggtcggactaaggtcgggtactacggggaactacggtacctttcaaccttccgtaaccgaccctatcgaacgtacgaagtaacgtgggtaacttcggaacgtaaagttagttttccgaacgtaggttacttaagtttagttaccgggttanaacgtactaaaggttacgtggttacgtaccgtacgttagggttactttacgggaccgtagggtaaccagtcgtagacgtaacgtacaaagttcgagtacggtctacggacctacgtactcttaccggtcttaaccg

SEQ ID NO: 38869 - DNA, 662 bp, Homo sapiens
  misc_feature: GYAE6OF02FX6LN.10.79.H02.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccacgctctcctgcagggccagtcagtgtcttagcagcaactacgttgcctggtaccaaacgtacgaaacctggaccacggccgtccccgggctcccgtctatcgtacgttcggtaactattccgtagccgaacgggccctaacgttcggcaacgttcccgaaggtactacgggttcaggttcggacgtagggttcgggtctaggggacaggttaccttacacgttcctaccgaacctagtaccgagtacgagacgtaggtacgtacgtagtaagtttagtttacgacgtagtttagttaattagtttcgtactagtactaagttacgtagggtacgtacgtaccgttggttaccgtttcgggacgtaacgggtactaacggtcgtagggtactaaggtaaccgtaaacgtacgtaggttcgacgtacggaccaccgttacgtcgttacgtcttaccg

SEQ ID NO: 38870 - DNA, 534 bp, Homo sapiens
  misc_feature: GYAE6OF02IPEKS.10.79.H02.1.454.CMB.1.raw
  modified_base (325)..(325): a, c, t, g, unknown or other
  misc_feature (325)..(325): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
  modified_base (502)..(502): a, c, t, g, unknown or other
  misc_feature (502)..(502): n is a, c, g, or t
tcagcatagtagtgcacgaccggtgctcgatttagtgtcacacgaaggggaaagggggagctctgggagaagagccccagccccagaattcccaggagtttccattcggtgatcagcactgaacacagaggactcaccatggagtttgggctgagctgggttttccttgttgctattataaaaggtgtcagtgtcaggtgaagctggtggagtcgtgggggagcttggtcaagcctggagggtccctgagactctcctgtgcagcctcgtggtattccgcctctggattgacgttcagtgactactacatcggaccgtgggtccncagtctccgagggtaagggctgggtagtcggttcagtactatttacgtctagtggtagtataaccgataatacgtacgcagactctgtagaggcattcacntctcaggacaacncaagactcacngtacttagactaancgaacacncgcgagccgagacgacgaccgtatactagngtcgagagaactaccgtcggctaggtataccg

SEQ ID NO: 38871 - DNA, 886 bp, Homo sapiens
  misc_feature: GYAE6OF02HSFHU.10.79.H02.1.454.CMB.1.raw
  modified_base (277)..(277): a, c, t, g, unknown or other
  misc_feature (277)..(277): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctggtttccttgttgctattaataaaggtgtcagtgtcaggtgagcgtggtaggagtcggtggggggagtcgttggtacgaacggtccgtgggtacggggtcctagacggtactccgtccgtgngcacgtcctcgtgtactccgtcttacgtggtacttcggtacgtttcgaggttacgtaaccttacttaacacgtccggtaacccgttcgggccccgaacccggtaacggggtccgtaaccggggaacggggggtaacggggtccttagggggtacgggtttgggttaccagttaaaccgtttagtttcgtaccggttagggttgacgttaacgtactaagggttaactaccgaacgaccgtaacggtaccttacgtagggtacggtaaacgggtacctttacggtaacctacgttaaccgtacccgtaccggaaacgggactaaaccccggaacgtaaaccgtttaaacccacctaaacccggtttacgttaacccgttaaggttaaaccgaaaacgttaccccggaaaacccttacccgaacggggttaaaccccgaccggtaaccccggggaaccgggtaaacccgggtcccgggttaaaccccttaagggttaaaccctttcgggtttaacccgaacggggtacccgtaaacggtttaaccccgggtttaaaccccggtttccggggttaaccctttaacgggggttttaacccttttaacccgggg

SEQ ID NO: 38872 - DNA, 720 bp, Homo sapiens
  misc_feature: GYAE6OF02FUKV7.10.79.H02.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
  modified_base (277)..(277): a, c, t, g, unknown or other
  misc_feature (277)..(277): n is a, c, g, or t
  modified_base (343)..(343): a, c, t, g, unknown or other
  misc_feature (343)..(343): n is a, c, g, or t
tcagcatagtagtgcacgaccggtgctcgatttagtgtcacacgaagggaaagggggagagctgctcagttaggacccagagggaaccatggaaaccccagcgcagcttctcttcctcctgctactctggctcccagataccacgganaaattgtgttgacgcagtctccaggcaccctgtctttgctccgaagggaangccacgctctcctgcgaggccagtcagtagtctagcagcactgtgcctgacacagaactgcagcctccggctcctacnttctatggtacatcgtagcgacggcctagtcggctactcccgagtacgtaggtactagtcggacgnggttcgggtcgtcgggaacgtacgtaccttcgtaaccctcgtaccctaaccgtcgttaccgagtccgtaacggtacgtagggttacggtactaagggttaaacgtttaggtttccgaccgttaaggttttacggttaactttacgtttacggttacgaacgttacgtaaacgtttcggtacgggtttaacgggttaccctaacggggttttaaccgggttcgttttaacccggggacccgggtttaaacggggaccgtaacgggttccgtagggtaacgtacgtaaaccggttaaaccggttaacggtacgggtttaccggtacgttacggtaccctaaaccggtttccgttacgtttaccgtttcccgttaacccg

SEQ ID NO: 38873 - DNA, 678 bp, Homo sapiens
  misc_feature: GYAE6OF02H1KUC.10.79.H02.1.454.CMB.1.raw
  modified_base (212)..(212): a, c, t, g, unknown or other
  misc_feature (212)..(212): n is a, c, g, or t
  modified_base (572)..(572): a, c, t, g, unknown or other
  misc_feature (572)..(572): n is a, c, g, or t
  modified_base (594)..(594): a, c, t, g, unknown or other
  misc_feature (594)..(594): n is a, c, g, or t
  modified_base (632)..(632): a, c, t, g, unknown or other
  misc_feature (632)..(632): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtctagtgtcaggtgaagctggtgggngtcgtgggggaggtcgttggtcaacggtccgtgggcgggttccccgtgacgtactctcctgtgccagtccctcgtggattccgccttcgtggtacgtttcgtaccggtttcaacggttcgacccttaacgtactacgtacggttacccggtcgggtcccgccggaacggtcccgtcggaacgggggtaacggggcgtacggggttaggttcggggtttaccaattaccgttatttacgttcgttaggtcggtagtactacattatacctacgacagttactctaggtacgggaacgggccctaagttccacctacgtccgtacgacggtaaccacggacctaagactcgatacgttactnaactaaagtacctaccgacccnggaccgaaggccgacgaccgaccggtactattactgtnacggtacctagtaacccgtaccgtcgttaccggtgtttactttccg

SEQ ID NO: 38874 - DNA, 878 bp, Homo sapiens
  misc_feature: GYAE6OF02IRJEQ.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccataggagtttggctgagtcgttggttttccttgttgcttattaataaaggtgtaccagtgtcgaggtgaagtcgtgggtggagtcggtgggggaggtcgttggtacgtaagccggtgggtacgggtccccgtggacggccttccgttcgtaggtgccgacggtccttcgtcggtacttccgccgttccggttaggtacgtttacggtaccggtttcgtaggttacgtaccttacgtaaactacgtacgtacccgtcgggttccccgaccgtacgggtcctaccgggaggggtaacgggcggttgggtaaggtttcggggttactaacggtacgttaactttaccttaccggtttaggtcggttaacgtacttaacccgtttaagtaaccgttaccgtaaccggtctaaacggtccttacgggtacggttaacggggtaaacccggggtacgttaaaccgtttcccgaaccttaccggttacccgtaaacccggaaccgggtaaaccggaaaacccggacccgttaaaaagtacccgtaccgtaaccgtacggtttaacccgtttacggtaaataaaaccgggtaacctaaccccgtaaccgtccggtaaaccgaacccgggttaccggaacggaccccgtacgggtaaccgttaacgtaacggtttaaccgtcggtacgaaacggtaacgtaacccggtttaaccggtttccggtaaaccgttcgggttttaactaacccgg

SEQ ID NO: 38875 - DNA, 729 bp, Homo sapiens
  misc_feature: GYAE6OF02JH7BO.10.79.H02.1.454.CMB.1.raw
  modified_base (177)..(177): a, c, t, g, unknown or other
  misc_feature (177)..(177): n is a, c, g, or t
tcagcatagtagtgcacgaccggtgctcgatttagtgtcacacgaagggaaaggggagctctgggagaagagcccagccccagaattcccaggagtttccattcggtgatcagcactgaacacagaggactcaccatggagttgggctgagctggtttctgtgctattataaaggtntccagtgtcaggtgaagctgggtggaggtcgtggggggagtcgttggtacaagccgtgggacgggtccctggacgtccgttctccgtgtcgcacgccttcgtgggactttccggccccttgtcggtagttcgtaccggtttcgtagttcggaaccttacgaactatcggtacccgtgggtccgccgacggcctcggaggggaggcctgggaggttcggtttacagttacgtatttacgacgttaggttacggtgtaactacctattaacgttaccgtacggactacgtacttacgttggtacgggaaacgggtctaaattccgaacctagtacccgttaccggaacggggaaacctacccggaacccgtaaagaccgttaacctaccgtagttactttcggaactaaacggtacctaaaccgacccttcggacggtacgacccggtacggaccgtaccgggtacccttaaaggttacttaaacggtccggtaggaccgtaacggtaaacccgttacccggttaccgttcccgtttaaggtttacccttacgg

SEQ ID NO: 38876 - DNA, 700 bp, Homo sapiens
  misc_feature: GYAE6OF02F2R8Z.10.79.H02.1.454.CMB.1.raw
  modified_base (338)..(338): a, c, t, g, unknown or other
  misc_feature (338)..(338): n is a, c, g, or t
  modified_base (463)..(463): a, c, t, g, unknown or other
  misc_feature (463)..(463): n is a, c, g, or t
tcagcatagtagtgcacgaccggtgctcgatttagtgtcacacgaagggaaagggggagctctgggagaagagccccagccccagaattcccaggagtttccattcggtgatcagcactgaacacagaggactcaccatggagtttgggctgagcttgggttttccttgttgctattaataaaggtgtccagtgtcaggtgaagtctggtggagtcgtgggggagtcttggtcaagccgtgggacggtccctgagctcgtcctgtcgcgacgcctcgtggtaccttcggccttcgtggtattgacgttcagtgaactactacatccgacgtcgggccncaggcctacggagggacgggctgggagttcgggttacatactatttactcgttaggtggtacactaaccattactacgtacgactaggtaccttgtggtaaggaacggggtccttatccaacctnttaccgccggaagggaaccaacccgaccaaagtacctacacgttacgttctttacggaaactaaacggttcaacccttacccggtaggaccgtaaccggaccgggaacggaacccgacccggggtaacctttaaccttaaggtttaccggttaggacggtaacccggaaagttaaccccggttttaaaccccccgggttcgttaaccccggttttagggtttaaccctttaaccccg

SEQ ID NO: 38877 - DNA, 691 bp, Homo sapiens
  misc_feature: GYAE6OF02G8AGJ.10.79.H02.1.454.CMB.1.raw
  modified_base (188)..(188): a, c, t, g, unknown or other
  misc_feature (188)..(188): n is a, c, g, or t
  modified_base (626)..(626): a, c, t, g, unknown or other
  misc_feature (626)..(626): n is a, c, g, or t
  modified_base (648)..(648): a, c, t, g, unknown or other
  misc_feature (648)..(648): n is a, c, g, or t
tcagcatagtagtgcacgaccggtgctcgatttagtgtcacacgaagggaaaggggagctctgggagaagagcccccagcccccagaattcccaggagtttccattcggtgatcagcactgaacacagaggactcaccatggagtttgggctgagtctgggttttccttgttgcttattataaaggtntccagtgtcaggtgaagctgggtggagtcgtgggggacgtccgttggtccaagtcctgggacggtccctggacacgtctccgtgtcgcagtccttgtaggtactttccgccttacgtaggacttcggtaccgtttcgaggttcacttaccgtacagttccgaccgttaggggccctaccgagggtccctaccggaggggtaacgggctagggtcggttcggttacacggttaactagttttaccgcccgtttaaggttcggataaccgaacgtttacaacgttaaccgtaccggatacgtaccttcggtaacggtacggacgggtacctaccttacgacctagtacccgtacggaccgggaactaccggacaaacacgtaccgattacgtaatttcgaacctaaagtccaaaccgtcccgaggaccgttacgccgtanacggtccgacttagtacttcgngtcgacgtatacttacccggtcgtactaggtttaccctaacgg

SEQ ID NO: 38878 - DNA, 780 bp, Homo sapiens
  misc_feature: GYAE6OF02FYKVF.10.79.H02.1.454.CMB.1.raw
  modified_base (288)..(288): a, c, t, g, unknown or other
  misc_feature (288)..(288): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagttggctgagcgtggtttctgttgctattataaaggtgtcagtgtcaggtgagcgtggtggaggtcgtaggggaggtcgttggtacaaggccgtagggtacggtcccgtagaacggctccgtaccgtgtcgcggacgtcccgttcgnggtacgtttccgtacccgttcgttacggtacgtttacggtacggtttacgtaggttaccggtaacgttaccgttaacgcgtttacggaccccggttagggttccccgaccggaccggttaccgtaccggggaacgggggtaacggggtccggttagggtacggggttacgggtttaccgtaacgttaaccgtttacgtttacgttaccccgggtttaagggtttcggtaaccggtaacgtaacccggtaattaccgttaccgtaccggtagtaccgtaccgtacgttcgggtaggtaaccgggtaccgtacgttaccgtacgtacgtccgtaccgacgaaccgtacgactaacgtactactaccgtagtaccttacgtacgtaacgtacgtaccgacgtaccgacgaccgaccgacggtaccgaaccggtacgtagttaccgtgtacgtagacgtacgtaccgtacgttccgtacgttaccggtattaccgg

SEQ ID NO: 38879 - DNA, 699 bp, Homo sapiens
  misc_feature: GYAE6OF02GQLMJ.10.79.H02.1.454.CMB.1.raw
  modified_base (185)..(185): a, c, t, g, unknown or other
  misc_feature (185)..(185): n is a, c, g, or t
  modified_base (215)..(215): a, c, t, g, unknown or other
  misc_feature (215)..(215): n is a, c, g, or t
  modified_base (518)..(518): a, c, t, g, unknown or other
  misc_feature (518)..(518): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtntccagtgtcaggtgaagctggtggagtcgngggggagtcttggtcaagccgtggacggtccctgagactctcctgtcgcacgcctcgtggacttccgcctcgtggtattcgacgtttcgagttgaactactacgatcgacccgtgggtcccgccgtaggcctaccggaggggaacgggtctggggtagttcgggttcaattacgtatttacgtccgtaggttggtatactaacgtattaactaccgtacgtctaagtaccctttggtcggtaagggaacgggtcctaacttccacctatcccgtacgaacggggtaaccaaccgtccgaaaanacctcgtaacctgtaacctttgaaccaaacgttccgaaacccgttaccgcggtaaccggacgacccggtaacgacccgtaacccgggtacgttaacttaacgttaaccggtggtacggtaacccgaacggttaaaccctttaccccggttcgttaacccggtttaggttacctttacccgg

SEQ ID NO: 38880 - DNA, 982 bp, Homo sapiens
  misc_feature: GYAE6OF02HLLN3.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctggagcgttgggttttccttgttgcttattaataaaaggtgtccagtgtcaggtgaagctgggtgtacgtcggtagggggaggtcgttgggtacgaacggtcccgttggggaacggggttcccctaggaacgtaccttaccgttccgtggttacggccaacggtccctagtcggtactttccgaccttcgtggtattggaccgtttcaaggtcgtaacttacgtaaccgtagttacgaacccggttcgggtccccgaccgtagggacccttaccgggaaggggggaaccggggtccgttaggggtaacgggtttcgggggtttacctaacggttaaccgttaacgttttaaccgttacccggttaaggttcgggttaacgtaacttaaccccgtaaattaaccgttaaacgtacgaaccgtaacggtaccttcggtttaacgggtaacgggtaaacccggggttcccgtaaactttacccgtaaaccctaaccggtttacccggtaaccccggtaaacgggggaaacccctaaacccgggtaaaccccggtaaaacctaaaccccggttaccgtaacccggtttaacggttaaacccgtttttaaccgaaaaccgttaaaaacggttacccgtaaacccccgttaacccgtacggggtaaacccggtaaacgggaccccgggtaacggggaaaccccgttaccggggaaccccgttttaaagttaaccgtttaccgggtaacgttaccgggaaaccgttaaacccggttaaacccgttaaccccggggtttaccgtttaaccgggtttacggtttaaccctttaaaccccggg

SEQ ID NO: 38881 - DNA, 679 bp, Homo sapiens
  misc_feature: GYAE6OF02JSO4X.10.79.H02.1.454.CMB.1.raw
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
tcagcatagtagtgcacgaccggtgctcgatttagtgtcacacgaagggaaagggggagagctgctcagttaggacccagagggaaccatggaaaccccagcgcagcttctcttctcctgctactctggctcccagactaccaccggagaaattatcgttgacgcagtctccaggcacctgtctttgtctaccgaggggaancgccacgctctctgcgaggccagtcagagttctagcagcaacgtcgtncctagtaccaacacgaacgtcggaccgacggccgtccggcctccgtctactctactcggtactactacgtacgacgtacggaccgtacgtcggtacacctaccgacgacgtacggttacgaggtcggacgtacgggtacggttcggtacgggaacgtacggtaccttccgtaccgtaccttaccaaccggggtactacgacgaccgtacggtactacgggtacgtacgtaggtaagttacgtttagacgtagttcgttaatttacgttacgtacgtacgtataacgttacggttaggtaacggttcgtaccggttagggttaccggtttacggtaccggaagggtaaccgtaaggtcgtacggtacgtacgtaacggtaaactcggtgttacgaacgtcgacgaccgtacgtcgttacgttcttaaccg

SEQ ID NO: 38882 - DNA, 771 bp, Homo sapiens
  misc_feature: GYAE6OF02HSD50.10.79.H02.1.454.CMB.1.raw
  modified_base (155)..(155): a, c, t, g, unknown or other
  misc_feature (155)..(155): n is a, c, g, or t
  modified_base (195)..(195): a, c, t, g, unknown or other
  misc_feature (195)..(195): n is a, c, g, or t
  modified_base (647)..(647): a, c, t, g, unknown or other
  misc_feature (647)..(647): n is a, c, g, or t
tcagcatagtagtgcacgaccggtgctcgatttagtgtcacacgaagggaaaggggagctcgtgggagaagagccccagccccagaattcccaggagtttccattcggtgatcagcactgaacacagaggactcaccatggagtttggctggagnttggttttcctgttgacgtattagtaaaaggtcgtaccgngttgtcgtaggtgaagcgttgggtggagttcggtaggggggtacgtcgttggtacgaacggtcgtgggacggtccctaggagtaccttcgtccttaggcgtcagtccgttacgtggttcctttccgtccctagttggtagtttacgacgttttacgagttaccggtactaccgttactaacgtccgggtaccgtccgggttaccccgacgacggtccgtaaccgggagggaacgggtcgtagggtagttggttaccagtacgttaatttctcgtagttgtacgtactaacctattaacgtaccgtacgtcctaaggtcctcgtacggtagggtaacggtccgacttaacgacttacgttacccggtaccgtaacggggtaacccaaaccggtacctaaacggaaccctacgtaacgttacgtttaacgtagaaaccgtaagtaccgtaaccnccgtacggccgaaacgtaccggaaggtacccggtcgtacccgttaaagttaccgttaccgtagtccggagtaaacctccgtttaaaccccggtgtttacccggtttagtttaacccgtttacgg

SEQ ID NO: 38883 - DNA, 765 bp, Homo sapiens
  misc_feature: GYAE6OF02IA32A.10.79.H02.1.454.CMB.1.raw
tcagcatagtagtgcacgaccggtgctcgatttagtgtcacacgaaagggaaaggggagctctgggagaagagccccagccccagaattcccaggagtttccattcggtgatcagcactgaacacagaggactcaccatggagtttgggctgagcgttgggttttccttgttgctattataaaaggtgtccagtgtcaggtgaagctggtggagtcgtgggggagtcgttggtcgaagccgtggacgggtccctagacgtacttccgtccgtggtgccagtcccttcgtaggtactttccggcccttcgttggtactttacggtaccggttttacgaggtttaacgtaacccttaaccttaaacgacgttaccgggtaaccccgggttcggggtacccccggaccgtacggggtaccttaaccgggaaagggggggaaacgggggttcctagggggttaagggtttcggggtttacaaagttactttaattttacgtcccgtttaaggttcggttagaacctaaccgaaatttactaaccgtacgctaacgtacttcgttaggtacgggaaggtcccgtaattacccgaacctatacccgtaccgaaggaccaaaccgaccaaacgaacctccaacttagtaacctttagaactaaatcgaaacctcgtacgacggtacgacgacgacacggaccttgtaacgttcgtagtcggaacgtacgtaaacccgttcccggttaccggtctttacggtacctttaacgg

SEQ ID NO: 38884 - DNA, 589 bp, Homo sapiens
  misc_feature: GYAE6OF02JZGNE.10.79.H02.1.454.CMB.1.raw
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (455)..(455): a, c, t, g, unknown or other
  misc_feature (455)..(455): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagtcgtgggttttcctgttgctattataaaggtgtccagtgtcgaggtgaagctggtggagtcgtgggggagtcgttggtacgagccgtggacgggtccctggacgactctccgtgtgcatctntggattcncctctggtatgtctnacgtgacctnacattcgaccgtcggccgaccgaggtacctacggagggaacgggtcgtgggtaggtttcggttacaagttaccttattacgttccgttaggtcggtacgacttaaccgactaactaacgtacgctagtactgtgtaggaacggtacncttcgactactcgcctaggaaccacgtcaacgactacagtacgtacttgaatacganaccaccgngtacagccgagtcgacgtcgtaatntcngtcgtagaacgtccgtaccgttcgacgttatcccgttaacg

SEQ ID NO: 38885 - DNA, 760 bp, Homo sapiens
  misc_feature: GYAE6OF02GPD27.10.79.H02.1.454.CMB.1.raw
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
  modified_base (652)..(652): a, c, t, g, unknown or other
  misc_feature (652)..(652): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgttgggttttccttgttgcttattaataaaaggtgtccagtgtcaggtgaagctggtggagtcgtgggggagtcgttggtacaacgtcctgggacgggtccctagacgacctctccgtgtgcacgcctcgtggtacttccgcctcgtaggtattcgtaccgttntaggtgaactactacagtcggaccgtcgggtccnccgacggtccgtccggaaggggtaacgggtcgtagggtacggttcggggtttacaacgttactaagttttaccgtccggtttaaaggtcggttacgtaacgttaaccgtaatttaacgttaaccgtaaccgaccgtaacgtaccctttacggtttagggttaaaccgggaacgggggtacccgttaactttaccgaaacccctagtacccctaaccggaagggtaaaccccaaaccggacctaaaacgtacctaccgaaacgttcgtttaaacgttacaaacgtaaactaaccgaacccnccgtacggaccgaccggaccgagtacccggacgtacctaattaccttaacgttacgtcggtagaaccggtaagtaacccttaccggtcgttacccgttagtttaaccc

SEQ ID NO: 38886 - DNA, 784 bp, Homo sapiens
  misc_feature: GYAE6OF02FZXRH.10.79.H02.1.454.CMB.1.raw
tcagcatagtagtgcacgaccggtgctcgatttagtgtcacacgaagggaaaggggagctctgggagaagagccccagcccccagaattcccaggagtttccattcggtgatcagcactgaacacagaggactcaccatggagtttgggctgagtctgggttttccttgttgctattagtaaaaggtgtccagtgtcagggtgaagcgtgggtgggagttcggtggggggaggtcgtttcgggtacaacggtcccgtgggtacgggttcccctaggtacggtaccttccgtaccctggttcgctacggtcccttcgtcggtactttccggcccgttacgtgggtaacgttcggtaccggtttcaggttacgaaccgttacgtaacctagttaccgacccggttcggggtccccgaccgtacgggacctaccgggaaggggaacggggtcgtaggggtacggttcggtttacaacgttacgttacgtttacgtaccgttaggttacggtagaccttaaccgtatacgttaacgtacgtacgtaacgtcgtttacggtacgtagggtaaccgggtcctacgtacccgaccgtacgttaccgtaccggaacggaacctaaccggaccgaaaccgtaacgtacacgtacgttacgttacgacgtaaactacgtaaccaccgtacgacggtaccggaccggtacggaccgtacggtacccggtaatcgttaacccgtgtacgaagtacgtaacgttacccggtcgttaccggttagttacttaacccgg

SEQ ID NO: 38887 - DNA, 798 bp, Homo sapiens
  misc_feature: GYAE6OF02JZH0O.10.79.H02.1.454.CMB.1.raw
  modified_base (453)..(453): a, c, t, g, unknown or other
  misc_feature (453)..(453): n is a, c, g, or t
  modified_base (693)..(693): a, c, t, g, unknown or other
  misc_feature (693)..(693): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacgagaggactcacctatggtaggtttgggctggacgtcgttcgggtttttccttggttgtctattaagtaaaggttgtacagtcgtcaggtgaagtcgttggtaggtacgtcggtgggggtaggtcgttacggtcgaaggtccggtggggtaacgggtcccgtggaacgtccgttccgtccgtgtcgcgacgttccgtcgtcggttacttccggtcctacgtggtagttccgtacgttcgagttcgtaactacgtacattcggaccgtgggtcccacggtacggtccgtacggacgggggtagggtccgttacggggtggttccggttanaccggtttaatttacgtttacgaccggtttaggttggtaccgtaacgttaaccgtaagtttactaccgtaacggtactacggtaccctggttacggaacgggtaaccgggtctttacctaccgtacctaaagttccccgtaaacgggaccggttaaacaacccccggtaagtaaccgtaccctagttaacccgggttaatcctttaaacggaacccttaaagccgtaaaccgtacccggngaacccggtaggaccgtaagacccgtcgaagttaacctttcggagtgtaacggtccgtaaacccttacgggtacccgtacggtttccttacgttaccgttaccgg

SEQ ID NO: 38888 - DNA, 913 bp, Homo sapiens
  misc_feature: GYAE6OF02GD8CG.10.79.H02.1.454.CMB.1.raw
  modified_base (877)..(877): a, c, t, g, unknown or other
  misc_feature (877)..(877): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagttggctgagtcgtgggttttccttgttgcttattagtaaaggtcgtccagtgtcaggtgaagtcgtggtggacgtcggtgggggaggtcgttggtcaagcccgttaggacgggttaccctgacgtaccttcgtacccgtggtcgcgtacgcccttcgtggtacgttccgccgttcgtaggtcttacgtccgtttcgaagttacgtaaccttacgtaacgacgtccggtaacccggttgggtccccggaaccggacggtacccgttacccgggaaaggggggtacggggtaccggttaggggttagggttttacggggtttaccaaaggttttacttaagttttaccgtacccgtttaggttcggtaaacgtaacttaacccgtagttttaaaccgacgttaaccgacgtaacgttacccgttaccggttaggtaaccggggaaaccgggtaccgtttaaccttaaccggaacccgttaaccgttccgttaaacccgaaacgggggttaaccaaaaccgtaccccgaaaacggttaaccctacggtaccgttaccgttaaaccggtttactaaaacctaaacgttaccgtaaaccccggttcgttaacgggacccgtaaacgggggtaaccgaaacccggggttaccgaaaccggttaacccggtttaacgttaaacgtttaccgggttacgtaacccggtaaacgttaccggttaaaacctacccccgggttttnttaccccggttttaaggtttaacccttttaacccgg

SEQ ID NO: 38889 - DNA, 842 bp, Homo sapiens
  misc_feature: GYAE6OF02IGEHL.10.79.H02.1.454.CMB.1.raw
  modified_base (168)..(168): a, c, t, g, unknown or other
  misc_feature (168)..(168): n is a, c, g, or t
tcagcatagtagtgcacgaccggtgctcgatttagtgtcacacgaagggaaagggagctctgggagaagagccccagccccagaattcccaggagtttccattcggtgatcagcactgaacacgagaggactcaccatggagtttggctgagctggttttcctgttgntattataaagtgtccagtgtcaggtgaagctggtggagtcgtggggaggtcgttggtcaagccgtggacggtcctgacgtactctccgtgtcggacacgtccttgtacggtacttccggcctcgtacggtatttacggtaccgtttcgaaggttcgaactttaaccgtaactagttaaccgaccgtttacgggtccccgtccgtaacgggtcccttaaccggggaagggggtaacggggtcgtaggggtaggtttcggtttacaacgttacgtacgttttactccggttaagttcgggtactaacttaaccctaattaaccggtaccgttaaccggacgtaacgttaccgttcgttacggtaaccgggtaacggggttacccgtaactttaacccgaaaccttaccgttacccgttaaccggaaccggggttaaaaccctaaacccggtacccgttaaaaccgtaacttcccgtaaaccgttacggttaaccttttacgaaacccgttaaagttaaccgaaacccctcccgtaaggacccgaaccggtcccgtaaacggacccgtacgggtaacccgtttaagtaacccgtttacggtcggtaaccgtaacggtaaccgttaacccgttacccgggttacccgttaaccggttacggttttaacccttacccgg

SEQ ID NO: 38890 - DNA, 706 bp, Homo sapiens
  misc_feature: GYAE6OF02HSAMA.10.79.H02.1.454.CMB.1.raw
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (504)..(504): a, c, t, g, unknown or other
  misc_feature (504)..(504): n is a, c, g, or t
tcagcatagtagtgcacgaccggtgctcgatttagtgtcacacgaagggaaaggggagctctgggagaagacgccccagcccccagaattcccaggagtttccattcggtgatcagcactgaacacagaggactcaccatggagtttgggctgagtcgttggttttccttgttgcttattaataaaaggtctaccagtgtcaggtagagtcgtgggtggagtcggtgggggagtcgttggtacgaacgccgtgggacgggtccctagacggtaccttctcctgtgcagccctcgtggtactccgtcctcgtgtagttcgtacttcgagtacgtactactanatcggtaccgtcggccnccgagcctaccggagggaggcgtggtaggttaggttacactacttatttaccgtcgttaacgtggtactaccgtaatataactacctaccgacgaacgtcgttcgttaggacggtaccgggacttacctagtaccctagttacccnccggaaaggaacccaccgaacgtaaacctacctacccgtaatgttaaccgttacgaaactaacgtaaccggaacccacccggttaccgacggaaaccggtccgaaccgggaccgtaccgggtaccttaagttaccgttacgtcggttaacgaccgttaaacgaacccgtttacccggttccgttacgtttaggtaccttcgg

SEQ ID NO: 38891 - DNA, 749 bp, Homo sapiens
  misc_feature: GYAE6OF02FT8QH.10.79.H02.1.454.CMB.1.raw
  modified_base (304)..(304): a, c, t, g, unknown or other
  misc_feature (304)..(304): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagtcgtggtggagtcgtgggggagcgttggtcaagccgtgggacgggtcccctgagactcctcctgtcgcacgcctctggtactttccggcccttcgtaggtnttacggtacgttcgagtcgtaacctactacagtcgacccgtcgggtccgccgtacggtcccgtacggaagggggaacgggcgtagggtaggttggtttacagttactactttactccggttagttggtgtaactaaccattaactacctacgactacggtaccttgtaggtacggtaacgggccttaactttacccgaccttaccttcccgtaacccgggaacgggtaacccaaacccggtaaccctaaacggtaaaccctccgtaaccgttactttaaccgtttcgaaacctaaacgttaccgaaacccttacccgtggtaacccggacgaaccccgggtaaggacccgaccgggtacctttaaaggttaccttacggttcggtacgacgtaaacgttacccgttaaccccggttcccgtacgtttacggtttaaccttacccg

SEQ ID NO: 38892 - DNA, 498 bp, Homo sapiens
  misc_feature: GYAE6OF02INIA5.10.79.H02.1.454.CMB.1.raw
  modified_base (212)..(212): a, c, t, g, unknown or other
  misc_feature (212)..(212): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (464)..(498): a, c, t, g, unknown or other
  misc_feature (464)..(498): n is a, c, g, or t
tcagcatagtagtgcacgaccggtgctcgatttagtgtcacacgaagggaaagggggctggagtgggtttcatacatttatcctagtggtgataccatatactacgcagactctgtgaagggccgattcaccatctccagggacaacgccaagaactcactgactttgcaaatgaacaccctgcgagccggaggacacggccgtatattacngtgcgagaacttaacccggttcgccttaggttaattaccttgaacctacgttggggccagggaaccctggtccacgtctcctcagcctcaccaaggcccagtcgtccttccccnggcnccctgcctcaggcnccacctcgagcgcacgacgccggccgtggcctcgccgtggtaccgaacggcttaaccgtcccactactagtcgctggacggtccggcgtggaccgtaacgcgggactagtagntcgntannnnnnnnnnnnnnnnnnnnnnnnnnnnnnnnnnn

SEQ ID NO: 38893 - DNA, 808 bp, Homo sapiens
  misc_feature: GYAE6OF02HHWFS.10.79.H02.1.454.CMB.1.raw
tcagcatagtagtgcacgaccggtgctcgatttagtgtcacacgaagggaaaggggagctctgggagaagagccccagccccagaattcccaggagtttccattcggtgatcagcactgaacacagaggactcaccatggtagtttggctgagcttgggttttccttgttgcttattaagtaaaaggtgtcctagtgtcaggtgaagcgtggtggagtcggtgggggagtcgttggtacacggtccgtgggacggtacctggacgtcctctcctgtcgcgacgtcctcgtggtacttccggtccttacgtggtacttggtacctttacgaggttcgtaacttactaactacgttaccggtaccggttccgggtaccccgaccgtacgggtacccgtacggggaagggggtaaccggggtccgttagggggtagggtttccgggtttacaacggtttaaccttacgttttaacgtaccggtttaaggttacggtacgtaaccttaaaccgtaattaaccggttaaccgtacgtcctaacggtacccttggttacggtaacgggtaaccggtccgtaacgttacctaccgtacgtaccgtaccggaacggacccaaccgacgaaaccgtaacgtaccacggttactacccgtttacgaactaacgtaccgaacccgtacgtaccggtaccgaccggtaccgggaacgtcccggaacggttaccgttaacgttacgttacggtacggtaccgaacggtaaccgttaaccgttaccccggttacggtaccggttttacgttaccgtttaccg

SEQ ID NO: 38894 - DNA, 791 bp, Homo sapiens
  misc_feature: GYAE6OF02H8U5Z.10.79.H02.1.454.CMB.1.raw
  modified_base (312)..(312): a, c, t, g, unknown or other
  misc_feature (312)..(312): n is a, c, g, or t
tcagcatagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttctgtgctattataaaaggtgtccagtgtcgaggtgaagcgttgggtagggaggttcggtcgggggggtagggtcgtttcgggtacgaaacggcccgttaggggtacgggggttacccctaggacggtaccttccttcctcggtggtaccncgtcccgttacgtcggtatttccggtccttccgtgggtaactttcggtaaccggtttcaaggttgtaccttaaaccgttacagttcggacccgttcgggtccccgacgacggtcccgtaccggaaggggggaaccggggtcgttacgggggaggttttcgggggttacaacgtttaacgttagtttacctcggttagtgggtagtactactaagttactaacgtacgctagtactcgttcggtaggacggccgttaattcaaccctagtcgtaccgaacgggaacctaccggaaccctaaacggtaactcaaccggttgttaaccttaacggactaaacgaccgtaaaccaccggtccgaacggccgaccggaacggaccgtaacggtacccggtattttaacgtcgtacggttacggaaccgtaacggttaacgttcccccggttttaggcccttttagggttaccctttaacccggg

SEQ ID NO: 38895 - DNA, 773 bp, Homo sapiens
  misc_feature: GYAE6OF02IEAUF.10.79.H02.1.454.CMB.1.raw
  modified_base (214)..(214): a, c, t, g, unknown or other
  misc_feature (214)..(214): n is a, c, g, or t
  modified_base (648)..(648): a, c, t, g, unknown or other
  misc_feature (648)..(648): n is a, c, g, or t
tcagcatagtagtgcacgaccggtgctcgatttagtgtcacacgaagggaaaggggagctctgggagaagagccccagccccagaattcccgaggagtttccagttcggtgatcagcactgaacacagacggactcaaccatggagtttggctgagcgttgggttttcctggttgctattaataaaaggtgtccaggtgtcaggtgaagctggnggtacgtggtgggggagtcgttggtacaacgccgtgggacggttccctgagtacctcctcgtgtgcacgtccgtgtcggacttcgtcctcgtagtagttcgtacgttcgacgtagtaaccctaactacgagtacgggtacccgtgggtacccgccgaaggtcccgtaaccggtaaggggaggtcgtaggacggttcggtttaaccagttaactacgttttagacccgtttaggtacggtataaccgtaacgtaatttaacgtaaccgttacgcgtaacgttaccgttacgtaggtacgggtaaacggtaccccggttaattaccgaaaccgtaccgtacccgtaaccgtaaccgggaaacctaaccgaccgtaaagaacccgtactaacgtcgttaaaccgtttagaaacgtaaacgttacgaacccgttaccnccggtacgaacccggtaccgaacgtaccggacccggtacgttaacgttaaacgttacgtacgaacggttaacgaacgtaacccgttaaccggttacccgtacggtttacgtaacccgtttaccgg

SEQ ID NO: 38896 - DNA, 934 bp, Homo sapiens
  misc_feature: GYAE6OF02GD8DC.10.79.H02.1.454.CMB.1.raw
tcagcatagtagtgcacgaccggtgctcgatttagtgtcacacgaaggggaaaggggagctctgggagaagagccccagccccagaattcccaggagtttccattcggtgatcagcactgaacacagaggacctcaccagtggacgtttgggctgagtcgttgggttttccttgttgctagttaataaaaggtgtaccgtagtcgtcaggtagaagtcgtgggtacggtagtcggtgggggacgtcgttggtacgacgccgttagggacgggtccctgacgtaccttcctccgttggtcgacgtacgtccgtacgtcggtaccttaccggcccgtttagtgggtacttacggtaccggttaccgtaggttacgtaacccttacctaacgtagtacccggtaccggttcggggtcccgtaccgtacgggtccgtaccgggaacgggggtacgggtcggttacggggttacggttcgggtttactaaacgttactttaagtttccggtacgtttaggtaccgttacgtaactccgttaacgtaactacggttaaccacggtacgttaaccgtgggtttaacgggaacgggtaaccgggaccctttacttaccgaacccgtttacggaaccccggttaaccggaaacggttaaccccgtaaaccgtaaccccgtaaagggtaacccttccggtaaaccggtttccgtttaacgttaaacccgaaaccgttaaaccggtaaaccgtacccccgtaacgggttccggaaacccgaaccgggttaaccgaaccggtttaacccggcccggttttaaacgtttaaaacgtttcccggtaacggttaaaccggttccggggtaaaacttaaaccccgggttaacccgggttttacccccgtagggttttacccgttttaaccggtaaccccgttttaacggg

SEQ ID NO: 38897 - DNA, 448 bp, Homo sapiens
  misc_feature: GYAE6OF01CMP3Q.44.35.D02.1.454.CMB.1.raw
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
  modified_base (418)..(448): a, c, t, g, unknown or other
  misc_feature (418)..(448): n is a, c, g, or t
tcagacagtatatacacgaccggtgctcgatttagcacacgataggtttgggggttgggcgcatctataacagtggcagcaccaactacaaccccgcctcaacgagtcgagtcaccatgtcactagacaggtccaagaaccagttactccctgaaattgacttctgtgaccgccgcggacacggtccgtatacttattgtgcgagagattcctatcgatacagtagagacggggggcaactggctcgacccctggggccagggaccctggtcaccgtctcctcagcctccaccagggcccatcggtcttcccccnggccaccctcctccaacgagccacctctggggcacagcggcctgggctgccgtggcagggactactccacgctactgctgagcgggctggcaaggcncatagnnnnnnnnnnnnnnnnnnnnnnnnnnnnnnn

SEQ ID NO: 38898 - DNA, 424 bp, Homo sapiens
  misc_feature: GYAE6OF01EDZYM.44.35.D02.1.454.CMB.1.raw
  modified_base (421)..(424): a, c, t, g, unknown or other
  misc_feature (421)..(424): n is a, c, g, or t
tcagacagtatatacacgaccggtgctcgatttagcacacgatagttgggtttggggaaggtcagccataatggaagcgaccagctataacccgtccctcaagagtcgactcaccatctccgtcgacacgtccaagagacagatgtccctgaggttctgacgtctgtgaccgccgcggacgcggctgtgtatttctgtgcgagaggccctggtaccagacgagtggtacctctactactactctctggacgttctggggccaggggaccgcggtcaccgtctcctcagcctccaccaagggcccatcggtcttccccctggcaccctcctccaagagcacctctggggcacagccggcctggctgcctggtcaaggactacttcctatatactgtctgagcgggctggcaaggcgcatagnnnn

SEQ ID NO: 38899 - DNA, 432 bp, Homo sapiens
  misc_feature: GYAE6OF01D1VR8.44.35.D02.1.454.CMB.1.raw
  modified_base (428)..(432): a, c, t, g, unknown or other
  misc_feature (428)..(432): n is a, c, g, or t
tcagacagtatatacacgaccggtgctcgatttagcacacgatagttgggttgggcgcatcgtataacagtggcagctaccaactacaaccccgcctcaagagtcgaggtcaccatgttcactagacaggtccaagaaccgagttcgtccctaggaaattgactttctgtgaccgccgcggacacggccgtatattattgtgcgagagattcctatcgatacagtagagacgagggggcgaactggctcgacccctggggccagggaaccctggtcaccgtctcctcagcctccaccaagggcccatccggtcttccccctggccaccctcctccaagacgcacctcgtggggcacagccggcctgggctgcctggtcaaggactacgttccacgtctactgctgagcgggctggcaaggcgcatagnnnnn

SEQ ID NO: 38900 - DNA, 415 bp, Homo sapiens
  misc_feature: GYAE6OF01ATTVC.44.35.D02.1.454.CMB.1.raw
  modified_base (409)..(415): a, c, t, g, unknown or other
  misc_feature (409)..(415): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaccctggtcaccgtctcctcagcctccaccaaggcccatcggtcttccccctggcaccctcctccaagagcacctctggggcacagcggcctgggctgcctggtcaaggactactcctatatactgtctgagcgggctggcaggcgcatagnnnnnnn

SEQ ID NO: 38901 - DNA, 426 bp, Homo sapiens
  misc_feature: GYAE6OF01ELCTR.44.35.D02.1.454.CMB.1.raw
  modified_base (415)..(426): a, c, t, g, unknown or other
  misc_feature (415)..(426): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcaactggctcgacccctggggccagggaaccctggtcaccgtctcctcagcctccaccaaggcccatcggtcttccccctggcaccctcctccaagacgcacctctggggacacagcggccctgggctgcctggtcaaggactacttcctatatactgtctgagcgggctgggcaaggcgcatagnnnnnnnnnnnn

SEQ ID NO: 38902 - DNA, 602 bp, Homo sapiens
  misc_feature: GYAE6OF01EBSMS.44.35.D02.1.454.CMB.1.raw
  modified_base (196)..(196): a, c, t, g, unknown or other
  misc_feature (196)..(196): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
tcagacagtatatacacgaccggtgctcgatttagcacacgatagttggggttggggcgacatctataacagtggcagcacaactacaaccccgccctaccaagagtccgagtcaccattcgtcactagacaggtccaagaacccagttacctcccgtgaaattgacttctgtgaccgccgcgacacggccgtatnttattgtgcgagagattccatccgatacagtagagacggggggcaactggcctcgacccgtgggccagggaaccctggtcaccgtctacctcacgcctccaccaacgggcccatccggtcttcccccgtaggacacgtccctcctaccgaagcgcgacctcgtcggggcaacgacggtcggccgttagggctcgccgtggtacaaggcttactccgtatactactgtactgacggcggctggcgtaaggccgacagtacgtnancganatgtcatnacntaagtcncgttacaccgntaacctgtaacggtcacccggttaagacgtacggtacgaccgtaggtaacgacggtaacgtacgtacggaacgtcgtacgtacgtactaaccggtcttcgtaacgtcgg

SEQ ID NO: 38903 - DNA, 427 bp, Homo sapiens
  misc_feature: GYAE6OF01E29JB.44.35.D02.1.454.CMB.1.raw
  modified_base (421)..(427): a, c, t, g, unknown or other
  misc_feature (421)..(427): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggccgccctgcctccaggacgcacctctgggggcacagcggccctgggctgcctggtcaaggactacttcctatatactgtctgagcgggctggcaaggcgacatagnnnnnnn

SEQ ID NO: 38904 - DNA, 429 bp, Homo sapiens
  misc_feature: GYAE6OF01D1TGB.44.35.D02.1.454.CMB.1.raw
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (425)..(429): a, c, t, g, unknown or other
  misc_feature (425)..(429): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacggggggcaactggctccgaccccgtggggccagggaaccctggtccaccgtctcctcagcctccaccaagggcccatcggtcttccccctggccaccctcctccaagagccacctcgtgggggcacagcggccctgggctcgccgtggtcaaggactacgttcctaatatactgtctgagcgggntggcaaggcgnatagnnnnn

SEQ ID NO: 38905 - DNA, 494 bp, Homo sapiens
  misc_feature: GYAE6OF01CFG1V.44.35.D02.1.454.CMB.1.raw
  modified_base (200)..(200): a, c, t, g, unknown or other
  misc_feature (200)..(200): n is a, c, g, or t
  modified_base (460)..(494): a, c, t, g, unknown or other
  misc_feature (460)..(494): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaaagaaccagttctccctgaaattgacttctgtgaccgccgcggacacggccgtatattattgtgcgagngattcctatcgatacagtagaggacgggggggcaacgtggactccggaccccgtggggccaggggaaccctgggtccaccggtctcctcagcctccaccgaacgggcccaattccgggtccttccccccgtggccaccccttcctccaaagacgccacctcgtggggacacgagtccggcccgtgggctcgccgtggcaaggactacctttcaatatactgtctggagcgggtactcgggacgaaggccgacgagtaagnnnnnnnnnnnnnnnnnnnnnnnnnnnnnnnnnnn

SEQ ID NO: 38906 - DNA, 460 bp, Homo sapiens
  misc_feature: GYAE6OF01CT8NQ.44.35.D02.1.454.CMB.1.raw
  modified_base (451)..(460): a, c, t, g, unknown or other
  misc_feature (451)..(460): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcacgcctccaccgaacgggcccagtccggtcctttcccccgtggccacccctcctccaacgagccacctcgtggggccacgacgcggccctggcctcgccgtggtcgaaacggtacctaccgttacctattaactacgttgtctggagcgggtctaggcgaaggcgcatagnnnnnnnnnn

SEQ ID NO: 38907 - DNA, 416 bp, Homo sapiens
  misc_feature: GYAE6OF01CMF8T.44.35.D02.1.454.CMB.1.raw
  modified_base (412)..(416): a, c, t, g, unknown or other
  misc_feature (412)..(416): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtcgtggggccaggggaccgcggtcaccgtctcctcagcctccaccaaggcccatcggtctccccctggcaccctcctccaagacgcacctctggggcacagcggcctggctgcctggtcaaggctacttccacgtctactgctgagcggctggcaaggcgcatagnnnnn

SEQ ID NO: 38908 - DNA, 697 bp, Homo sapiens
  misc_feature: GYAE6OF01AYM1H.44.35.D02.1.454.CMB.1.raw
tcagacagtatatacacgaccggtgctcgatttagcacacgatagttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcggggacccccgggcgagggggtcaccatctcttgttctggaaggaagtccaatatcggatcttatcctgtacactggtatcgggactccaggcaccggcccccactcctatctatcgctactaatcacgccgccctcgacggggtcccctcggcccgtattcctcgtcggctcccaagtccgtggacactacgcgtctaccgcggacctactccttggacttctaccgtagttcgtagacggtatacggagggttcctaggtaactttaaccgtacgtcgtcgactacgtacgaacgggttgggtactacgggaaccgtacgggtaccgggtaaccgggtcgggttacgggggttacgggttacccggggaaccgggggtaaccggggtaaccggttaaacgggtttccggggaaacccccgtttcccgggtaacggttacccgaacgggttaccccccggaaagggttccccgtacccggggtcccccccgtttacccggg

SEQ ID NO: 38909 - DNA, 474 bp, Homo sapiens
  misc_feature: GYAE6OF01D64VG.44.35.D02.1.454.CMB.1.raw
  modified_base (461)..(474): a, c, t, g, unknown or other
  misc_feature (461)..(474): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcaactggctcgacccctggggccagggaaccctggtcaccgtctcctcacgcctccaccaacgggcccagtccggtccttcccccgtggccaccctccctccaacgacgccaccgtcgtcgggggcacgacggccggcccgtgggcctcggcccgtgggtaccaaacgggtaccttacctttccgtaattactactgtctggacggcgggctggacgaaggcgcagtagnnnnnnnnnnnnnn

SEQ ID NO: 38910 - DNA, 478 bp, Homo sapiens
  misc_feature: GYAE6OF01AQWH9.44.35.D02.1.454.CMB.1.raw
  modified_base (458)..(478): a, c, t, g, unknown or other
  misc_feature (458)..(478): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggccgtatattattgtgcgagagattcctatcgatacagtagaggacggggggcaactggctcgaccccgtggggccagggaccctggtcaccgtctcctcacgcctccaccgaacgggccccacgtccggtccttcccccgtggcccacccctcctccaagacgccaccgtcgtcggggcacgacggccggcccgtgggcctcgccgtcggtcaacggtactacgttcctatactactcgtcgtgacggcgggtcgtcggacgaacggccgacagtagnnnnnnnnnnnnnnnnnnnnn

SEQ ID NO: 38911 - DNA, 437 bp, Homo sapiens
  misc_feature: GYAE6OF01CA115.44.35.D02.1.454.CMB.1.raw
  modified_base (426)..(437): a, c, t, g, unknown or other
  misc_feature (426)..(437): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtcgtgggggccaggggaccgcggtcaccgtctccctcagcctccaccaagggccccatcggtctttcccccctggccacccctccctccaagacgcacctctgggggcacagcggccctggctgcctggtcaaggactacttcctatatactgtctgagcgggctggcaggcgcagtagnnnnnnnnnnnn

SEQ ID NO: 38912 - DNA, 435 bp, Homo sapiens
  misc_feature: GYAE6OF01BATTE.44.35.D02.1.454.CMB.1.raw
  modified_base (425)..(435): a, c, t, g, unknown or other
  misc_feature (425)..(435): n is a, c, g, or t
tcagacagtatatacacgaccggtgctcgatttagcacacgatagttgggtttggggaagtcagccataatggaagcaccagctataaccccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctgggggccaggggaccgcggtcaccggtctcctcagcctccaccaaggcccatcggtcttccccctggcacccctcctccaagacgcacctctcgggggcacagccggcccgtggctgcctggtcaaaggactacttccacgtctaactgctgagcgggctggacaggcgcatagnnnnnnnnnnn

SEQ ID NO: 38913 - DNA, 506 bp, Homo sapiens
  misc_feature: GYAE6OF01BF329.44.35.D02.1.454.CMB.1.raw
  modified_base (461)..(462): a, c, t, g, unknown or other
  misc_feature (461)..(462): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
  modified_base (473)..(475): a, c, t, g, unknown or other
  misc_feature (473)..(475): n is a, c, g, or t
  modified_base (477)..(506): a, c, t, g, unknown or other
  misc_feature (477)..(506): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtcgtggggccaggggaccgcggtcaccgtctcctcagcctccaccaacgggccccatccggtccttcccccgtcggcccacccctccctccaacgacgccacctcgtcggggcacgagccggccgtggcgtcgccgtggtcgaacggtactaccgttctactacttacgttcgtctggacggccgggtcgtcggaccgaaggcgaccgtagtagnngncngctncgnnngnnnnnnnnnnnnnnnnnnnnnnnnnnnnnn

SEQ ID NO: 38914 - DNA, 515 bp, Homo sapiens
  misc_feature: GYAE6OF01C78GR.44.35.D02.1.454.CMB.1.raw
  modified_base (470)..(470): a, c, t, g, unknown or other
  misc_feature (470)..(470): n is a, c, g, or t
  modified_base (473)..(515): a, c, t, g, unknown or other
  misc_feature (473)..(515): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagtagggcagttcgtcaccaactacttttgaccacgtggggccaggggaacccctggtccaccgtctcctcagcctccaccaacgggcccatccgtcttcccctggccaccctcctccaagacgccacctcgtgggggcacgacgcggcccgtcgggctcgtccgtggtaccgaaacgggtaccttacctttaccgttaatacgttaccgttgttacgttacggaacggtccggggcgttacgggaccgtaaggggcgacctaagtagagcngannnnnnnnnnnnnnnnnnnnnnnnnnnnnnnnnnnnnnnnnnn

SEQ ID NO: 38915 - DNA, 498 bp, Homo sapiens
  misc_feature: GYAE6OF01B4CBY.44.35.D02.1.454.CMB.1.raw
  modified_base (461)..(463): a, c, t, g, unknown or other
  misc_feature (461)..(463): n is a, c, g, or t
  modified_base (465)..(498): a, c, t, g, unknown or other
  misc_feature (465)..(498): n is a, c, g, or t
tcagacagtatatacacgaccggtgctcgatttagcacacgatagttgggtttgggggaagtcagccataatggaagcaccagctataacccgtccctcaagagtcgactcaccatctccgtcgacacgtccaagagacagatgtccctgagtctgacgtctgtgaccgccgcggacgcggctgtgtatttcgtgtgcgagaggccctggtaccagcgagtggtacctctactactactctctggacgtcgtggggccaggggaccgcggtcaccggtctcctcacgcctccaaccaacgggcccatcggtccttcccccgtggccaccctcctccaacgacgccacctcgtgggggcacgacgccggcccgtgggcctgccgtggtacaaggacctaccttccacgttctactcgcttggacggccgggtctcgggacgaacgggccgacaagttcgatnnncnnnnnnnnnnnnnnnnnnnnnnnnnnnnnnnnnn

SEQ ID NO: 38916 - DNA, 503 bp, Homo sapiens
  misc_feature: GYAE6OF01AZ4MJ.44.35.D02.1.454.CMB.1.raw
  modified_base (230)..(230): a, c, t, g, unknown or other
  misc_feature (230)..(230): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (469)..(503): a, c, t, g, unknown or other
  misc_feature (469)..(503): n is a, c, g, or t
tcagacagtatatacacgaccggtgctcgatttagcacacgatagttgggtttggggaagtcagccataatggaagcaccagctataaccccgtccctcaagagtcgactcaccatctccgtcgacacgtccaagagacagatgtccctgagtctgacgtctgtgaccgccgcggacgcggctgtgtatttctgtgcgagacggccctggtaccagcgagtggtaccctntactactactctctggacgtcgtggggccaggggaccgcggtcaccgtctcctcacgcctccaccgacggcccagtccggtccttcccccgtcggcccacccctccctaccaacgacgccacccgtcgtcgggggcacgacgccggcccgtggctcgccgtcggtacgaacggtacctacttcctatacttactgtcgtggacggcgggtcgtggcgaacggcgacgtaanagnagncnnnnnnnnnnnnnnnnnnnnnnnnnnnnnnnnnnn

SEQ ID NO: 38917 - DNA, 541 bp, Homo sapiens
  misc_feature: GYAE6OF01BISLU.44.35.D02.1.454.CMB.1.raw
  modified_base (285)..(285): a, c, t, g, unknown or other
  misc_feature (285)..(285): n is a, c, g, or t
  modified_base (504)..(541): a, c, t, g, unknown or other
  misc_feature (504)..(541): n is a, c, g, or t
tcagacagtatatacacgaccggtgctcgatttagcacacgatagttgggtttggggaagtcagccataatggaagcaccagctataaccccgtccctcaagagtcgactcaccatcctccgtcgacacgtccaaagagacagatgtccctgagtctgacgtctgtgaccgccgcggacgcggctgtgtatttctgtgcgagacggccctggtaccagcgagtggtacctctactactactctctggacgtctggggccaggggaccgcggtcaccgtctcctcncgcctccaccgagggcccatcggtcttcccccgtggccacccctcctccaagacgccacctcgtcgggggcacgacggcccgggtcccgtgggcctcggcccgttgggtaccgaaacgggtaccttacctttccccgtccggattcccggtccggttccgttcgggaacgggtcccgggggtcgttacgggcctaaacgggcgtaccgaaagttaggcnnnnnnnnnnnnnnnnnnnnnnnnnnnnnnnnnnnnnn

SEQ ID NO: 38918 - DNA, 577 bp, Homo sapiens
  misc_feature: GYAE6OF01A4AE5.44.35.D02.1.454.CMB.1.raw
  modified_base (103)..(103): a, c, t, g, unknown or other
  misc_feature (103)..(103): n is a, c, g, or t
  modified_base (140)..(140): a, c, t, g, unknown or other
  misc_feature (140)..(140): n is a, c, g, or t
  modified_base (279)..(279): a, c, t, g, unknown or other
  misc_feature (279)..(279): n is a, c, g, or t
  modified_base (322)..(322): a, c, t, g, unknown or other
  misc_feature (322)..(322): n is a, c, g, or t
  modified_base (354)..(354): a, c, t, g, unknown or other
  misc_feature (354)..(354): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(517): a, c, t, g, unknown or other
  misc_feature (516)..(517): n is a, c, g, or t
  modified_base (519)..(520): a, c, t, g, unknown or other
  misc_feature (519)..(520): n is a, c, g, or t
  modified_base (535)..(535): a, c, t, g, unknown or other
  misc_feature (535)..(535): n is a, c, g, or t
  modified_base (538)..(539): a, c, t, g, unknown or other
  misc_feature (538)..(539): n is a, c, g, or t
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
  modified_base (554)..(555): a, c, t, g, unknown or other
  misc_feature (554)..(555): n is a, c, g, or t
  modified_base (557)..(557): a, c, t, g, unknown or other
  misc_feature (557)..(557): n is a, c, g, or t
  modified_base (571)..(572): a, c, t, g, unknown or other
  misc_feature (571)..(572): n is a, c, g, or t
  modified_base (574)..(574): a, c, t, g, unknown or other
  misc_feature (574)..(574): n is a, c, g, or t
tcagacagtatatacacgaccggtgctcgatttagcacacgataggttgggttggcgcatctataacagtggcagcacccaactaacaaccccgccctcaagngtcgagtcaccatgtcactagacaggtccaagaaccngttctccctgaaattgacttctgtgaccgcgcggacacggccgtatacttattgtgcgtagagattccgatcgatacagttaggaggacggggggcaactggctccgacccgtggggccagggaccctggccaccgtcncctgacgcctcacccgaaggcccaagtccggtccttacccccnggccaccctccgtccgaagcgccaccgtcggnggggacctacgacggtcccggccgtgggcctacggtccgtgggtaccaaagggtccttaacgtttccctaagtaccgtaacttcggttacttacggtacggtccggggtacttcgggacgtaacgggccgacgtaagtagcagancganagtngtacngngnngnngtctgtacgacgcgnganncnctcncgagcgtcnncncacgtcgcgcgcanngngtc

SEQ ID NO: 38919 - DNA, 556 bp, Homo sapiens
  misc_feature: GYAE6OF01C7F70.44.35.D02.1.454.CMB.1.raw
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (521)..(529): a, c, t, g, unknown or other
  misc_feature (521)..(529): n is a, c, g, or t
  modified_base (531)..(556): a, c, t, g, unknown or other
  misc_feature (531)..(556): n is a, c, g, or t
tcagacagtatatacacgaccggtgctcgatttagcacacgatagttgggttgggcgcatctataacagtggcagcaccaactacaacccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcaactggctccgacccctggggccagggaccctggtcaccgtctcctcacgccctccgaccaacgggcccagtcggtccttccccccgtggcccacccctcctccgaacgcgccaccttcggtcgggggccacgacggcccggccccgttgggcctcggccgttcgggtacctaaagggtacccttaaccgtttcccgaaccggtaccttaaccgtcggtcgttcggacgggccggggtctcggggtaccgaacggggccaacgtagtaacggcgtgcgntgnacngcnnnnnnnnngnnnnnnnnnnnnnnnnnnnnnnnnnn

SEQ ID NO: 38920 - DNA, 564 bp, Homo sapiens
  misc_feature: GYAE6OF01CLUMY.44.35.D02.1.454.CMB.1.raw
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (528)..(530): a, c, t, g, unknown or other
  misc_feature (528)..(530): n is a, c, g, or t
  modified_base (532)..(532): a, c, t, g, unknown or other
  misc_feature (532)..(532): n is a, c, g, or t
  modified_base (534)..(564): a, c, t, g, unknown or other
  misc_feature (534)..(564): n is a, c, g, or t
tcagacagtatatacacgaccggtgctcgatttagcacacgatagttgggtttggggaagtcagccataaatggaagcaccagctataaccccgtccctcaagagtcgactcaccatctccgtcgacacgtccaagagacagatgtccctgagtctgacgtctgtgacccgccgcggacgcggctgtgtatttctgtgcgagcggccctggaccaggcgtaggtcgtacctctacctactactctgtcggcgtcgnggggccgagggccgcggtcgaccgtcctcctcnctcctcccaccgaacggccccagtccggttccccttcccccgtcggcccacccctccctccaaacggacaccgacccgttcggtcgggggaccaccgaccggcccgggtccccgtgggccgtacggtcccgtcggtaccgaacggtaaccttaaccgtttactacttaacttccgtagttccgtagggacggtccggggtacgtcggggaaccggtaagggccgaacggtagtaagcgnnncngnnnnnnnnnnnnnnnnnnnnnnnnnnnnnnn

SEQ ID NO: 38921 - DNA, 421 bp, Homo sapiens
  misc_feature: GYAE6OF02HK36K.44.35.D02.1.454.CMB.1.raw
  modified_base (416)..(421): a, c, t, g, unknown or other
  misc_feature (416)..(421): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctggggcacagcggccctgggctgcctggtcaaggactacttcctcgatcgcgtctgagcgggctggcaaggcgcatagnnnnnn

SEQ ID NO: 38922 - DNA, 453 bp, Homo sapiens
  misc_feature: GYAE6OF02IX5LG.44.35.D02.1.454.CMB.1.raw
  modified_base (428)..(453): a, c, t, g, unknown or other
  misc_feature (428)..(453): n is a, c, g, or t
tcagacagtatatacacgaccggtgctcgatttagcacacgataggttggggttgggcgcatctataacagtggcagcacaactacaaccccgccctcaacgagtcgagtcaccatgtcactagacaggtccaagaaccagttactccctgaaattgacttctgtcgaccgccgccggacacggtccgtatacttagttgtgcgagagattcctatcggatacagtagagacgggggggcaactggctcgacccctggggccaggggaaccctggcaccgtctcctcacgcctccaccaagggccccaatcggtcttcccctggccaccctcctccaagacgcacctctgggggccacagcggccctgggctgcctggtcaagggctacttcacgtctactgctgagcgggctggcaaggcgcatagnnnnnnnnnnnnnnnnnnnnnnnnnn

SEQ ID NO: 38923 - DNA, 416 bp, Homo sapiens
  misc_feature: GYAE6OF02ISGSP.44.35.D02.1.454.CMB.1.raw
  modified_base (415)..(416): a, c, t, g, unknown or other
  misc_feature (415)..(416): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctggggcacagcggccctggctgcctggtcaaggactacttccacgtctactgctgagcgggctggcaaggcgcatagnn

SEQ ID NO: 38924 - DNA, 419 bp, Homo sapiens
  misc_feature: GYAE6OF02GFX3N.44.35.D02.1.454.CMB.1.raw
  modified_base (414)..(419): a, c, t, g, unknown or other
  misc_feature (414)..(419): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcaactggctcgacccctggggccagggaccctggtcaccgtctcctcagcctccaccaagggccccatcggtcttccccctggcaccctcctccaagagcacctctgggggcacagcggccctgggctgcctggtcaaggactacttccacgtctactgctgagcgggctggcaaggcgcatagnnnnnn

SEQ ID NO: 38925 - DNA, 421 bp, Homo sapiens
  misc_feature: GYAE6OF02F7RYP.44.35.D02.1.454.CMB.1.raw
  modified_base (417)..(421): a, c, t, g, unknown or other
  misc_feature (417)..(421): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaggagcacctccgagagcacagcggccctgggctgcctggtcaaggactacttcctcgatcgcgtctgagcgggctggcaaggcgcatagnnnnn

SEQ ID NO: 38926 - DNA, 580 bp, Homo sapiens
  misc_feature: GYAE6OF02FWU3G.44.35.D02.1.454.CMB.1.raw
  modified_base (492)..(492): a, c, t, g, unknown or other
  misc_feature (492)..(492): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
  modified_base (531)..(531): a, c, t, g, unknown or other
  misc_feature (531)..(531): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (572)..(572): a, c, t, g, unknown or other
  misc_feature (572)..(572): n is a, c, g, or t
  modified_base (578)..(578): a, c, t, g, unknown or other
  misc_feature (578)..(578): n is a, c, g, or t
tcagacagtatatacacgaccggtgctcgatttagcacacgatagtttggggttttgggggaagttcacgccgattaatggaagcaccacgctactaacccgtccctcaagaggtcgactcgaccagtcctccgttcgacaccgtccaacgagacacgatcgtccctgacgtcgtgaccgtcgtgtgaccgcgcggacgcggctcgtgtatttctggtagcgagaggccctggtacctaggcgtagttaggtacctcgtactactacgtcctactaggaccgtcgtggggaccacggggaaccgcggtcaccgtcttcctcagcctccaccaagggcccactcggtacgtttccccctggcacccttcctccaaggcgccaaccttcgtcgggggacacgacgccggccctcgggcttcggccgtcggtccaagggactacgttccgtacgagtcgcgttactttgagcgggtctggcaaggcgcgataggnagcacgtncgtntcgancgacagtacncgtctacgcacnccagccaaccnctncncncgtctccnctcncgcgcncncgngcgcgngc

SEQ ID NO: 38927 - DNA, 415 bp, Homo sapiens
  misc_feature: GYAE6OF02GVKAQ.44.35.D02.1.454.CMB.1.raw
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (411)..(415): a, c, t, g, unknown or other
  misc_feature (411)..(415): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaccctggtcaccgtctcctcagcctccaccaagggcccatcggtcttccccctggcgccctgctccaggagcacctccgagcgcacagcggcctgggctgtctggtcaaggactacttctatatactgtctgagcgggntggcaggcncatagnnnnn

SEQ ID NO: 38928 - DNA, 571 bp, Homo sapiens
  misc_feature: GYAE6OF02J227K.44.35.D02.1.454.CMB.1.raw
  modified_base (158)..(158): a, c, t, g, unknown or other
  misc_feature (158)..(158): n is a, c, g, or t
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (541)..(541): a, c, t, g, unknown or other
  misc_feature (541)..(541): n is a, c, g, or t
  modified_base (543)..(571): a, c, t, g, unknown or other
  misc_feature (543)..(571): n is a, c, g, or t
tcagacagtatatacacgaccggtgctcgatttagcacacgatagttggtttgggaagtcagccataatggaagcaccagctataacccgtcctcaagagtcgactcaccatctccgtcgacacgtccaagagacagatgtccctgagtctgacgtcngtgaccgccgcggacgcggctgtgtatttcngttcgagnggccctggtacccaggcgagtcggtacctcgtactactactctctggacgtctgggggccaggggaccgcggtcgaccgtctcctcacgccgtccacccaacgggccccacgtccggtccgttcccccctggccctaccctcctccaacgcgccacccgtcgtcgggggccaccgtacgccggtcccctcggggcctcggacccgtgggttccacggggtaccttaccgtttcccgttaacgttacgttaccgtttacgtcgttacggacggtccggggtccgttcggggacccgtaaacggggtcccggtaccgtaacggttacggcgtcncgntggctacgncnnnnnnnnnnnnnnnnnnnnnnnnnnnnn

SEQ ID NO: 38929 - DNA, 419 bp, Homo sapiens
  misc_feature: GYAE6OF02H05PV.44.35.D02.1.454.CMB.1.raw
  modified_base (415)..(419): a, c, t, g, unknown or other
  misc_feature (415)..(419): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcaactggctcgaccccgtggggccagggaccctggtcaccgtctcctcagcctccaccaagggccccatcggtcttccccctggcaccctcctccaagagcacctctgggggcacagcggccctgggctgcctggtcaaggctacttcacgtctactgctgagcgggctggcaaggcgcatagnnnnn

SEQ ID NO: 38930 - DNA, 421 bp, Homo sapiens
  misc_feature: GYAE6OF02GB1HM.44.35.D02.1.454.CMB.1.raw
  modified_base (416)..(421): a, c, t, g, unknown or other
  misc_feature (416)..(421): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcctccaccaagggcccatcggtcttccccctggcacccctcctccaagacgcacctctgggggcacagcggccctgggctgcctggtcaaggctacttcctatatactgtctgagcgggctggcaaggcgcatagnnnnnn

SEQ ID NO: 38931 - DNA, 420 bp, Homo sapiens
  misc_feature: GYAE6OF02FYEUU.44.35.D02.1.454.CMB.1.raw
  modified_base (414)..(420): a, c, t, g, unknown or other
  misc_feature (414)..(420): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccaggggaaccctggtcaccgtctcctcagcctccaccaagggcccatcggtctccccctggcaccctcctccaagagcacctctgggggcacagcggccctgggctgcctggtcaaggctacttcctcgatcgcgtctgagcgggctggcaaggcgcatagnnnnnnn

SEQ ID NO: 38932 - DNA, 433 bp, Homo sapiens
  misc_feature: GYAE6OF02G1H5B.44.35.D02.1.454.CMB.1.raw
  modified_base (422)..(433): a, c, t, g, unknown or other
  misc_feature (422)..(433): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccagtcggtccttccccctggccacccctcctccaagacgcacctcgtggggcacagcggccctggctgcctggtcaaggactacttcctatatactgtctgagcgggctggcaaggcgcagtagnnnnnnnnnnnn

SEQ ID NO: 38933 - DNA, 427 bp, Homo sapiens
  misc_feature: GYAE6OF02I9H7V.44.35.D02.1.454.CMB.1.raw
  modified_base (419)..(427): a, c, t, g, unknown or other
  misc_feature (419)..(427): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaccctggtcaccgtctcctcacgcctccaccaagggccccatccggtcttccccctggccacccgtcctccaagacgcaccgtctgggggcacagcggccctgggctgcctggcaaggctacttcctatatactgtctgagcgggctggcaaggcgcatagnnnnnnnnn

SEQ ID NO: 38934 - DNA, 450 bp, Homo sapiens
  misc_feature: GYAE6OF02IYVUF.44.35.D02.1.454.CMB.1.raw
  modified_base (438)..(450): a, c, t, g, unknown or other
  misc_feature (438)..(450): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacggggggcaactggctcgaccctggggccagggaaccctggtcaccgtctcctcagcctccaccacgggcccatcggtcttcccctggccaccctcctccaagacgccacctcgtcgggggcaccgagcggccccgtgggctcggcccgtggtaccaagggtaccttaccgttccacggtctactgctggacgcgggctgggcaaggcgacatgnnnnnnnnnnnnn

SEQ ID NO: 38935 - DNA, 572 bp, Homo sapiens
  misc_feature: GYAE6OF02GYXE4.44.35.D02.1.454.CMB.1.raw
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
  modified_base (529)..(529): a, c, t, g, unknown or other
  misc_feature (529)..(529): n is a, c, g, or t
  modified_base (533)..(534): a, c, t, g, unknown or other
  misc_feature (533)..(534): n is a, c, g, or t
  modified_base (536)..(539): a, c, t, g, unknown or other
  misc_feature (536)..(539): n is a, c, g, or t
  modified_base (545)..(546): a, c, t, g, unknown or other
  misc_feature (545)..(546): n is a, c, g, or t
  modified_base (548)..(560): a, c, t, g, unknown or other
  misc_feature (548)..(560): n is a, c, g, or t
  modified_base (562)..(564): a, c, t, g, unknown or other
  misc_feature (562)..(564): n is a, c, g, or t
  modified_base (566)..(572): a, c, t, g, unknown or other
  misc_feature (566)..(572): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttcngtgcgagaggccctggtaccagcgagtggtacctntactactactctctggacgtcgtggggccaggggacgcggtcaccgtctcctcacgcctcaccaagggcccagtcggtcctcccccgtgccgccctcgcctccaggacgccacccgtcgtcgggggacctacgacggccggccccgtggggccgtcggtccgttcgggtccgaaacggtaccgttaaccttcccgtaaaccggttcctttaaccgtcgggtccttcgggtaacgggcccggggggtacttcgggggcccgaagggggtcccgtacggtaaaactcgggaccgcgcgaacggngcgnncnnnncgagcnncnnnnnnnnnnnnngnnngnnnnnnn

SEQ ID NO: 38936 - DNA, 312 bp, Homo sapiens
  misc_feature: GYAE6OF02HZHWO.44.35.D02.1.454.CMB.1.raw
  modified_base (300)..(312): a, c, t, g, unknown or other
  misc_feature (300)..(312): n is a, c, g, or t
tcagacagtatatacacgaccggtgctcgatttagcacacgatagttgggttaggggcgcatctataacagtggcagcaccaactacaaccccgccctcaagagtcggacgtcaccatgtcacgtagacaggtccaagaaccagttctccctgaaattgacttctgtgaccgccgcggacacggccgtatattattgtgcgagagattcctatcgatacagtagagacgggggggcaactggctcgacccgtggggccagggaaccctggtcacgtctcctacacgcctaccaccgaacnnnnnnnnnnnnn

SEQ ID NO: 38937 - DNA, 482 bp, Homo sapiens
  misc_feature: GYAE6OF02IVDXO.44.35.D02.1.454.CMB.1.raw
  modified_base (452)..(482): a, c, t, g, unknown or other
  misc_feature (452)..(482): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgcccgcggacacggccgtatattattgtgcgagagattcctatcgatacagtagaggacggggggcgaactggcctcgaccccgtggggcccagggaacccctggtccacccgtctccctcacgcctccaccgaacgggccccatccggttccttccccctggcccaccctccctccgaagacgccacctcgtgggggccacagccggcccgtgggctcgccgtggtcaaggaccttacttcctatactacttcgtctgacggcgggctgggcaaggcgcagtagnnnnnnnnnnnnnnnnnnnnnnnnnnnnnnn

SEQ ID NO: 38938 - DNA, 508 bp, Homo sapiens
  misc_feature: GYAE6OF02JUZA2.44.35.D02.1.454.CMB.1.raw
  modified_base (192)..(192): a, c, t, g, unknown or other
  misc_feature (192)..(192): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (467)..(469): a, c, t, g, unknown or other
  misc_feature (467)..(469): n is a, c, g, or t
  modified_base (471)..(471): a, c, t, g, unknown or other
  misc_feature (471)..(471): n is a, c, g, or t
  modified_base (473)..(474): a, c, t, g, unknown or other
  misc_feature (473)..(474): n is a, c, g, or t
  modified_base (479)..(479): a, c, t, g, unknown or other
  misc_feature (479)..(479): n is a, c, g, or t
  modified_base (481)..(485): a, c, t, g, unknown or other
  misc_feature (481)..(485): n is a, c, g, or t
  modified_base (487)..(508): a, c, t, g, unknown or other
  misc_feature (487)..(508): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttcngtgcgagaggccctggtaccagcgagtcggtacctcgtactacgtactcgtctggaccgtctggggccaggggaccgcggtcaccgtctcctcacgcctccaccaacgggcccatccggtaccttcccccgtcggccacccctccctccgacggacgccaccgtcgtcggggccaccgacgccggccgtcggccgtcgccgtggtccaaggctaccttctatactactgtactgacggcggtacgtcggacgacggtcncgtagtacgtngtcgnnngncnnctgcntnnnnncnnnnnnnnnnnnnnnnnnnnnn

SEQ ID NO: 38939 - DNA, 460 bp, Homo sapiens
  misc_feature: GYAE6OF02HQ74G.44.35.D02.1.454.CMB.1.raw
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (339)..(339): a, c, t, g, unknown or other
  misc_feature (339)..(339): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (430)..(431): a, c, t, g, unknown or other
  misc_feature (430)..(431): n is a, c, g, or t
  modified_base (433)..(460): a, c, t, g, unknown or other
  misc_feature (433)..(460): n is a, c, g, or t
tcagacagtatatacacgaccggtgctcgatttagcacacgatagttggggtttgggggaagtcagccataatggaagcaccagctataacccgtccctcaagagtcgactcaccatctccgtcgacacgtccaagagacagatttccctgagttctgacgtctgtgaccgccgcggacgcggctgtgtatttctgtgcgagagggccctggtaccagcgagtggtacctctactactactctctgacgtcngggccagggaccgcggtcnccgtactcctcacgcctccaccaagggcccatcgtccttccccctggcacccctcctccaagacgccncctccgtgggggcacagcggacccgtgggctcgccnggtcaggactactcctatanactgtctgagcggctcggnaaggcnaatancgncnnannnnnnnnnnnnnnnnnnnnnnnnnnnn

SEQ ID NO: 38940 - DNA, 538 bp, Homo sapiens
  misc_feature: GYAE6OF02JIXKZ.44.35.D02.1.454.CMB.1.raw
  modified_base (503)..(503): a, c, t, g, unknown or other
  misc_feature (503)..(503): n is a, c, g, or t
  modified_base (505)..(507): a, c, t, g, unknown or other
  misc_feature (505)..(507): n is a, c, g, or t
  modified_base (509)..(538): a, c, t, g, unknown or other
  misc_feature (509)..(538): n is a, c, g, or t
tcagacagtatatacacgaccggtgctcgatttagcacacgatagttgggtttgggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctgggtaccagcgagtggtacctctactactactctctggacgtcgtggggccagggggaccgcggtccaccgtctcctcaggcctccaccaacggggcccacgtccggtccttccccccgtcggcccacccctccctacccaacgtaaccggccaccctcgtcggggggccaaccgagcccgggccctcggtacctcggtccctgggtccaaacgggccttaaccgtttcctaattaacgtacttgttcctggtacggcggggtcctcggggtacgaagggccgaccgaagttacgngnnntnnnnnnnnnnnnnnnnnnnnnnnnnnnnnn

SEQ ID NO: 38941 - DNA, 487 bp, Homo sapiens
  misc_feature: GYAE6OF02HZYBN.44.35.D02.1.454.CMB.1.raw
  modified_base (457)..(487): a, c, t, g, unknown or other
  misc_feature (457)..(487): n is a, c, g, or t
tcagacagtatatacacgaccggtgctcgatttagcacacgatagttgggtttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctgggtaccagcgagtggtaccctctactactactctctggacgtcgtgggggccaaggggggaccgcgggtcacccggtcctccctcacgccctccaccaagggccccagtccggtcctttccccccgtggtccacccctcctacccaacgcgccacctccgtgggggcacgaggccggcccgtggctcgcctggacaaggacctactcctatactctgtctggagcgggctggacgtaagggcgcatagcnnnnnnnnnnnnnnnnnnnnnnnnnnnnnnn

SEQ ID NO: 38942 - DNA, 654 bp, Homo sapiens
  misc_feature: GYAE6OF02HQ587.44.35.D02.1.454.CMB.1.raw
  modified_base (161)..(161): a, c, t, g, unknown or other
  misc_feature (161)..(161): n is a, c, g, or t
  modified_base (196)..(196): a, c, t, g, unknown or other
  misc_feature (196)..(196): n is a, c, g, or t
  modified_base (598)..(598): a, c, t, g, unknown or other
  misc_feature (598)..(598): n is a, c, g, or t
  modified_base (608)..(609): a, c, t, g, unknown or other
  misc_feature (608)..(609): n is a, c, g, or t
  modified_base (612)..(613): a, c, t, g, unknown or other
  misc_feature (612)..(613): n is a, c, g, or t
  modified_base (616)..(654): a, c, t, g, unknown or other
  misc_feature (616)..(654): n is a, c, g, or t
tcagacagtatatacacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttttntgtcgaccgccgacgacgccggcgtattattatgngacgagatacttctatcgaactacgtaagtaggacgggggaccggggggaacctagtcggtccgtacccggcccgggtacgggaccggaacgggtacccgtcggtaccctaccgttcctaccctacgaccgtcccctaaccccgaaaccggtaccggacccctacggttccccggtttacccccttcccccggtacggaccccccttacccccgttccctaaccggaacggaccgtaccctaccgtccggggtacgggaccaaccggccggccccggtaccggtcgggtacctcggtaccggtacggtaaaccgtaaccggttacctttaccctttaacgtaagttaacgttacgttccggttacgtacgggaccgggtcggtcgtacggacggtaaccggnaactaagcgnnganngtnnnnnnnnnnnnnnnnnnnnnnnnnnnnnnnnnnnnnnn

SEQ ID NO: 38943 - DNA, 658 bp, Homo sapiens
  misc_feature: GYAE6OF02HAMOZ.44.35.D02.1.454.CMB.1.raw
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (534)..(534): a, c, t, g, unknown or other
  misc_feature (534)..(534): n is a, c, g, or t
  modified_base (554)..(554): a, c, t, g, unknown or other
  misc_feature (554)..(554): n is a, c, g, or t
  modified_base (562)..(562): a, c, t, g, unknown or other
  misc_feature (562)..(562): n is a, c, g, or t
  modified_base (566)..(566): a, c, t, g, unknown or other
  misc_feature (566)..(566): n is a, c, g, or t
  modified_base (572)..(572): a, c, t, g, unknown or other
  misc_feature (572)..(572): n is a, c, g, or t
  modified_base (582)..(582): a, c, t, g, unknown or other
  misc_feature (582)..(582): n is a, c, g, or t
tcagacagtatatacacgaccggtgctcgatttagcacacgatagttgggtttggggaagtcagccataatggaagcaccagctataacccgtcctcaagagtcgactcaccatctccgtcgacacgtccaagagacagatcgtcctgagtctgacgtctgtcgaccgccgcggacgcgctgtgtattcgtgtgacgtagcggtccctggtaccnggacgnggttacggtaccctcttaaccgtacctactccgttcgtacgggtacgttcgacggggaccgaaaggggtacaaagttcggtaccaccgtcttaccgttcacgaccctcccgaacgacgggaccctagttcccggtacctccccgtggccctacccgtcctacaacggctacgacccgttggcgggacacggcgcccggcctggggtcctagggaccgttccgggagtaaccgacgtttccgtttaccgacttttaacggacgtttcgtacggtcgtaaccggggcccgtgtaccgggtaccgaacgggttccncggtacgttaggctccgtgnggcttcgngtcncgtacngcgacttgcncacgtcgacgtcgcgtcgtcgcgtcgtcgctcgtcgtacgtacgtcgtacgtcgtccgtcgtaccgtacgacgtcg

SEQ ID NO: 38944 - DNA, 216 bp, Homo sapiens
  misc_feature: GYAE6OF01AJWK4.26.20.B09.1.454.CMB.1.raw
  modified_base (215)..(216): a, c, t, g, unknown or other
  misc_feature (215)..(216): n is a, c, g, or t
tcagagactatactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccagtatagtctctgagcgggctggcaaggcgcatagnn

SEQ ID NO: 38945 - DNA, 218 bp, Homo sapiens
  misc_feature: GYAE6OF01B53YC.26.20.B09.1.454.CMB.1.raw
  modified_base (216)..(218): a, c, t, g, unknown or other
  misc_feature (216)..(218): n is a, c, g, or t
tcagagactatactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaagggactacttccagtatagtctctgagcgggctggcaaggcgcatagnnn

SEQ ID NO: 38946 - DNA, 250 bp, Homo sapiens
  misc_feature: GYAE6OF02GHLL4.26.20.B09.1.454.CMB.1.raw
  modified_base (221)..(226): a, c, t, g, unknown or other
  misc_feature (221)..(226): n is a, c, g, or t
  modified_base (228)..(250): a, c, t, g, unknown or other
  misc_feature (228)..(250): n is a, c, g, or t
tcagagactatactcacgaccggtgctcgatttagtgtagtgtgaagggtggccagggaaccctggtcaccgtctcctcagcctccaccaagggcccatcggtcttccccctggcaccctcctccaagagcacctctgggggcactagcggcctgggctgccttggtcaaggactacttaccagtatagtctctgagtcgggctgggcaaggcgcgagtgnnnnnngnnnnnnnnnnnnnnnnnnnnnnn

SEQ ID NO: 38947 - DNA, 727 bp, Homo sapiens
  misc_feature: GYAE6OF02F00TB.26.20.B09.1.454.CMB.1.raw
  modified_base (144)..(144): a, c, t, g, unknown or other
  misc_feature (144)..(144): n is a, c, g, or t
  modified_base (183)..(183): a, c, t, g, unknown or other
  misc_feature (183)..(183): n is a, c, g, or t
  modified_base (203)..(203): a, c, t, g, unknown or other
  misc_feature (203)..(203): n is a, c, g, or t
tcagagactatactcacgaccggtgctcgatttagtgtagtgtgaagggtaagggggtaggaatccagacccagtcaggacacagcatggacatgagagtcctcgcgtcagctcctgggctcctgctgctactgttcccaggtnccagtatggtgacatccagatgacccagtcgccatcctnactgtctgcctgtgtagganacgagagtccacatcacgttgtccggcgtagtcagggctagttagcgttaagtttttacgccttggtttcagtcaagtaaccgagggaaactcccccgaagtcccgtaggtactacgtaactcgcgtacgtccgttacctaacgtttaacgaacggtacggtaacgtaccgtaacgtaccgtaacggtttccgaacggccggtacgtaacggttcggtacttaccggtacggggtacctaacgggtacgtttcccggaacttaccgtaacgaaaccgtacttaccgaacggtccgtaacggtacccgttagggaccgtaaccggtacccgtttaggtaacggtttacgtttttacggaccttaaaccgttttacgttaaccgtcgtacccgtagtccggtaaagttaacgttaacgtacgtaactttaacccggacttaccgtaccggttacgggaccgggtacgaacggtcgttaacggaaaccgttaacgacgtacggtcgtaccgtcgacaccgtgtaccg

SEQ ID NO: 38948 - DNA, 232 bp, Homo sapiens
  misc_feature: GYAE6OF02HMWG0.26.20.B09.1.454.CMB.1.raw
  modified_base (214)..(232): a, c, t, g, unknown or other
  misc_feature (214)..(232): n is a, c, g, or t
tcagagactatactcacgaccggtgctcgatttagtgtagtgtgaagggtgccagggaaccctggtcaccgtctcctcagcctccaccaagggcccatcggtcttccccctggcaccctcctcaagagcacctctgggggcacagcggccctgggctgcctggtcaaggactacttccagtatagtctctgagcgggctggcaaggcgcatagnnnnnnnnnnnnnnnnnnn

SEQ ID NO: 38949 - DNA, 711 bp, Homo sapiens
  misc_feature: GYAE6OF01BQRFE.34.16.B05.1.454.CMB.1.raw
  modified_base (171)..(171): a, c, t, g, unknown or other
  misc_feature (171)..(171): n is a, c, g, or t
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
tcagtacacgtgatcacgaccggtgctcgatttagagctcacgtagttgggtttggggggggtctcaggaggcagcgctctcgggacgtctccaccatggcctggctctgctattcctccaccctcctcactcaggggcacgagggtcctgggcccagtctgccctgactnaggctcgcctccgtgtcgtgggtctccgtggacagtcgatcgacctatcctcctgaccgactagtaaccggnagtgtacgttgatgtattataagtctgtcttcgtaggtaaccaacaaccgacccgganaaacgcctacccaaactctatagtattagtgtatgtacaatacgtccgcctagtaggttnttctctatcgtcttctctcgcctactgtcgtcgtcggaccgtaaccgaccggtccctacccgtacgtaacctcgttcctccgtacgccgtacgacggtcgtaggaacgggtacgggtagggttactaagtttaccgttaacgtcggtacccgtaccttacgtaagttaactacgtacgttacctaccgttaccgtacccgtaccttacgtacggttaagtttcgggtttaacggtttacgggttttacccggggaacgggttaaccggtaaacccttaacccgttacccgttaaccccggtttcccgttaccgtaacccggacccggtacccggtaaccgggtcccccgg

SEQ ID NO: 38950 - DNA, 681 bp, Homo sapiens
  misc_feature: GYAE6OF01DTRCQ.34.16.B05.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
tcagtacacgtgatcacgaccggtgctcgatttagagctcacgtagttggggtttggggggggtctcaggaggcagcgctcgtcgggacgtctccaccatcggcctggctctgctattcctcacctctacactcgagggcacgacgggtcctacgggcctagtctcgccctgactcgagctcgcctcgtntcgtggtcctcgcgatgtcatcanctctcgnctacgtacgaacgntagtgacgttgctaagtattacgaacttctcgttctacgtaacgaccaaacaccgaccggaacaacgcctaccaatcatacgttaatatagacttaagactaacgtacgtcccggtcttcggtacgttgttaccacgttcgacgttccttacgctcgtaacctcggttaacgcgttacgtaccgaacttaaaccgcgtacccgtacctaaccggtaactctgttaccgacgtacctacggttaacgcggttagggaacggtacgttacggtaataaccttacgttagaccgacgtactaactaactaccgtaacaacgttacaacgttccgaactccgtacgtacgttagtcgttaaggttacgggtaacggaccgtaaacgtaaaccccggtacgtaccggtttcctaccggttacgtaccgtaccgttacccgagttacccccg

SEQ ID NO: 38951 - DNA, 737 bp, Homo sapiens
  misc_feature: GYAE6OF01DQMWC.34.16.B05.1.454.CMB.1.raw
  modified_base (231)..(231): a, c, t, g, unknown or other
  misc_feature (231)..(231): n is a, c, g, or t
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
  modified_base (734)..(734): a, c, t, g, unknown or other
  misc_feature (734)..(734): n is a, c, g, or t
tcagtacacgtgatcacgaccggtgctcgatttagagctcacgtatttggggtttggggggggtctcaggaggcagcgctctcgggacgtctccaccatggcctgggctctgcttattccctccacccctcctcactcgagggcacgagggtcctcgggcccagtctcgccctgactcaggctgcctcgtgtcgtcggtctccgtggacagtcgatccaaccacttctccngaccacgttacggtaaccggctaggtcgtacgttgagtagtaattacgtaagttctacgtacctacgtacgtaaaccaaaccaaccgacccgtaanaaaccgtacctaaccgtaaacgtactagtagtaatttanagtaacgtacgttaacaaacgttaccgtccggtaccctagtacgttcgttctacagttccgttctttctacgtctacctacgtaagttccgtacgtacgacccgtaaacctaccggtccctaccgtacgtaacctacgtacgtacgtacggtacccgtacgacggtacgtacgggtaaacggacgtaacgggacgtaaccggaaccgtaacccggtctacccggtacccgtccgtacctacccgttcccgttaccgttccccgtaaccttcccgtaacgtacctacccggttaagtacggttaaccgacggtacgggtaccggtaggaaccggtaccggaacggtaccgaggttaacacgggactgcngag

SEQ ID NO: 38952 - DNA, 652 bp, Homo sapiens
  misc_feature: GYAE6OF01DP4O1.34.16.B05.1.454.CMB.1.raw
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (428)..(428): a, c, t, g, unknown or other
  misc_feature (428)..(428): n is a, c, g, or t
  modified_base (453)..(453): a, c, t, g, unknown or other
  misc_feature (453)..(453): n is a, c, g, or t
  modified_base (549)..(549): a, c, t, g, unknown or other
  misc_feature (549)..(549): n is a, c, g, or t
tcagtacacgtgatcacgaccggtgctcgatttagagctcacgtagttggggtttgggggggggtctcaggaggcagcgctctcgggacgtctccaccatggcctgggctctgctattcctcaccctctcactcagggcacacgggtcctgggcccagtctcgccctgactcaggctgcctccgtgtctgggtctcgtggcagtcgatcaccatctcngacctagtcgtaaccggnacgtcgtacgttanagtacgtattataggtcttgtactccgtagtaaccaacaacccgaccggacaacgtacctacccaaactctagttactaacgtttagagtacgtacttaacgaataaccggtccgccttaaacggggtcttcttttacgccgttagttccgtctttccgtcggtacctccttaaccgngtttcgtccgtacggaccgaaaccnccggttccctaccgtcgtactactcctacggtacgtactacccgtggacgtcggaacggtggtacggtaagtcgttaacgtactcggtctaacgtntaactcgtatacgtcaagtcacttcactctaagtcggttactagggttccgagggtacgtaacctaccgtctacccgttcctacggactcgcccgtcgtcccg

SEQ ID NO: 38953 - DNA, 811 bp, Homo sapiens
  misc_feature: GYAE6OF01BBV02.34.16.B05.1.454.CMB.1.raw
  modified_base (112)..(112): a, c, t, g, unknown or other
  misc_feature (112)..(112): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (277)..(277): a, c, t, g, unknown or other
  misc_feature (277)..(277): n is a, c, g, or t
tcagtacacgtgatcacgaccggtgctcgatttagagctcacgtagttgggtttgggggggggtctcgaggaggcagcgctctcgggactctccaccagtggcctggctctnctattcctccaccctcctcactcgagggcacgtacggtcctcggggaccctaggtctcgccctgaccgtcgaggtctcgccttccgtgttccgtcggttcctccgtggacacggtccgtacncctaaccncttccgtacctgacctaccgtacgggtaaaccggnacggttacgtacgttgagttactaagtttactaacgttcgttacgttccgtccgtaaccgtaaaccaaaccgtaacccggacccggaataaccgtaccctaacccctaaataccgtaggttaaccgtttaattcgtacgttaacgttactaaacctaaacggtcccgttccccgaccctttagggttcggtttactttcccgtaacgccgttaccgtttccttacttcccgtccccttctaacgtcttcggttcgtaaccggaaccctaaccggtccgtaccctcctaccgtactcgtccgtacgtcgtaccgacggtcgtagtacgggacggttaaggaacgttacgtttacgtacccgttaggtaccctcgtacgttaacttaacgttataaccgttcccgtaaccttacgtccttaacccctggtaaccttaggtaccggtttgtaccggtttaaaccgggaccggtaaccggtaaccgaccctaccgttaccgttaaccgtctacgacccgactaccggttccgtacccg

SEQ ID NO: 38954 - DNA, 610 bp, Homo sapiens
  misc_feature: GYAE6OF02IS4CB.34.16.B05.1.454.CMB.1.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
  modified_base (482)..(482): a, c, t, g, unknown or other
  misc_feature (482)..(482): n is a, c, g, or t
tcagtacacgtgatcacgaccggtgctcgatttagagctcacgtatttggggtttgggggggggtctcgaggacggcacgcgctcttccgggacggtcttccacctatggcctgggctctgctattcctcaccctcctcactcagggcacgtagggtcctgggcccagtcgtgtcccttgactctaaggctgcctccgtgtactgggtctcctggacaggtcgatcggaccgattctcctgccacgtgtaaccggcagtgacgttgatgattataagtctgtctctggtacactaacacccgnaaagtctaccaaactcagtnatttagcgatgtcaataagtcggccctgaggtgtttcncatcgtcttctactgcctcgaatcggtctaggcaaacaccggtcctccgtaggaaccactactctaggactccaggtcngggaacggacgaacgggtanaagtttaacttaacctgtaccnctacaataagttaaccaagtttccacgtacgacctacttctacggatacgtagtagttttacgggtacggaacgggaacctaaaacgtactaaccggttccttacgttacgaacgttccgaaagtccg

SEQ ID NO: 38955 - DNA, 754 bp, Homo sapiens
  misc_feature: GYAE6OF02FWB1S.34.16.B05.1.454.CMB.1.raw
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
tcagtacacgtgatcacgaccggtgctcgatttagagctcacgtaagttggggtttagggggggggtcctacaggaggcagacgactctcgggacgtctccaccatggcctgggctctgtcctattcctcaccctcctcactcagggcacgagggtccgtgggcccgagtcgtcggccctgactcaggctgcctccgtgtctgggtctcctggacagtcgatcaccatctctgcactggtaaccgcagtgacgttgatgattanaagtctgtctctgtaccaacaaccgccccganaaagcctacccaaactcaatcgtatttagtagattcggtacaaattaacgtccgggacccctacgtagggtttcgtttctcgtatccgtctttctcctcgtaccctcctaattcggtccgttcgggacctaaaccgtaccggtcccctacccgtacgtaccctactctccgtacggtacccttaccgacggtccgttagggaacgggaccgggttaggggtactttacgtttaacggtttaccgtccgggtacccttccgtacttaacgttaaacttacctaaccgtttacctaacgttccctaacccgtaaccgtttccgtaaccgtttagttcggttacggtttaaccggttttccgggggaaccgggtaacccggggttaaaccctaacccgttacccgttacccgggttcccgtttaccggaccctaaccggtaccccgtaccgggttaccccg

SEQ ID NO: 38956 - DNA, 679 bp, Homo sapiens
  misc_feature: GYAE6OF02HOKCV.34.16.B05.1.454.CMB.1.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
tcagtacacgtgatcacgaccggtgctcgatttagagctcacgtagttgggggtttgggggggggtctcaggaggcagcgctcgtcgggacgtctccaccagtcggtccgtgggctctgtcttacttcctacctaccctcctcacgtacgacgggcaacgtcgggtccgccgggccctagtcctcgtccctagtacctcgaggctcgtcccgtcgtgtcgtggtcctccgagactcgtcacnccactntccgtcncgacgtactacggtacgcgtagtcgtacgtgtagtataattagtactctacgttcctacgtacgaaccaaccgacccgaccgaactaacnccctaaccaaagtcacgttagtacttagagtactagaaanacgtaccggtcctcgtaagttcggtacttccacgtctttaccgtcttggcctacctcctgtattccggactcgaaacccgtacgtcccgtaccctacactactccgttcgcgtaccgtacctggtcgaggtcggtacgggaacggttaggtacttacttacgtcgcgtcgtactatactaacgtaccttagtcctacgtccacgtccgtagtacgtacttgtaccggttcggtacggtacgggaaccacccgttacgccgttacctcgtccgtacgtaccgtccgcgtaccccg

SEQ ID NO: 38957 - DNA, 128 bp, Homo sapiens
  misc_feature: GYAE6OF01EPLNI.47.57.F02.1.454.CMB.1.raw
  modified_base (128)..(128): a, c, t, g, unknown or other
  misc_feature (128)..(128): n is a, c, g, or t
tcagagctcacgtacacgaccggtgctcgatttagctcgatatagttgggttggcacagcggccctgggctgcctggtcaaggactacttcctacgtgagctctgagcgggctggcaaggcgcatagn

SEQ ID NO: 38958 - DNA, 130 bp, Homo sapiens
  misc_feature: GYAE6OF01E0QEF.47.57.F02.1.454.CMB.1.raw
  modified_base (130)..(130): a, c, t, g, unknown or other
  misc_feature (130)..(130): n is a, c, g, or t
tcagagctcacgtacacgaccggtgctcgatttagctcgatatagttgggtttgggcacagcggccctgggctgcctggtcaaggactacttcctacgtgagctctgagcgggctggcaaggcgcatagn

SEQ ID NO: 38959 - DNA, 129 bp, Homo sapiens
  misc_feature: GYAE6OF01CZG0R.47.57.F02.1.454.CMB.1.raw
  modified_base (129)..(129): a, c, t, g, unknown or other
  misc_feature (129)..(129): n is a, c, g, or t
tcagagctcacgtacacgaccggtgctcgatttagctcgatatagttgggtttggcacagcggccctgggctgcctggtcaaggactacttcctacgtgagctctgagcgggctggcaaggcgcatagn

SEQ ID NO: 38960 - DNA, 130 bp, Homo sapiens; identical to SEQ ID NO: 38958
  misc_feature: GYAE6OF01BSMD3.47.57.F02.1.454.CMB.1.raw
  modified_base (130)..(130): a, c, t, g, unknown or other
  misc_feature (130)..(130): n is a, c, g, or t

SEQ ID NO: 38961 - DNA, 725 bp, Homo sapiens
  misc_feature: GYAE6OF01C7HE8.47.57.F02.1.454.CMB.1.raw
  modified_base (198)..(198): a, c, t, g, unknown or other
  misc_feature (198)..(198): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
tcagagctcacgtacacgaccggtgctcgatttagctcgatatagttgggtttggggagatcagacccagtcaggacacagcatggacatgagagtcctcgctcagctcctggggctcctgctgctctttttcccaggtgccagatgtgacatccagatgacccagtccgccatcctcactgtctgcatctgtagganacagagtcaccatcacttgtcggcgagtcgagggtataggcaactggttacgctggtatacaacagaaaccagggaacncccctaactccacatcnctactgactactacctactttcgaacgtaacggtcgggtcccaattacgaaagggttccaaggccgggtactagggtaggtactacgtacgggggaactacggttaacttttaccactttaccgtactaacctttaagtccgaaacgggcctaaaccggtccccttaaggcccgtaacggacccgtttaagggtaaaacgtttacttttttaacggggtaaaactttttaagttaacgttttaccggttaaactaaaccggttaacgggggtttaaaacccttccgggtttttaccccccgacttaacccggtacccggtttccggggacggggtaaacggggtaaccccgtaaagggggtcggaaacggtaaagttaacggaaaaacggtacgtgggttacgacgttacggacaccctagtcccttacgg

SEQ ID NO: 38962 - DNA, 129 bp, Homo sapiens
  misc_feature: GYAE6OF01DW8T8.47.57.F02.1.454.CMB.1.raw
  modified_base (129)..(129): a, c, t, g, unknown or other
  misc_feature (129)..(129): n is a, c, g, or t
tcagagctcacgtacacgaccggtgctcgatttagctcgatatagttgggttgggcacagcggccctgggctgcctggtcaaggactacttcctacgtgagctctgagcgggctggcaaggcgcatagn

SEQ ID NO: 38963 - DNA, 130 bp, Homo sapiens; identical to SEQ ID NO: 38958
  misc_feature: GYAE6OF01CT1LY.47.57.F02.1.454.CMB.1.raw
  modified_base (130)..(130): a, c, t, g, unknown or other
  misc_feature (130)..(130): n is a, c, g, or t

SEQ ID NO: 38964 - DNA, 867 bp, Homo sapiens
  misc_feature: GYAE6OF01E0R45.47.57.F02.1.454.CMB.1.raw
  modified_base (204)..(204): a, c, t, g, unknown or other
  misc_feature (204)..(204): n is a, c, g, or t
tcagagctcacgtacacgaccggtgctcgatttagctcgatatagttgggtttggggagatcagacccagtcaggacacagcatggacatgagagtcctcgctcagctcctggggctcctgctgctctgtttcccaggtgccagatgtgacatccagatcgaccccagtccgccattccctcactgtctgctatcgtgtagganacagacgtccaaccatcgtacgttgggtcgggcgagtcgagggctagttacgtcttaagttttttacggcccgttggtttacgacgtaccgtaacggaaaaccccgtaaggggtaaaccgtacccccgttaaacggttccccgtagtaacttaccgttaagttccggtaccgtttcggttaccgttacccgttaaccgttttacgggtaaccgttaaaacgggttcccgggggttaacccctaacggttaaccgggttaaaggggtttacggacccccccgggggttagggttaaccgggtacgttacgggtttaacgggaacgttaacggttacgttttacccgaacccgtttcccgtaacccttaacccgtacttaccgaaccggtacccgtaaacggtcccgtagtaccgtaccggtaccccgttaggttaaccgttacgtttttacgaaccctttaaccgttaaccgtttaccgaacccggtaactaaaccttaagttaacttaacgttaaccgttaacccgtttaacctaccgttaccgtaacccggttacccggtacggtaaaaccggggtactaaccggttaagggtaacgggtaacgttaaacgggtaaacggtacgttcggggtaccgtacgttaccgcccgtaacgttacccg

SEQ ID NO: 38965 - DNA, 131 bp, Homo sapiens
  misc_feature: GYAE6OF01C6U9U.47.57.F02.1.454.CMB.1.raw
  modified_base (131)..(131): a, c, t, g, unknown or other
  misc_feature (131)..(131): n is a, c, g, or t
tcagagctcacgtacacgaccggtgctcgatttagctcgatatagttgggtttgggcacagcggccctgggctgcctggtcaaggactacttcctacgtgagctctggagcgggctggcaaggcgcatagn

SEQ ID NO: 38966 - DNA, 849 bp, Homo sapiens
  misc_feature: GYAE6OF01CN4VE.47.57.F02.1.454.CMB.1.raw
tcagagctcacgtacacgaccggtgctcgatttagctcgatatagttgggtttggggaggatcagacccagtcaggacacagcatggacatgagagtcctcgctcagctcctggggctcctgctgctctgtttcccaggtgccagatgtgacatccagatgacccagtcgccatcctcactgtctgcatcgtgtaggagacagacgtcaccatctacgttggtcgggcgtaggttcgaggggtctaagtttacggtaccttaaagtttttttacgcccgtttagggttttaccaacggtaccgaaacggtaaaaaccccgaaagggggtaaaaacccggtaccccccgttaaaacggttccccgttaaggtaaccttaccgttaagttcggtccgtttacggttacgttaccccttaacgttttcggaaccgttaaaacgggttccggggttacccctaacgttaaccggttaaaggggtttacggaccggggtaccgggttagggtaacgttaccgggtacggggtaaccgtaacggttactttttacccgaaccgtttacccgtaacccgtaacccgtaacgttaccgaacggtaccgaacccgtcccgttagaccgtacgtaccgttaaggtaacgtttacgttttacgacctttaaacgtttacttaaccgtacgaaaccctaaacgtaaatttaacgttaacgttacgttaaaccctttaacccgtacgttaccccgtaaccggtttaccggaaacccgtaaacgggtaccctaaccggtacgttacgggaaacggtaacggtaaacggtaccgtacgggtacgacctacgccgtaaccgtacg

SEQ ID NO: 38967 - DNA, 806 bp, Homo sapiens
  misc_feature: GYAE6OF01EZ0PH.47.57.F02.1.454.CMB.1.raw
  modified_base (140)..(140): a, c, t, g, unknown or other
  misc_feature (140)..(140): n is a, c, g, or t
  modified_base (495)..(495): a, c, t, g, unknown or other
  misc_feature (495)..(495): n is a, c, g, or t
tcagagctcacgtacacgaccggtgctcgatttagctcgatatagttgggtttggggagatcagacccagtcaggacacagcatggacatgagagtcctcgctcagctcctgggctcctgctgctctcgtttcccaggtnccagatgtgacactccagatcgaccccagtccgccactcctcactgtctgctatcgtgtaggacgacagacgtccaacctatcctacgttggtcgggcgagtcgaggactagttagtacttaagtttttcgccgttgttcagaccgaacgaaaccggaacgggaacctaccccgtaacgttccgtacgtacgtttacgtaacgtcggtaccgttaggttacccgttaccgttacgttttacggaacgttaacgggttccgggtaccctaagttaccggtaaacgggtttcggacgggtaggtacgggtagttacggtaggactacgttacttacctacgtactaccgaaccgtanaccgtacgacgtaccgtccgtacgaccgtacttacccggttaagaagtttttacgttaaccgttaacgtttaaacctttttaccgtaaccgtaaccggtaaaccccttaaaagttaaacgtttaaacttaaaccgtttaaccgtttaaaccctttaaccccgttaacccgttacccgttaaccccggttaaccgggtaaacccgtaaacgggtaaacccgtaaggtaaccgggttaacggtaaacgggttaaacccggtaaaggttaaccgtcgggttaaccgtactacccgtaccgtaccgtttaaccgg

SEQ ID NO: 38968 - DNA, 798 bp, Homo sapiens
  misc_feature: GYAE6OF01EMOVN.47.57.F02.1.454.CMB.1.raw
  modified_base (584)..(584): a, c, t, g, unknown or other
  misc_feature (584)..(584): n is a, c, g, or t
tcagagctcacgtacacgaccggtgctcgatttagctcgatatagttggggtttggggagatcagacccagtcaggacacagcatggacatgagagtcctcgctcagctcctggggctcctgctgctctgtttcccaggtgccagatgtgacatccagatgaccctagtcgccatcctcactgtctgcatctagtaggagacagagtccaccatcacgttgtcgggcgagtcgaggtactattagtctaagttttttacgccttaggtttacaacgacgtaacggaaaacccgaacggggtaaaaccgtacccccgttaaaaggttccccgtacggtaacttccgtaacgttcgccgtttagttaccgttacccgtaacgttttacggtaacccggttaaaacggggtccggggggttaacccctaacggttaaccggttaaacggggtttacggccgggggtacgggttacgggtacggttacggttacgggggaccttaacgggtaactttttacccgaccgttaccccgttaccctaacccgtacgtaccgtaacggtccccgtaaacgtcccgggttacncccggtaacgtacccgttaaggtaacgtttacgttttacggaacctttaaacgtttactttaaccgacgtaaccctaaataaactttagtaactacgttaaccgttaaccctacgttacccgtaccgttacggacccgtaaaggtacccgtaacggtacgtagggaaacgtaagtaaaggaccgttacggtacgaccgttacgccgtacctacg

SEQ ID NO: 38969 - DNA, 856 bp, Homo sapiens
  misc_feature: GYAE6OF01EQMSP.47.57.F02.1.454.CMB.1.raw
  modified_base (158)..(158): a, c, t, g, unknown or other
  misc_feature (158)..(158): n is a, c, g, or t
tcagagctcacgtacacgaccggtgctcgatttagctcgatatagttggggtttgggggagatcagacccagtcaggacacagcatggacatgagagtcctcgctcagcctccgtggggctcctgctgctctcgtttcccaggtcgccagatgtgacntccagatcgacccagtcctccatccctccctgtcctgctactcgtaggtaacgggaacgaccaacgtacgtacccaacctactcccgtaccggttccgggccggggtacgtacggtacgaacggtaacttaagttaacgtaactttaaagttttacgttaacccgtccggttaggtactacgaaccggtaaccgaaaacggtaaaaccgggtaagggtaaactttacccgtaagtcccctacggttatactttacgtaacgttacgttaacctacttaccctttagtaccgtaaccgtttaccggggttaccccggtacttaccggttccgttacggttcgtaggtcggtaggtaacgggttggtaccgttacgggtaacgggtataacggtttaccctttccaccgtttaacccaacctacgtaacgtaccgaccgtaccgtaaccggtccctaaggcccggttaacggaccggttaaggaacggttacgttttaggtaaccggttaacctttaaacgttttaacctaacggtttaaacgtaaaaaacttaaagttaacccggtaacggtcccggttccccgttacccgtcgttacccggtaacccgggttacgggggaaccgggtaacggggtacgtaaggggtaacgaacgtaaacggtaacccgaagggttacctgggttccgagttaaccccg

SEQ ID NO: 38970 - DNA, 698 bp, Homo sapiens
  misc_feature: GYAE6OF01B8E93.47.57.F02.1.454.CMB.1.raw
  modified_base (180)..(180): a, c, t, g, unknown or other
  misc_feature (180)..(180): n is a, c, g, or t
tcagagctcacgtacacgaccggtgctcgatttagctcgatatagttggggtttggggagatcagacccagtcaggacacagcatggacatgagagtcctcgctcagctcctgggctcctgctgctctgtttcccaggtgccagatgtagacagtccagatcgacccagtcgccatcccncactgctgctatcgtagtaggacacgagtacgtccaccattctaacgtttcggaccggggcgaagttcgacggggtctaagtttagacttaagttttttacgccgttaggtttcaggaccgtaacgaaaccgtacgggaaacgtcccccgtaagttccctagtacttacaactcgtcgttgtacgttaccctacgtttaggaaccgtaaacggttccggggtaccctaagttacggttaaacgggtttaccggcgggtcggtaggtacgtcgtacgggacctagttactttcacgttctactacctacgtacacgacacgtcctacgacgtacgtaccgtagttacggttactttcgaaccgttaacttcttaacctacgtaacctaacgtaaacttaacgttaacttaccgttaactttacccgtacttacccgtacgttacggacccgtaacggacgtacgtacgtagggaagtaacggtaacggtacgttacggacgtacgtacgacgtactacg

SEQ ID NO: 38971 - DNA, 589 bp, Homo sapiens
  misc_feature: GYAE6OF01D4VF5.47.57.F02.1.454.CMB.1.raw
  modified_base (314)..(314): a, c, t, g, unknown or other
  misc_feature (314)..(314): n is a, c, g, or t
tcagagctcacgtacacgaccggtgctcgatttagctcgatatagttgggtttggggagatcagacccagtcaggacacagcatggacatgagagtcctcgctcagctcctggggctcctgctgctctgtttcccaggtgccagattgtgacatccagatgacccagtcgccatcctcactgtctgcatctgtaggagacagagtccaccatccacttaggtcgggcgagtcgagggctattagtacttaatttttagccttggtttcagacaaggaaaccgagggaaacgtccctaacgtcctagatctatgntgtcgtacctacttgcgtaaacggtcggggtacccagtacgtaaggtttcgcgggtcggtaggtatcgtagggactagtacttctacttcctactacacgtcagtcacgcctacgcacgctagtaagtatttacgacttaactttacgtactacgaaccaaactaagtaataagtacgttacttaaccttactacctaccgtacgacccggaaggtacgtaccgtagtacgggacgtaaacggtaaacggtacggtgtacggctacgcacgtacg

SEQ ID NO: 38972 - DNA, 719 bp, Homo sapiens
  misc_feature: GYAE6OF01CTNH3.47.57.F02.1.454.CMB.1.raw
  modified_base (184)..(184): a, c, t, g, unknown or other
  misc_feature (184)..(184): n is a, c, g, or t
  modified_base (204)..(204): a, c, t, g, unknown or other
  misc_feature (204)..(204): n is a, c, g, or t
tcagagctcacgtacacgaccggtgctcgatttagctcgatatagttgggtttggggagatcagacccagtcaggacacagcatggacatgagagtcctcgctcagctccgtggggctcctgctgctctgtttcccaggtcgccagtatgtagacactccagatcgacccagtccgccatcccncactgtctgcatctgagganacaggatccacatcacgttggcgggacgacgtcgacgggtctaatacgtattaactttttacgccgttagtttccgagtaacgaacgaaaaccgtaacggggaaaccgtaccccgtaagtcccgtagacttacgtatcgacctgtacgtacctattagacgtaacggtccgggtacagttacgtagggttacggcggtaggtacgagttacggacggggactaggtactttaccgacctttacgaccgtaaccacgtactacgacgtaccgtctacgaacacggtacctaagtaacgtttcgttaccaacgttaactttaacgtaccgtacgtaaccaaataaaggttaacttacgttacgtaaacccttaccgtactaacccgtaacccggtaacggtacccgtaaaaggtaccgaacggtaaccgggtaaaggtaaaacgggttaaaacgggtaaaaccggttaacgttcgggaacggacccgtttaaaccgaacccggtaaccctttaacgg

SEQ ID NO: 38973 - DNA, 141 bp, Homo sapiens
  misc_feature: GYAE6OF02G01CJ.47.57.F02.1.454.CMB.1.raw
  modified_base (124)..(141): a, c, t, g, unknown or other
  misc_feature (124)..(141): n is a, c, g, or t
tcagagctcacgtacacgaccggtgctcgatttagctcgatatagttgggttgggcacagcggcctggctgcctggtcaaggactacttctcgagctctcgagcgggctggcaaggcgcatagnnnnnnnnnnnnnnnnnn

SEQ ID NO: 38974 - DNA, 130 bp, Homo sapiens
  misc_feature: GYAE6OF02FEQ5U.47.57.F02.1.454.CMB.1.raw
  modified_base (129)..(130): a, c, t, g, unknown or other
  misc_feature (129)..(130): n is a, c, g, or t
tcagagctcacgtacacgaccggtgctcgatttagctcgatatagttgggtttggcacagcggccctgggctgcctggtcaaggactacttcctacgtgagctctgagcgggctggcaaggcgcatagnn

SEQ ID NO: 38975 - DNA, 131 bp, Homo sapiens
  misc_feature: GYAE6OF02JCJRP.47.57.F02.1.454.CMB.1.raw
  modified_base (129)..(131): a, c, t, g, unknown or other
  misc_feature (129)..(131): n is a, c, g, or t
tcagagctcacgtacacgaccggtgctcgatttagctcgatatagttgggttgggcacagcggccctgggctgcctggtcaaggactacttcctacgtgagctctgagcgggctggcaaggcgcatagnnn

SEQ ID NO: 38976 - DNA, 128 bp, Homo sapiens; identical to SEQ ID NO: 38957
  misc_feature: GYAE6OF02GO66D.47.57.F02.1.454.CMB.1.raw
  modified_base (128)..(128): a, c, t, g, unknown or other
  misc_feature (128)..(128): n is a, c, g, or t

SEQ ID NO: 38977 - DNA, 130 bp, Homo sapiens; identical to SEQ ID NO: 38958
  misc_feature: GYAE6OF02HW4AL.47.57.F02.1.454.CMB.1.raw
  modified_base (130)..(130): a, c, t, g, unknown or other
  misc_feature (130)..(130): n is a, c, g, or t

SEQ ID NO: 38978 - DNA, 148 bp, Homo sapiens
  misc_feature: GYAE6OF02GZE72.47.57.F02.1.454.CMB.1.raw
  modified_base (131)..(148): a, c, t, g, unknown or other
  misc_feature (131)..(148): n is a, c, g, or t
tcagagctcacgtacacgaccggtgctcgatttagctcgatatagttgggtttgggcacagcggccctgggcctgcctggtcaaggactacttcctacgtgagctctgagcgggctggcaaggcgcatagnnnnnnnnnnnnnnnnnn

SEQ ID NO: 38979 - DNA, 503 bp, Homo sapiens
  misc_feature: GYAE6OF02IPOJ2.47.57.F02.1.454.CMB.1.raw
tcagagctcacgtacacgaccggtgctcgatttagctcgatatagttgggtttggggagatcagacccagtcaggacacagcatggacatgagagtcctcgctcagctcctggggctcctgctgctctgtttcccaggtgccagatgtgacatccagatgacccagtcgccatcctcactgtctgcatctgtaggagacagagtcaccatcacttgtcgggcgagtcagggcattagcaatttttagcctggtttcagcagaaaccagggaaagcccctaagtccctgatctatgctgtgtccactttgcaaagtggggtcccatcaaggtttagcggcggtggatctgggacagatttcactctcaccatcagcagcctgcagcctgaagtattttgactaactttattactgaccaactaatataatgtaactttaaccctataccaccttcggaccaagggaccacgtactggaagagtaaagactggtggctgacacta

SEQ ID NO: 38980 - DNA, 558 bp, Homo sapiens
  misc_feature: GYAE6OF02FOND9.47.57.F02.1.454.CMB.1.raw
tcagagctcacgtacacgaccggtgctcgatttagctcgatatagttgggtttggggagatcagacccagtcaggacacagcatggacatgagagtcctcgctcagctcctggggctcctgctgctctgtttcccaggtgccagatgtgacatccagatgacccagtcgccatcctcactgtctgcatctgtaggagacagagtcaccatcacttgtcgggcgagtcagggtattagcaactggttagcctggtatcaacagaaaccagggaaacgcccctaacctcctcatctctactgcatccactttgcaaagtggggtcccatcaaggttcagcggcagtggatctgggacagatttcactctcactatcagcagcctgcagcctgtaagtattttggaactttattaattgtacctaaacgtaacggggttaaaccacgttttacccgcttacctaccgtttaccgggacggtacgggaccgaagggttgggaacggtaacgttaaggaaaacgtaaccgttaggtacgggtacctaggaccaccgtattccg

SEQ ID NO: 38981 - DNA, 607 bp, Homo sapiens
  misc_feature: GYAE6OF02GT5NL.47.57.F02.1.454.CMB.1.raw
  modified_base (227)..(227): a, c, t, g, unknown or other
  misc_feature (227)..(227): n is a, c, g, or t
  modified_base (298)..(298): a, c, t, g, unknown or other
  misc_feature (298)..(298): n is a, c, g, or t
tcagagctcacgtacacgaccggtgctcgatttagctcgatatagttgggtttgggggagatcagacccagtccaggacacagcatgggacatgagggtccccgcgtcagctcctgggactcctgctgctctggttcccaggtgccgaggtgtgacgatccagatgacccagtctccatcctccctgtctgcatctgtaggagacagagtcaccatcacttgccggnagtcagggcttgcaatgctttggcctggtttcagcagacacaggaagccctaagcgcctgatctatggtancatacgtactttgacaaaggttcggggtaccctagtacgaaggtttcaggcggactaggtaggtctggggacaggtacgttcacgtctcaactactcagcggctagcacgacctagaagttcgttcttacgaccttaaactttacgtacttacgtccttaccgtaagttattaaggacttacgttacctttaccccgttacgggttaccgttttacccgggaccgtaaacggggtaaccgtaaacgggttaacggaaaactaaccgaaaacgtaccgtaggtcggtacgtaccgacgtaccacttaccg

SEQ ID NO: 38982 - DNA, 634 bp, Homo sapiens
  misc_feature: GYAE6OF02IU0TV.47.57.F02.1.454.CMB.1.raw
  modified_base (204)..(204): a, c, t, g, unknown or other
  misc_feature (204)..(204): n is a, c, g, or t
tcagagctcacgtacacgaccggtgctcgatttagctcgatatagttgggtttgggggagatcagacccagtccaggacacagcatggacatgagagtcctcgctcagctcctggggctcctgctgctctgtttcccaggtgccagatgtgacatccagatgacccagtctccatcctccctgtctgcatctgtaggagacagngtcaccatcacgttggccgggcagtcgaggggcgttgacaaatgtctttcggccttggtttcagcagacgacaaggggtaacggccccgtaagccgcctagacttacttacgtggtcgactatacgtactttagacgtaaacggtcgggtacccagtcgaaacggttcgaaggcggactaggtggtcgtagggaccaggtacgtcacttcctacgactacgtcgtacgccgtccgtacgcacggtctacgtaagtttacgtttcgtactttagtttacttacgttgtactacgactaagttacttaactaacgttaaccgtcggtaccctcgttacccgtaccggttcccggaaccggaaacgggtacccgaaccggtacgtaacggtaacggttaaaccttaaaccggtaacgttgggtaccgtaccgg

SEQ ID NO: 38983 - DNA, 132 bp, Homo sapiens
  misc_feature: GYAE6OF02FZQ06.47.57.F02.1.454.CMB.1.raw
  modified_base (129)..(132): a, c, t, g, unknown or other
  misc_feature (129)..(132): n is a, c, g, or t
tcagagctcacgtacacgaccggtgctcgatttagctcgatatagttgggtttggcacagcggccctgggctgcctggtcaaggactacttcctacgtgagctctgagcgggctggcaaggcgcatagnnnn

SEQ ID NO: 38984 - DNA, 872 bp, Homo sapiens
  misc_feature: GYAE6OF02F2G4V.47.57.F02.1.454.CMB.1.raw
tcagagctcacgtacacgaccggtgctcgatttagctcgatatagttgggtttggggagatcagacccagtcaggacacagcatggacatgagagtcctcgctcagctcctggggctcctgctgctctgtttcccaggtgccagatgtgacatccagatgacccagtcgccatcctcactgtctgcatctgtaggagacagagtcaccatcacttgtcgggcagtcgagggcattagctaatttttagccttggtttcagcaacgaaaccgagggaacgacccctaacgtccctgactctatgctgtcgtcctacgtttgacgtaaagtcggggtaccctagtacggtaaacgggttttacggaccggggtcgggttacgggtaacgttacgggtacgggggtaaccgtaacggttacgtttttacccaaccgtttcccgttaacccgtaaaccccttaacgtttaaccccgaaacgggtaaccccgttaaaccgggtccccggtttacggaccccggtaaccggtacccccgttaagggttaaaaccggttttaacgtttttttaccgggaaacccctttaaaacgttttttaccgttttaaacccgttaaccggtaaacccctaaaaaccgtttaaaacttttaaaacttaaaacgtttaccggttttaaaacccttttaaaccccctttaactttaaccccgtaaccccggttttaacccggggaacccccggttaaaaacgggggtaaccccgtaaaccgggtaaccggttaacgggggtaaaaccggttaaaccggggttaaaaacggggttaaaccgttcggggttaaccggggtaccctttaccgggaccccaaccggtttaacc

SEQ ID NO: 38985 - DNA, 835 bp, Homo sapiens
  misc_feature: GYAE6OF02G90YW.47.57.F02.1.454.CMB.1.raw
tcagagctcacgtacacgaccggtgctcgatttagctcgatatagttggggtttggggagatcagtcccactcaggacacagcatggacatgagggtcccgctcagctcctggggctcctgctgctctggttcccaggtgtccaggtgtgactatccagatgacccagtctccatcctcctgtctgcagtctgtaggagacagagtacaccatctacgttcggccgggcgagtcgagggtccgttgacaaatgtctttggtccttgttcagcgtagacaccgacgggaacggtcccgtagccgccgtcgacgtcgtaggtggtacgtctagtacgtacgtttcgacgtaaaacgggttcgggtaccctaagttaaccggtaaacggtttaccgtaaggaccgggtacgtaacggttacggttacggtaacggggaaacgtacgggtaaccggtttaccgaacccgttacccgttaaccgtaacctttaaccgtacggtaacccgggtcccggtaccgtacgggtacccgttaaccgggacccggttaaacggtaaacgtttacgtttacccgtaacggttaacccttaaacgttttacgtttaaccgttacgtttaccgttacccgtaaggtttaacgtacgggttaacttacccgttaccgttttaacccgtacgggtttaacccgtttttacccgggaaccgggttaaaccggggttaacccgggtaaaacggggttaaccggggttaaaacttaaccgggtaaaaacccggttacggttacgggttaacgggttaccgttacccgggtaacggtaccgttacggtttaccgg

SEQ ID NO: 38986 - DNA, 634 bp, Homo sapiens
  misc_feature: GYAE6OF02HOS1V.47.57.F02.1.454.CMB.1.raw
  modified_base (477)..(477): a, c, t, g, unknown or other
  misc_feature (477)..(477): n is a, c, g, or t
tcagagctcacgtacacgaccggtgctcgatttagctcgatatagttgggtttggggagatcagacccagtcaggacacagcatggacatgagggtccccgctcagctcctggggctcctgctgctctggttcccaggtgccaggtgtgacatccagatgacccagtctccatcctccctgtctgcatctgtaggagacagagtcaccatccacttggccgggacgagtcgaggggcgttgacaaatgtctttggccttggtttcagcagacaccgaagggaacgcccgtaagccgctagactcgtagtggtgactaactactactttagacgtaaggtcgggtaccctagtaccgaaggttccagcggcgtaggtagtacgtcggggaactaggtacgttcacgtctactactagtcaggccggtctagccgagtcccgtagtaacgtctttcgcgtacaacgtttactaccgttntacccgttacctagttatacggtacttacgtacctttacccgtacgggtttaaccgttccgggaaccgaacggggtaaccggtaacggggttaacgaaaccgtacccgtaaaacggtacccgttaggcggtaacgtccgacctaccgtacgtttccg

SEQ ID NO: 38987 - DNA, 611 bp, Homo sapiens
  misc_feature: GYAE6OF02H9OEH.47.57.F02.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (277)..(277): a, c, t, g, unknown or other
  misc_feature (277)..(277): n is a, c, g, or t
tcagagctcacgtacacgaccggtgctcgatttagctcgatatagttgggtttggggagatcagacccagtcaggacacagcatggacatgagagtcctcgctcagctcctggggctcctgctgctctgtttcccaggtgccagatgtgacatccagatgacccagtcgccatcctcactgtctgcatctgtagganacgagntcacatcacgttggcgggcgagtcagggcattagtctaatttttagccttggtttcagcagaaaccgaggaacncccctaagtccctagatctatgctgtcgtcctatttgacgtaagtcggggttacccatcgtaagggtttagcgggtcggtggactcgtaggactaggtatttaccgactctacacctactcgagcctagcctgacgacgtcctaggtaagtttactttagaaccttaaacgtttacttaaccttcgaacctaaacgtaacttaaagttaacgttacgtaaactttaaccccttatcccttaaccgttcggaccgtaacgggaacgtaccgaacgtagggtaacggtaaacggttaaacggacgttacgggtacggtacgtcgaccgtacctacg

SEQ ID NO: 38988 - DNA, 798 bp, Homo sapiens
  misc_feature: GYAE6OF02I0RWT.47.57.F02.1.454.CMB.1.raw
  modified_base (140)..(140): a, c, t, g, unknown or other
  misc_feature (140)..(140): n is a, c, g, or t
  modified_base (186)..(186): a, c, t, g, unknown or other
  misc_feature (186)..(186): n is a, c, g, or t
  modified_base (246)..(246): a, c, t, g, unknown or other
  misc_feature (246)..(246): n is a, c, g, or t
  modified_base (325)..(325): a, c, t, g, unknown or other
  misc_feature (325)..(325): n is a, c, g, or t
  modified_base (370)..(370): a, c, t, g, unknown or other
  misc_feature (370)..(370): n is a, c, g, or t
tcagagctcacgtacacgaccggtgctcgatttagctcgatatagttgggtttggggagatcagacccagtcaggacacagcatggacatgagagtcctcgctcagctcctggggctcctgctgctctgtttcccaggtnccagatgtcgacatccagatcgacccagtccgcatcctcactgtcngtacattctggtaggatacagacgtcaccatcctacgtggccggactaaggtcaggtacnctaattaacacgacgttaaatttaaacgttggtaactccaaaaccgtaaacggaaaaacccgaacgggggtaaaacccncccccctttaaaacccgtccgttagggaaacctttacggttaaanccggttcgtaggaaccttaacccgttaccgtttagggtttacgaccggtaaacgtttaccggggggtaccgggttaccccttaaaggtttcggtttaacgggtttccgaaaggttcggggtaccgtaaggttccgggtaaaccgttcggttaacggggaacgtaaccgtttacgtttacccgtacttccgtaacccgtactaacgtcgtaacgccgttacgcgttaacgactaccgtagttaagttacttacgggttactaacggttaacctttacgttaactacgttaaactaaaagtttacgtaaaccggtacgtaccgaccccgttacgttaaccgttacggttaccgggaccggtaacggggacccggttaagggtaccgaaggttaaccgaccggttaaacggacgttcggttaccgtaccgg

SEQ ID NO: 38989 - DNA, 768 bp, Homo sapiens
  misc_feature: GYAE6OF02IIT9Q.47.57.F02.1.454.CMB.1.raw
  modified_base (752)..(752): a, c, t, g, unknown or other
  misc_feature (752)..(752): n is a, c, g, or t
tcagagctcacgtacacgaccggtgctcgatttagctcgatatagttgggtttgggagatcagacccagtcaggacacagcatggacatgagagtcctcgctcagcctcctggggctcctgctgctctcgtttcccaggtcgccaggatgtcgaccatccagactcgaccccgagtcctccatcccttcccctgtcctgctatcctgtacggactacgagtagtccaacccgtatcacgttcggccgggaccgagtcggacggggtacgtttgaccgtaaagtcgtacgtttccgggtacgtttcggttacgtacgacgtacgaaccggaccggaacgggggtaaccggacccccgttaaggcccgtaccgtacgtacttaccggtagttaggtcggtacctacgtacgttaccgtttacggaccgtaaacggttcccgggtaccgtaacgtaccgtaaggttccgaacgggtccggacggtagtaacgggtccgtacgggacgtagtacggtacgtaccctacgtaccgtaacgtacgtaccgtaggcccgtaccggtcgacgtacggaccgtagttacgtacttacgtacgtacctaacttaactttaccgttacgttaccgttacctaggttacgtacgttcggttaaccggtcgtttacccgtaccggtttaccttaccgggtaacccggtaaacggtaccggtaaaccgggttaggtaaacgtaccggtaaacgtccgttaacgggngttaccggacctaccg

SEQ ID NO: 38990 - DNA, 291 bp, Homo sapiens
  misc_feature: GYAE6OF01E0I07.33.38.D05.1.454.CMB.1.raw
  modified_base (269)..(291): a, c, t, g, unknown or other
  misc_feature (269)..(291): n is a, c, g, or t
tcagtacacacactcacgaccggtgctcgatttagtatctgatagttgggtttgggacagacgttacactcctcaccatcacgcggcctccagtctcgaagattttgcagtttagttacctgtcagcagttatacgtaactggcctcccatgtacacttttggccaggggaccaagctggagatcaaacgaactgtggctgcaccatctgtcttcagtcttccgcctatctgaatgtgtgtactgagcgggctggcaaggtcgcatagnnnnnnnnnnnnnnnnnnnnnnn

SEQ ID NO: 38991 - DNA, 260 bp, Homo sapiens
  misc_feature: GYAE6OF01B0YUD.33.38.D05.1.454.CMB.1.raw
  modified_base (259)..(260): a, c, t, g, unknown or other
  misc_feature (259)..(260): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtacacttttggccaggggaccaagctggagatcaaacgaactgtggctgcaccatctgtcttcatcttcccgccatctgaagtgtgtgtactgagcgggctggcaaggcgcatagnn

SEQ ID NO: 38992 - DNA, 316 bp, Homo sapiens
  misc_feature: GYAE6OF01BGJZF.33.38.D05.1.454.CMB.1.raw
  modified_base (278)..(284): a, c, t, g, unknown or other
  misc_feature (278)..(284): n is a, c, g, or t
  modified_base (288)..(316): a, c, t, g, unknown or other
  misc_feature (288)..(316): n is a, c, g, or t
tcagtacacacactcacgaccggtgctcgatttagtatctgatagttgggtttgggacaaggacgttacactcctcaccatcacgcggcctccagtctcgaagattttgcagtttagttacctggtcagcagttatacgtaactggcctcccatgtacacttttggccaggggacccaagctggagatcaaacgactggtggctgcaccatctgtcttcagtccttcccgccatctgaagtgtgtgtactgagcgggctggctaaggtccgcagtagnnnnnnnctgnnnnnnnnnnnnnnnnnnnnnnnnnnnnn

SEQ ID NO: 38993 - DNA, 264 bp, Homo sapiens
  misc_feature: GYAE6OF01AGQRL.33.38.D05.1.454.CMB.1.raw
  modified_base (261)..(264): a, c, t, g, unknown or other
  misc_feature (261)..(264): n is a, c, g, or t
tcagtacacacactcacgaccggtgctcgatttagtatctgatagttgggtttgggacagagttcactctcaccatcagtcggcctccagtctgaagattttgcagtttattactgtcagcagtatactaactggcctcccatgtacacttttggccaggggaccaagctggagatcaaacgaactgtggctgcaccatctgtcttcatcttcccgccagtctgaagtgtgtgtactgagcgggctggcaaggcgcatagnnnn

SEQ ID NO: 38994 - DNA, 261 bp, Homo sapiens
  misc_feature: GYAE6OF01DAI28.33.38.D05.1.454.CMB.1.raw
  modified_base (259)..(261): a, c, t, g, unknown or other
  misc_feature (259)..(261): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtacacttttggccaggggaccaagctggagatcaaacgaactgtggctgcaccatctgtcttcatcttcccgccatctgaagtgtgtgtactgagcgggctggcaaggcgcatagnnn

SEQ ID NO: 38995 - DNA, 260 bp, Homo sapiens; identical to SEQ ID NO: 38991
  misc_feature: GYAE6OF01DZK37.33.38.D05.1.454.CMB.1.raw
  modified_base (259)..(260): a, c, t, g, unknown or other
  misc_feature (259)..(260): n is a, c, g, or t

SEQ ID NO: 38996 - DNA, 263 bp, Homo sapiens
  misc_feature: GYAE6OF01DE17H.33.38.D05.1.454.CMB.1.raw
  modified_base (259)..(263): a, c, t, g, unknown or other
  misc_feature (259)..(263): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtacacttttggccaggggaccaagctggagatcaaacgaactgtggctgcaccatctgtcttcatcttcccgccatctgaagtgtgtgtactgagcgggctggcaaggcgcatagnnnnn

SEQ ID NO: 38997 - DNA, 265 bp, Homo sapiens
  misc_feature: GYAE6OF01AYV6Z.33.38.D05.1.454.CMB.1.raw
  modified_base (257)..(265): a, c, t, g, unknown or other
  misc_feature (257)..(265): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtacacttttggccaggggaccaagctggagatcaaacgaactgtggctgcaccatctgtcttcatcttccgcatctgaagtgtgtgtactgagcgggctggcaaggcgcatagnnnnnnnnn

SEQ ID NO: 38998 - DNA, 261 bp, Homo sapiens; identical to SEQ ID NO: 38994
  misc_feature: GYAE6OF01BDMTX.33.38.D05.1.454.CMB.1.raw
  modified_base (259)..(261): a, c, t, g, unknown or other
  misc_feature (259)..(261): n is a, c, g, or t

SEQ ID NO: 38999 - DNA, 259 bp, Homo sapiens
  misc_feature: GYAE6OF01CLDZT.33.38.D05.1.454.CMB.1.raw
  modified_base (259)..(259): a, c, t, g, unknown or other
  misc_feature (259)..(259): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtacacttttggccaggggaccaagctggagatcaaacgaactgtggctgcaccatctgtcttcatcttcccgccatctgaagtgtgtgtactgagcgggctggcaaggcgcatagn

SEQ ID NO: 39000 - DNA, 272 bp, Homo sapiens
  misc_feature: GYAE6OF01D62BG.33.38.D05.1.454.CMB.1.raw
  modified_base (256)..(257): a, c, t, g, unknown or other
  misc_feature (256)..(257): n is a, c, g, or t
  modified_base (259)..(272): a, c, t, g, unknown or other
  misc_feature (259)..(272): n is a, c, g, or t
tcagtacacacactcacgaccggtgctcgatttagtatctgatagttgggtttggggacgagagttcactctcaccatcagcggcctccagtctgaagattttgcagtttattactgtcagcagcgtagcaactggtcttggacgttcggccaagggaccaaggtggaaatcaaacgaactgtggctgcaccatctgtcttcatcttcccgccatctgaagtgtgtgtactgagcgggctggcaaggcgcataggnntnnnnnnnnnnnnnn

SEQ ID NO: 39001 - DNA, 343 bp, Homo sapiens
  misc_feature: GYAE6OF01AF36R.33.38.D05.1.454.CMB.1.raw
  modified_base (262)..(271): a, c, t, g, unknown or other
  misc_feature (262)..(271): n is a, c, g, or t
  modified_base (274)..(277): a, c, t, g, unknown or other
  misc_feature (274)..(277): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (298)..(343): a, c, t, g, unknown or other
  misc_feature (298)..(343): n is a, c, g, or t
tcagtacacacactcacgaccggtgctcgatttagtatctgatagtggggtttgggacagagttcactctcaccatcagcggcctccagtctgaagattttgccagtttattactgtcagcagtatactaactggcctcccatgtacacttttggccaggggaccaagctggagatcaaacgactgtggctgcaccatctgtcttcatccttcccgccatcgtgaagtgtgtgtactgagcggctggcgaaggcgacatagnnnnnnnnnntannnngnagnagntngctgagnaacnnnnnnnnnnnnnnnnnnnnnnnnnnnnnnnnnnnnnnnnnnnnnn

SEQ ID NO: 39002 - DNA, 294 bp, Homo sapiens
  misc_feature: GYAE6OF01BB2SA.33.38.D05.1.454.CMB.1.raw
  modified_base (257)..(294): a, c, t, g, unknown or other
  misc_feature (257)..(294): n is a, c, g, or t
tcagtacacacactcacgaccggtgctcgatttagtatctgatagttgggtttggggacagagttcactctcaccatcagcgcctccagtctgaagtattttgctagtttattactgtcagcagcgtagcaactggtcttggacgttcggccaaggaccaggtgaaatcaaacgactgtgctgcaccatctgtcttcatccttcccgccatctagaagtgtgtgtactgacgcgggctgggacaaggccgcagtagnnnnnnnnnnnnnnnnnnnnnnnnnnnnnnnnnnnnnn

SEQ ID NO: 39003 - DNA, 292 bp, Homo sapiens
  misc_feature: GYAE6OF01C73ZW.33.38.D05.1.454.CMB.1.raw
  modified_base (242)..(242): a, c, t, g, unknown or other
  misc_feature (242)..(242): n is a, c, g, or t
  modified_base (258)..(292): a, c, t, g, unknown or other
  misc_feature (258)..(292): n is a, c, g, or t
tcagtacacacactcacgaccggtgctcgatttagtatctgatagttgggtttgggacgagagttcactctcaccatcagcggcctccagtctgaagattttgcagtttattactgtcagcagtatactaactggcctcccatcgtacacttttggccaggggaccaagctggagatcaaaacgaactgtggctgcaccatctgtctcatctccgccatctgaaggtctgtactgagcgggntggcaaggcgcatagnnnnnnnnnnnnnnnnnnnnnnnnnnnnnnnnnnn

SEQ ID NO: 39004 - DNA, 510 bp, Homo sapiens
  misc_feature: GYAE6OF01BTRCF.33.38.D05.1.454.CMB.1.raw
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttactcttttaagaggtgtccagtgtcaggtgcagctggtggagtctgggggagcgtggtccagcctgggagtccctcagactctcctgtgcagcgtctggattcaccttcagtagccatgatatgcactgggtccgccaggccccaggcaaggggctgggagtgggtggcagttatatggtatggagggaataatcaatactatgcagactccgtagagggccgattcaccatctcagagacaattccaagaacacgctagtactctgacaaagtggacagcctagatagacgacgacacggctagtatattactgtgacgagagaggtggaggggtgtggggacg

SEQ ID NO: 39005 - DNA, 263 bp, Homo sapiens
  misc_feature: GYAE6OF01DJHS5.33.38.D05.1.454.CMB.1.raw
  modified_base (259)..(263): a, c, t, g, unknown or other
  misc_feature (259)..(263): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtacacttttggccaggggaccaagctggagatcaaacgaactgtggctgcaccatctgtcttcatcttcccgcatctgaagtgtgtgtactggagcgggctggcaaggcgcatagnnnnn

SEQ ID NO: 39006 - DNA, 591 bp, Homo sapiens
  misc_feature: GYAE6OF01CJ9GZ.33.38.D05.1.454.CMB.1.raw
  modified_base (177)..(177): a, c, t, g, unknown or other
  misc_feature (177)..(177): n is a, c, g, or t
  modified_base (245)..(245): a, c, t, g, unknown or other
  misc_feature (245)..(245): n is a, c, g, or t
  modified_base (311)..(311): a, c, t, g, unknown or other
  misc_feature (311)..(311): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttactcttttaagnggtgtccagtgtcaggtgcagctgggtggagtcgtgggggagcgtggtccagccgtggggagtccctnagactctcctgtgcagcgtctggattccaccttcagtacgccatgatatgccacgtcggggtcccnccgacggccccagggccgaagggggctgggaggtggggtgctagttatagtggtatgggaagggtaataatcgaaatacgtatgacaggtacctccggtagaacgggcctaaacgttccaacctactccctaccgaagtaacgtaacgaacttaccaaacgaaccacgactagtatctagaacaaatggaactagcctagaactagaacgacgacgacggctagtactattacgtgtagacggaagtaacgtaaggttgggaagggggtgtcggggtacg

SEQ ID NO: 39007 - DNA, 657 bp, Homo sapiens
  misc_feature: GYAE6OF01C9ETN.33.38.D05.1.454.CMB.1.raw
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagcttgggttttcctcgttactcttttaagaggtgtccagtgtcaggtgcagctgggtggagtcgtggggggaggcgtggtccagccgtggggacgtccctgagactctcctggtgcagccgtctggacttcaccttcagtacgccatgatatgcacgtgggtcccnccacggccccaggccaaggggctgggagtgggngacagttatagtggtataggaagggtaataatcgaaattactagtcgacagtaccgtccggtaggaacgggcctaattccgaacctactccctaccgaagaactaactaacttaccaaaacgaaccgacgtcttacgtactacgttacgaactaaaggtcgaaccgtacgaccgttaagaacgtaacggaccggtaaaccgaccggtaccggtaccttaggtaacttaacgtttacgtggttacggacggtaaaggtaacgggttaacgggttaggggaacggggggttaggttcggggggtaaacccgg

SEQ ID NO: 39008 - DNA, 264 bp, Homo sapiens
  misc_feature: GYAE6OF01CQKKP.33.38.D05.1.454.CMB.1.raw
  modified_base (261)..(264): a, c, t, g, unknown or other
  misc_feature (261)..(264): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtacacttttggccaggggaccaagctggagatcaaacgaactgtggctgcaccatctgtcttcattcttcccgccatctgaagtgtgtgtactggagcgggctggcaaggcgcatagnnnn

SEQ ID NO: 39009 - DNA, 623 bp, Homo sapiens
  misc_feature: GYAE6OF01DRJC4.33.38.D05.1.454.CMB.1.raw
tcagtacacacactcacgaccggtgctcgatttagtatctgatagttgggtttggtgctgggagaggagcccagcactagaagtcggcggtgtttccattcggtgatcagcactgaacacagaggactcaccatggagtttgggctgagcttgggttttcctcgttactcttttaagaggtgtccagtgtcaggtgcagctggtggagtcgtgggggagcgtggtccagccgtgggacgtccctcagacctctcctgtgcagcgtctggattcaccttcagtagccatgatatgcacgtgggtccgccacggccccaggcgaaaggggctgggagtggggtggcagttatagtggtatggaagggaaagtaagtactaaagtacctaagtcgacgaagtaccgttccggtaggtaaacggggcccgtaacttccgaaccctacgtcctaccgaagacgaactaaacgttacccaaagaaccaacgtactagtactactagactaaaagtgggaacacggtcctaggacgtaagaaccgtaccgaacgaccgggacttaggttattaattacgttgttacggacggtaggaaggtaaggttgggaagggggtaggtacgggggg

SEQ ID NO: 39010 - DNA, 573 bp, Homo sapiens
  misc_feature: GYAE6OF01AJ9D3.33.38.D05.1.454.CMB.1.raw
  modified_base (242)..(242): a, c, t, g, unknown or other
  misc_feature (242)..(242): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttactcttttaagaggtgtccagtgtcaggtgcagctggtggagtcgtgggggagcgtggtccagcctgggagtccctnagactctcctgtgcagcgtctggattcaccttcagtagccatgatatgccactcggggtcccgccagggcccccagggccgaagggggctgggaggtgggtggctagttatagtggtatggaagggaagtaagtcaaatactatgacgagactcggtaggaagggccgattaccaccatcctcaagagacaattaccaaagacacgctagtatctgaccaaagtcggaacacgacctagataacgacgacgaccgacggtctacggtattaattacgtgtacgtcggaagtaaggtaacggttagggagggggtaggttgggggtaaccgg

SEQ ID NO: 39011 - DNA, 366 bp, Homo sapiens
  misc_feature: GYAE6OF01CB4OD.33.38.D05.1.454.CMB.1.raw
  modified_base (265)..(265): a, c, t, g, unknown or other
  misc_feature (265)..(265): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
  modified_base (316)..(366): a, c, t, g, unknown or other
  misc_feature (316)..(366): n is a, c, g, or t
tcagtacacacactcacgaccggtgctcgatttagtatctgatagtggggtttgggacagagttcactctcaccatcagcggcctccagtctgaagtatttgcctagtttatactgtcagcagtatactaactggcctcccatggtactacttttggaccaggggaccaagtcctaggagactaccaaacgaacgtggtcggctgaccacaactccgtggtcttcaattccttcccggccagtccgtagaacgtgtgtagttacngagtcggctggcaaggcanaagtgctncgcagcttaagcttnacagttgcnnnnnnnnnnnnnnnnnnnnnnnnnnnnnnnnnnnnnnnnnnnnnnnnnnn

SEQ ID NO: 39012 - DNA, 366 bp, Homo sapiens
  misc_feature: GYAE6OF01C6F9O.33.38.D05.1.454.CMB.1.raw
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
  modified_base (282)..(283): a, c, t, g, unknown or other
  misc_feature (282)..(283): n is a, c, g, or t
  modified_base (294)..(294): a, c, t, g, unknown or other
  misc_feature (294)..(294): n is a, c, g, or t
  modified_base (296)..(297): a, c, t, g, unknown or other
  misc_feature (296)..(297): n is a, c, g, or t
  modified_base (299)..(299): a, c, t, g, unknown or other
  misc_feature (299)..(299): n is a, c, g, or t
  modified_base (301)..(366): a, c, t, g, unknown or other
  misc_feature (301)..(366): n is a, c, g, or t
tcagtacacacactcacgaccggtgctcgatttagtatctgataggtggggtttgggacagagttcactctcaccatcagcggcctccagtctgaagattttgcagtttattactgtccagcagtatactaactggccctcccaatgtacacttttggaccagggggaccaagctggagatcaaaacgaactgtaggctgccaccatctgtctcatcctcccgccatctagaagtntgtgtactgaggcggcnggactaaggccgtacaagtagctagncanncgtgacattcngnntnannnnnnnnnnnnnnnnnnnnnnnnnnnnnnnnnnnnnnnnnnnnnnnnnnnnnnnnnnnnnnnnnn

SEQ ID NO: 39013 - DNA, 657 bp, Homo sapiens
  misc_feature: GYAE6OF01EDVVR.33.38.D05.1.454.CMB.1.raw
  modified_base (583)..(583): a, c, t, g, unknown or other
  misc_feature (583)..(583): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttccttgtttctgtcctagaggtgtccattctgttgtgcagctggtggaggtcggggggaggtcgttgggtaccggccggggggtctcgtaagactctcctgtgcagcctccggaatcagattcaccagtcgtttcggccttcacgtcgggtccgcccgaggtccgtccggtaggggaacggggtcgtgggaggtggctgtcatagtgtcttcgtggaggtgagttggtcgtcgttcgttcgtacggcggtactcgtggtggacgggccgtattcgagtcctaccgttaccgaaggtaacgaacccaaaccgacccaaaccgtaaccctccccgtagacctactcccgtaccgagtaacgtaccgggaacccaaccgtcggaaccgacggaccggccggaacacggacttaatacttacgtttacgnggttacgaaccggtataacggttaaccttagtacgacgtaaggtacggttccgggttggggtcggtcgtccggg

SEQ ID NO: 39014 - DNA, 275 bp, Homo sapiens
  misc_feature: GYAE6OF01BZ1XP.33.38.D05.1.454.CMB.1.raw
  modified_base (270)..(275): a, c, t, g, unknown or other
  misc_feature (270)..(275): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtactacttttggccgaggggaccaagctggagatacaaacgaactgtggctgcaccatctgtcttcatccttcccgccatctagtaagtgtgtgtactggaggcgggcgtggcaaggccgacatagnnnnnn

SEQ ID NO: 39015 - DNA, 270 bp, Homo sapiens
  misc_feature: GYAE6OF01EXP8K.33.38.D05.1.454.CMB.1.raw
  modified_base (261)..(261): a, c, t, g, unknown or other
  misc_feature (261)..(261): n is a, c, g, or t
  modified_base (264)..(270): a, c, t, g, unknown or other
  misc_feature (264)..(270): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtactacttttggccgaggggaccaagctggagatacaaacgaactggtggctgcaccatctgtcttcactcctcccgccatctgtaagtgtgtgtactggaggcggctggacgagcanagnnnnnnn

SEQ ID NO: 39016 - DNA, 260 bp, Homo sapiens
  misc_feature: GYAE6OF01CO2SP.33.38.D05.1.454.CMB.1.raw
  modified_base (253)..(260): a, c, t, g, unknown or other
  misc_feature (253)..(260): n is a, c, g, or t
tcagtacacacactcacgaccggtgctcgatttagtatctgatagtgggtttgggacagagttcactctcaccatcagcggcctccagtctgaagattttgcagtttattactgtcagcagtacggtagttcatctccgacgttcggccaagggaccaaggtggaaatcaaacgaactgtggctgcacacctctgtcttcatcttcccgccatctgaagtgtgtgtactgagcgggctggcaaggcgcatagnnnnnnnn

SEQ ID NO: 39017 - DNA, 355 bp, Homo sapiens
  misc_feature: GYAE6OF01AJIL4.33.38.D05.1.454.CMB.1.raw
  modified_base (278)..(278): a, c, t, g, unknown or other
  misc_feature (278)..(278): n is a, c, g, or t
  modified_base (284)..(285): a, c, t, g, unknown or other
  misc_feature (284)..(285): n is a, c, g, or t
  modified_base (290)..(355): a, c, t, g, unknown or other
  misc_feature (290)..(355): n is a, c, g, or t
tcagtacacacactcacgaccggtgctcgatttagtatctgatagttgggtttggggacagagttcactctcaccatcagcggcctccagtctgaagattttgcagtttattactgtcagcagtatactaactggcctcccatgtacacttttggcctaggggaccaagctggagatcaaacgactgtggctgcacatctgtcttcatcttcccgcatctgaacgtgtagtgtacgtgacggccggcgttcgggacaacgggccgaccgtaataggancatcgnngcatnnnnnnnnnnnnnnnnnnnnnnnnnnnnnnnnnnnnnnnnnnnnnnnnnnnnnnnnnnnnnnnnnn

SEQ ID NO: 39018 - DNA, 277 bp, Homo sapiens
  misc_feature: GYAE6OF01CXRAF.33.38.D05.1.454.CMB.1.raw
  modified_base (270)..(277): a, c, t, g, unknown or other
  misc_feature (270)..(277): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtacacttttggccaggggaccaagctggagatacaaacgaactgtaggctagcaccatctagtcttcatcttcccgccatctagaagtgtgtgtactggacgcgggtctggacgaaggcgacatagnnnnnnnn

SEQ ID NO: 39019 - DNA, 803 bp, Homo sapiens
  misc_feature: GYAE6OF01ARCZZ.33.38.D05.1.454.CMB.1.raw
  modified_base (429)..(429): a, c, t, g, unknown or other
  misc_feature (429)..(429): n is a, c, g, or t
tcagtacacacactcacgaccggtgctcgatttagtatctgatagttgggtttggggctgggagagggacgcccagcactagaagtcggcggttgtttccattcggtgatcagcactgaacacgagaggactccacagtggtagttgggctgagtcgttcgggtttttccttcgtttacttacgttttaaggaggttcgtaccgtaggtcgtacgagggtgcagtcgtgggtggaggtcgggtggggggagtcggttcggtccgaggtcccggtggggtaccgtcccgtggaacgtccgttcctccgtgtcgcctacgtccttcgtcggtacttccgtacccttgacgttacgacctataggtactagtcgaccgtacggtccgggtcccgaccggacccggcccgacgggacggaggggtcgtagggnggttgggcgtacgtaggttagtacgtaggtacgtagggtaaggtaagttaacgtactaatactagtcggacgtaacggaccgtcggtaagggacggtaccgttacgtacctacccgtacgtccctaaccgagtaacgaacctaacgttaaccgaaaccgtaacccgtacgtaccgttaacttacgtcgtaacggaacgttaaacgtcgaaccgtaccggtaccgtaaggtaacgtaacggacccgaaccggtaaccgtaccgggttattaaccgttagtttaaaccgttacggtcggtaaaggaacggtaagggttaaagggttacgggttaagggggtaaacggggtttcgggggtaggggtaaacccccggg

SEQ ID NO: 39020 - DNA, 264 bp, Homo sapiens
  misc_feature: GYAE6OF01A5OX7.33.38.D05.1.454.CMB.1.raw
  modified_base (256)..(264): a, c, t, g, unknown or other
  misc_feature (256)..(264): n is a, c, g, or t
tcagtacacacactcacgaccggtgctcgatttagtatctgatagtgggtttgggacagagttcactctcaccatcagcggcctccagtctgaagattttgcagtttattactgtcagcagtatactaactggcctcccatgtacacttttggccaggggaccaagctggagatcaaacgactgtggctgcaccatctgtcttcatccttcccgcatctgaagtgtgtgtactgagcggctggcaaggcgacatgnnnnnnnnn

SEQ ID NO: 39021 - DNA, 674 bp, Homo sapiens
  misc_feature: GYAE6OF01BEZVG.33.38.D05.1.454.CMB.1.raw
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttaactcttttaagagtgtccagtgtcaggtgctagctggtggagtcgtgggggagccgtggtccagcctgggacgtccctcagctctctgtcgcagcgtctggattcaccttcagtacgccatgatatcgcacgtggtccgccgtaggcccaggcaacggggctagggaggtgggtacgcgtagttagtagtcggtaagtcggaagggtaatacgtacgtaagttaacctagtcggactacggtaccgtaccggtagggtaacgggtacccgttaacgtttacctaaccggtacttacccgtaacccgtaaggtaaccgtaaacctaacggtttacccgaaaagtaaccaaccggtctaacggttactacgtacgtaaccgaaacgtcggtaaccgtacggtacccgtaagtacgtaacgaccgaacgtaccgacggtaccttaggtattacgtacgttcgtacgacgtaagtacggtaacggtacgggaggggtcggttcggggtaacg

SEQ ID NO: 39022 - DNA, 339 bp, Homo sapiens
  misc_feature: GYAE6OF01BFUJP.33.38.D05.1.454.CMB.1.raw
  modified_base (282)..(339): a, c, t, g, unknown or other
  misc_feature (282)..(339): n is a, c, g, or t
tcagtacacacactcacgaccggtgctcgatttagtatctgatagtgggtttgggacagagttcactctcaccatcagcggcctccagtctgaagattttgcagtttattactgtcagcagtatactaactggcctcccatgtactacttttggccaggggaccaagctggagatacgaaacgaactgtcggctgcacatctgtcttcatccttcccgccatctagtaagtgtagtcgtaactggacggtcgggcttggaccgaaaggccgtacaaagtggnnnnnnnnnnnnnnnnnnnnnnnnnnnnnnnnnnnnnnnnnnnnnnnnnnnnnnnnnn

SEQ ID NO: 39023 - DNA, 843 bp, Homo sapiens
  misc_feature: GYAE6OF01EPQ7G.33.38.D05.1.454.CMB.1.raw
tcagtacacacactcacgaccggtgctcgatttagtatctgatagttgggtttggggctgggagaggagcccagcactagaagtcggcggtgtttccattcggtgatcagcactgaacacagaggactcacatggagtttgggctgagtcgttgggtttttcctcgttacttcttttaagaggtgtccagtgtcaggtgcagcgtggtggaggttcggtggggggagtcgtgggtccaggtccgtgggacgtccctgagtacctctccgtgtcgacgtaggtccgtcgtacggtactttcccgaacctttcgaaggttaaccgtaccctaagttacggtaattaacgtcggaccctaaccgggttccggggttacccccgacccggaacccggggcccccccggaaggggaccgggaaacggggggtccgttaggggtacgggttgggggttacggtcgtaaaggttttagtaaggtttagggttaagtaacggggaagggtaaagtttaacgtaacgtaaacgttaacgtagtacggaacgaacggttaccgttaccgggtaacggggtaaccgggtacccgtaacctttacccgaaccctaaccgttccctaaccgaacggaaccgtaaacttaacccgtaaccgtaaacgaaacctaccggtacgttacgttaatccgtaacgaactaaggtaccgaccgtagtaccgtacgtaagtaaccggaaccgtaaccggaccgtaccggtacttaacgttattaacgttacgttcggacgtacgggtaaaggtaacgggttaagggtaggggtaacggggttacgggttcggggtaaacccggg

SEQ ID NO: 39024 - DNA, 700 bp, Homo sapiens
  misc_feature: GYAE6OF01CCPKI.33.38.D05.1.454.CMB.1.raw
  modified_base (196)..(196): a, c, t, g, unknown or other
  misc_feature (196)..(196): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (279)..(279): a, c, t, g, unknown or other
  misc_feature (279)..(279): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagcttgggttttcctcgttactcttttaagaggtgtccagtgtcaggtncagctggtggagtcgtgggggagcgtggtccagccgtgggacgtccctnagactctcngtgcagcgtctggacttccaccttnagtacgccatgatatcgcacgtcgggtccgccgacggccccgagggcgaaggggctgggaggttggggtgcgtagtttatagtggtataggaagggtaagtaactactaaatactagtcgacaacggtaccgttccggtaggaacgggtcccgtaagtttaccgaaccctactaccgtaccgaagtacgtaactaacgttaacccgaaacgaacctaccgagttacgtactaccgttacgaacctaaagttacggaaccgtaacgtacccgtaggaacgtaaccggaccgggtaaccgaaccggtaccggtacttacggtttaacgttaacgtttaacggttacgtacggaccggtaaagggtaacgggtaaggggtttaaggggtaacgggggggttagggttacgggggggtaacccgg

SEQ ID NO: 39025 - DNA, 696 bp, Homo sapiens
  misc_feature: GYAE6OF01B54OW.33.38.D05.1.454.CMB.1.raw
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (301)..(301): a, c, t, g, unknown or other
  misc_feature (301)..(301): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttggctgagcgttgggttttcctcgttacttcttttaagaggtcgtccagtgtcaggtncagctggtggagtcgtgggggagcgtggtccagccgtgggacgtcccnagctctcgtgngcagtcgtctggtacttctaccttacgagtcgcctatgatacgngaccgtacgttcgggtcccgccgaccggcccgaagggtcggaacggggtccgttagggaagggttggggtacggtacgtaggtttaagtcggttaggtacggtaggaagggttaaataactacgttaaatacgtagtcgatacggtaccgtcggagtaaccggtcctacgtaccaactacgtccctacgaagtaacaactaacctaccgaaacgaccgtacgtctacgtactacgtagaacgtaacgtacgaacgtccgtacgtacgaaggtaaccgaccgtaacggtaccgacggttaaccgtagttaaccgtttagttaccggttcggtaaggacggtaagtaaacgggttagggtaggggttacgggggtacggttaacgggggttaacccg

SEQ ID NO: 39026 - DNA, 775 bp, Homo sapiens
  misc_feature: GYAE6OF01ANIES.33.38.D05.1.454.CMB.1.raw
  modified_base (372)..(372): a, c, t, g, unknown or other
  misc_feature (372)..(372): n is a, c, g, or t
tcagtacacacactcacgaccggtgctcgatttagtatctgatagttgggtttgggggctgggagaggagcccagcactagaagtcggcggtgtttccattcggtgatcagcactgaacacgagaggactcaccagttggacgtttgggctgagtcgttggggttttccctcgttaacttgtttttaaacgaggttcgttccagttcgtcgacggttcgacgagcgttgggtggtacgttcggttggggggagccggttcggtacccgaggtccggtggggtacggttcccctagtaaccgggacctttccgtcccgttggtcggccacggtccggttaggtcgggtatttacctaccgtttagacggtacnccgtatagtataacgtcgcgtaccggttcgggtcccaccggtacggcccccgtaggccggtaaaggggtcgtagggttaacggtcgggttacggtaccgagttttagacgttggaacggtggaaacggttacgtaattaccgaaatttacctagtccacgtaacggcttaccgggtaggaccggtacctagttacccacgtactccgtaaccgaggtaactaactaaccgttacgaaacgtaccacgtcgtacgtataccgtataccgtaagttcggactaacggttctagaactacgtaaccggacgcggtaaaccggtcgtaagtacttacggtacgtggttcccgaggttaaacggacggggttaggttacggggcggggtttaggtaccggggtaaccg

SEQ ID NO: 39027 - DNA, 268 bp, Homo sapiens
  misc_feature: GYAE6OF01DHEPX.33.38.D05.1.454.CMB.1.raw
  modified_base (265)..(268): a, c, t, g, unknown or other
  misc_feature (265)..(268): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggccctcccatgtactacttttggccgaggggaccaagctggagatacaaacgaactgtgctgcacatctgtcttcatccttcccgctatctgaagtgtgtgtactgaggcggcgtggcaagggcgcaatagnnnn

SEQ ID NO: 39028 - DNA, 727 bp, Homo sapiens
  misc_feature: GYAE6OF01D4P21.33.38.D05.1.454.CMB.1.raw
  modified_base (179)..(179): a, c, t, g, unknown or other
  misc_feature (179)..(179): n is a, c, g, or t
  modified_base (277)..(277): a, c, t, g, unknown or other
  misc_feature (277)..(277): n is a, c, g, or t
  modified_base (376)..(376): a, c, t, g, unknown or other
  misc_feature (376)..(376): n is a, c, g, or t
tcagtacacacactcacgaccggtgctcgatttagtatctgatagttgggtttggggctggggagaggagcccagcactagaagtcggcggtgtttccattcggtgatcagcactgaaccacagaggactcaccatggagtttggctgagcttgggttttcctcgttactcttttaagnggtcgtccagttgtcaggtgcagcgtggtggagtcgtgggggacgcgtggtccagtccgtgggacgtccctcagtacctcgcctgtacgcagcgtcgnggtaacttcaccttcacgtacgaccagtacgtatacgtcgactacggtcgggtcccgccgacggaccccgaggacggtaagggcgtagggaggttgggnggtctagttagtagtagggtacgagggtaagggtaattaacgtaacaaacgttaactagtagtacgtacgtaacccgtaccgggttaaggaaccggtacggtaccttaaccgtaccgtacttcccgtaccgtaacggaaccgtaaacttaaccgttaacgaaaccgtaaccgtaaccgttacgtacgttaccgttactacggtaacgtaacgtaacggaacgtaccggtacgttacgaacgtaccgaccggaacgaacccgtaacgtagttaacgttagttaagttaaccggttgaagggtccgtaaggtaggtaaggttacggggaaggggtcgggttgggggtaacccg

SEQ ID NO: 39029 - DNA, 261 bp, Homo sapiens
  misc_feature: GYAE6OF02F348H.33.38.D05.1.454.CMB.1.raw
  modified_base (258)..(261): a, c, t, g, unknown or other
  misc_feature (258)..(261): n is a, c, g, or t
tcagtacacacactcacgaccggtgctcgatttagtatctgatagttgggtttgggacagagttcactctcaccatcagcggcctccagtctgaagatttgcagtttattactgtcagcagtatactaactggcctcccatgtacacttttggccaggggaccaagctggagatcaaacgaactgtggctgcaccatctgtcttcatcttcccgccatctgaagtgtgtgtactgagcgggctggcaaggcgcatagnnnn

SEQ ID NO: 39030 - DNA, 174 bp, Homo sapiens
  misc_feature: GYAE6OF02GL8NI.33.38.D05.1.454.CMB.1.raw
  modified_base (172)..(174): a, c, t, g, unknown or other
  misc_feature (172)..(174): n is a, c, g, or t
tcagtacacacactcacgaccggtgctcgatttagtatctgatagttgggtttggggaagaggaagactgacggtcccccaggagttcaggtgctgggcacagcggccctgggctgcctggtcaaggactacttccagtgtgtgtactgagcgggctggcaaggcgcatagnnn

SEQ ID NO: 39031 - DNA, 259 bp, Homo sapiens
  misc_feature: GYAE6OF02H31F4.33.38.D05.1.454.CMB.1.raw
  modified_base (257)..(259): a, c, t, g, unknown or other
  misc_feature (257)..(259): n is a, c, g, or t
tcagtacacacactcacgaccggtgctcgatttagtatctgatagttgggtttgggacagagttcactctcaccatcagcggcctccagtctgaagatttgcagtttattactgtcagcagtatactaactggcctcccatgtacacttttggccaggggaccaagctggagatcaaacgactgtggctgcaccatctgtcttcatcttcccgccatctgaagtgtgtgtactgagcgggctggcaaggcgcatagnnn

SEQ ID NO: 39032 - DNA, 260 bp, Homo sapiens
  misc_feature: GYAE6OF02FM0C4.33.38.D05.1.454.CMB.1.raw
  modified_base (258)..(260): a, c, t, g, unknown or other
  misc_feature (258)..(260): n is a, c, g, or t
tcagtacacacactcacgaccggtgctcgatttagtatctgatagttgggtttgggacagagttcactctcaccatcagcggcctccagtctgaagatttgcagtttattactgtcagcagtatactaactggcctcccatgtacacttttggccaggggaccaagctggagatcaaacgaactgtggctgcaccatctgtcttcatcttcccgccatctgaagtgtgtgtactgagcgggctggcaaggcgcatagnnn

SEQ ID NO: 39033 - DNA, 173 bp, Homo sapiens
  misc_feature: GYAE6OF02IIHLB.33.38.D05.1.454.CMB.1.raw
  modified_base (173)..(173): a, c, t, g, unknown or other
  misc_feature (173)..(173): n is a, c, g, or t
tcagtacacacactcacgaccggtgctcgatttagtatctgatagttgggtttgggggaagaggaagactgacggtcccccaggagttcaggtgctgggcacagcggccctgggctgcctggtcaaggactacttccagtgtgtgtactgagcgggctggcaaggcgcatagn

SEQ ID NO: 39034 - DNA, 259 bp, Homo sapiens
  misc_feature: GYAE6OF02INQA0.33.38.D05.1.454.CMB.1.raw
  modified_base (258)..(259): a, c, t, g, unknown or other
  misc_feature (258)..(259): n is a, c, g, or t
tcagtacacacactcacgaccggtgctcgatttagtatctgatagttgggtttgggacagagttcactctcaccatcagcggcctccagtctgaagatttgcagtttattactgtcagcagtatactaactggcctcccatgtacacttttggccaggggaccaagctggagatcaaacgaactgtggctgcaccatctgtcttcatcttcccgccatctgaagtgtgtgtactgagcgggctggcaaggcgcatagnn

SEQ ID NO: 39035 - DNA, 261 bp, Homo sapiens; identical to SEQ ID NO: 38994
  misc_feature: GYAE6OF02HFCXK.33.38.D05.1.454.CMB.1.raw
  modified_base (259)..(261): a, c, t, g, unknown or other
  misc_feature (259)..(261): n is a, c, g, or t

SEQ ID NO: 39036 - DNA, 263 bp, Homo sapiens; identical to SEQ ID NO: 38996
  misc_feature: GYAE6OF02HTQZP.33.38.D05.1.454.CMB.1.raw
  modified_base (259)..(263): a, c, t, g, unknown or other
  misc_feature (259)..(263): n is a, c, g, or t

SEQ ID NO: 39037 - DNA, 182 bp, Homo sapiens
  misc_feature: GYAE6OF02HGULG.33.38.D05.1.454.CMB.1.raw
  modified_base (172)..(182): a, c, t, g, unknown or other
  misc_feature (172)..(182): n is a, c, g, or t
tcagtacacacactcacgaccggtgctcgatttagtatctgatagttgggtttagggggaagaggaagactgacggtcccccaggagttcaggtgctgggcacagcggcctgggctgcctggtcaaggctacttccagtgtgtgtactgagcgggctggcaaggcgcatagnnnnnnnnnnn

SEQ ID NO: 39038 - DNA, 178 bp, Homo sapiens
  misc_feature: GYAE6OF02GHWTH.33.38.D05.1.454.CMB.1.raw
  modified_base (173)..(178): a, c, t, g, unknown or other
  misc_feature (173)..(178): n is a, c, g, or t
tcagtacacacactcacgaccggtgctcgatttagtatctgatagttgggtttgggggaagaggaagactgacggtcccccaggagttcaggtgctgggcacagcggccctgggctgcctggtcaaggactacttccagtgtgtgtactgagcgggctggcaaggcgcatagnnnnnn

SEQ ID NO: 39039 - DNA, 517 bp, Homo sapiens
  misc_feature: GYAE6OF02JX70A.33.38.D05.1.454.CMB.1.raw
  modified_base (242)..(242): a, c, t, g, unknown or other
  misc_feature (242)..(242): n is a, c, g, or t
  modified_base (437)..(437): a, c, t, g, unknown or other
  misc_feature (437)..(437): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttactcttttaagaggtgtccagtgtcaggtgcagctggtggagtctgggggagcgtggtccagcctgggaggtccctnagactctcctgtgcagcgtctggattcaccttcagtagccatgatatgcactgggtccgccaggccccaggcgaaggggctggaggtgggtggcaggttatagtgggtatggaggggaataatacgaatactatgacagactccgtgaagggccgatcaccatctccagagacaattccaagaacacgctagtanctgacaatagacagcctgatagacgacgacacggctagtatattactgtgcgagagtaagtggaggggtagtggggtacg

SEQ ID NO: 39040 - DNA, 259 bp, Homo sapiens
  misc_feature: GYAE6OF02HJZ7I.33.38.D05.1.454.CMB.1.raw
  modified_base (257)..(259): a, c, t, g, unknown or other
  misc_feature (257)..(259): n is a, c, g, or t
tcagtacacacactcacgaccggtgctcgatttagtatctgatagtgggtttgggacagagttcactctcaccatcagcggcctccagtctgaagatttgcagtttattactgtcagcagtatactaactggcctcccatgtacacttttggccaggggaccaagctggagatcaaacgaactgtggctgcaccatctgtcttcatcttcccgccatctgaagtgtgtgtactgagcgggctggcaaggcgcatagnnn

SEQ ID NO: 39041 - DNA, 278 bp, Homo sapiens
  misc_feature: GYAE6OF02G6FVD.33.38.D05.1.454.CMB.1.raw
  modified_base (233)..(233): a, c, t, g, unknown or other
  misc_feature (233)..(233): n is a, c, g, or t
  modified_base (261)..(278): a, c, t, g, unknown or other
  misc_feature (261)..(278): n is a, c, g, or t
tcagtacacacactcacgaccggtgctcgatttagtatctgataggtgggtttgggacagagttcactcgtcaccatcagcggcctccagtctgaagattttgcagtttattactgtcagcagtatactaactggcctcccatgtacacttttggccagggggaccaagctggagatcaaacgaactgtggctgcaccatctgtcttcatcttcccgccatctgaagtgtgtntactgagcgggctggcaaggcgcatagnnnnnnnnnnnnnnnnnn

SEQ ID NO: 39042 - DNA, 256 bp, Homo sapiens
  misc_feature: GYAE6OF02IR00V.33.38.D05.1.454.CMB.1.raw
  modified_base (254)..(256): a, c, t, g, unknown or other
  misc_feature (254)..(256): n is a, c, g, or t
tcagtacacacactcacgaccggtgctcgatttagtatctgatagttgggtttgggacagagttcactctcaccatcagcggcctccagtctgaagatttgcagtttattactgtcagcagtatactaactgtcctccatgtacactttggccagggaccaagctggagatcaaacgaactgtggctgcaccatctgtcttcatcttccgccatctgaagtgtgtgtactgagcgggctggcaaggcgcatagnnn

SEQ ID NO: 39043 - DNA, 261 bp, Homo sapiens; identical to SEQ ID NO: 38994
  misc_feature: GYAE6OF02FOKU0.33.38.D05.1.454.CMB.1.raw
  modified_base (259)..(261): a, c, t, g, unknown or other
  misc_feature (259)..(261): n is a, c, g, or t

SEQ ID NO: 39044 - DNA, 261 bp, Homo sapiens
  misc_feature: GYAE6OF02H0CZK.33.38.D05.1.454.CMB.1.raw
  modified_base (257)..(261): a, c, t, g, unknown or other
  misc_feature (257)..(261): n is a, c, g, or t
tcagtacacacactcacgaccggtgctcgatttagtatctgatagttgggtttgggacagagttcactctcaccatcagcggcctccagtctgaagatttgcagtttattactgtcagcagtatactaactggcctcccatgtacacttttggccaggggaccaagctggagatcaaacgaactgtggctgcaccatctgtcttcatcttccgccatctgaagtgtgtgtactgagcgggctggcaaggcgcatagnnnnn

SEQ ID NO: 39045 - DNA, 510 bp, Homo sapiens
  misc_feature: GYAE6OF02IK0T7.33.38.D05.1.454.CMB.1.raw
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttactcttttaagaggtgtccagtgtcaggtgcagctggtggagtcgtgggggaggcgtggtccagcctggggaggtcccctcagactctcctgtgcagcgtctggattcaccttcagtagccatgatatgcacgtgggtccgccgaggccccaggcaaggggctgggagtgggtgcagtatatggtatgagggaataatcaaatactatgcagactcgtagaggccgatcacatctccagagacaattaccaagaacacgctgtatactgacaatagacagcctgatagacgacgacgacgctagtatattacgtgtgcgagagagttggaggggtagtggggacg

SEQ ID NO: 39046 - DNA, 661 bp, Homo sapiens
  misc_feature: GYAE6OF02FQBX7.33.38.D05.1.454.CMB.1.raw
tcagtacacacactcacgaccggtgctcgatttagtatctgatagttggggcacccaggacctacatctgcaacgtgaatcgaacaagcccagcaacgaccaaggtcggacaacgaaagttgacgcccaaatcttgtgacaaaactcagactctcctgtgcagcgtctggattcaccttcagtagccatgatacgtgacactgggtccgccacggccccaggcaaggggctggagtgggtggcagttaatatggttatgaggagtaagtcaatactatgccagactccgtgaagggccattcgaccatcgtccagacgacaattccaagaacacgctgtatcgtgacaaatcggaacgagccgtgaatagacgacgacacggctggactagttacgtgtgacgagagtaagttggaaggggtagttgggggactaacggtcggtaccccgtttagaaccgttacgtggggacccgtaaggggaacccttgggtaccgtaacccgggtccttcccgtcggaccggtcccgtaccgaacccggtaccgggccccgtaacggttcccgggttaccctttccccccggtacggtaccccgtaccccgttccccgttaccccggaaaccggtaccgtacccttaacccgtccggttaccccggggg

SEQ ID NO: 39047 - DNA, 265 bp, Homo sapiens
  misc_feature: GYAE6OF02JXON4.33.38.D05.1.454.CMB.1.raw
  modified_base (259)..(265): a, c, t, g, unknown or other
  misc_feature (259)..(265): n is a, c, g, or t
tcagtacacacactcacgaccggtgctcgatttagtatctgatagttgggtttgggacagagttcactctcaccatcagcggcctccagtctgaagattttgcagtttattactgtcagcagtatactaactggcctcccatgtacacttttggccaggggaccaagctggagatcaaacgaactgtggctgcaccatctgtcttcatcttcccgccatctgaagtgtgtgtactggagcggctggcaaggcgcatagnnnnnnn

SEQ ID NO: 39048 - DNA, 518 bp, Homo sapiens
  misc_feature: GYAE6OF02GQJQ7.33.38.D05.1.454.CMB.1.raw
  modified_base (241)..(241): a, c, t, g, unknown or other
  misc_feature (241)..(241): n is a, c, g, or t
  modified_base (333)..(333): a, c, t, g, unknown or other
  misc_feature (333)..(333): n is a, c, g, or t
  modified_base (402)..(402): a, c, t, g, unknown or other
  misc_feature (402)..(402): n is a, c, g, or t
  modified_base (438)..(438): a, c, t, g, unknown or other
  misc_feature (438)..(438): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttactcttttaagaggtgtccagtgtcaggtgcagctggtggagtctgggggagcgtggtccagcctgggagtccctnagactctcctgtgcagcgtctggattcaccttcagtagccatgatatgcactgggtccgccacggccccaggcgaaggggctgggagtgggngcagttatagtggtatggaagggaagtaatcaatactatgcagctcgtgaacggcatcacatctcaganacaatccaagacacgctatatctagacaagtcgacngcctagatagacgacgacgacggtctagtaattacttactgtagacgagaggtaaggtgggaaggggtagttggggaacg

SEQ ID NO: 39049 - DNA, 487 bp, Homo sapiens
  misc_feature: GYAE6OF02IBWOO.33.38.D05.1.454.CMB.1.raw
  modified_base (148)..(148): a, c, t, g, unknown or other
  misc_feature (148)..(148): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (329)..(330): a, c, t, g, unknown or other
  misc_feature (329)..(330): n is a, c, g, or t
  modified_base (333)..(334): a, c, t, g, unknown or other
  misc_feature (333)..(334): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
tcagtacacacactcacgaccggtgctcgatttagtatctgatagtggggttgggacagagttcactctcacatcagcggctccagtctgaagatttgcagtttatactgtcagcatatactaactgcctccatgtacactttgaccngggaccaagcctggagatccaaacgacgtgtggcctgaccacactcgtgtccttcattcctccgaccagtcgtagtaagtcgtgtacgtaactgaagtcggtcctaggcgaacggtcactatacgtagctggcagcagctcgcancngcancgtgctcatcgnacgtcgattccngtnagnntcnnctacgngctagcgacttntacgcngtncgacgcgtacgtagtagacacgtacgacgtatacgtacgtactacgacacgagtacgagacgtanatacncngtacgtcgagtcgacgagcgtactgcgctacgatcgngagcgtcngactcgtnc

SEQ ID NO: 39050 - DNA, 529 bp, Homo sapiens
  misc_feature: GYAE6OF02JDSGE.33.38.D05.1.454.CMB.1.raw
  modified_base (242)..(242): a, c, t, g, unknown or other
  misc_feature (242)..(242): n is a, c, g, or t
  modified_base (410)..(410): a, c, t, g, unknown or other
  misc_feature (410)..(410): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttactcttttaagaggtgtccagtgtcaggtgcagctggtggagtcgtgggggagcgtggtccagcctgggagtccctnagactctcctgtgcagcgtctggattcaccttcagtagccatgatatgcacgtgggtccgccacggccccaggccaaggggctgggaggtgggtgcgtagttatagtggtatggaagggaagtaatcaaatactatgcagactcgtgaacggcgatcacatctcaganacatccaagacacgctagtatctagacaaatcggacacgcctagaacgtacgacgacgacgacggctagtaactattacgtgtacgacgagaggaaggttgggaggggtagtggggacg

SEQ ID NO: 39051 - DNA, 646 bp, Homo sapiens
  misc_feature: GYAE6OF02IQYWZ.33.38.D05.1.454.CMB.1.raw
  modified_base (314)..(314): a, c, t, g, unknown or other
  misc_feature (314)..(314): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttactcttttaagaggtgtccagtgtcaggtgcagctggtggagtcgtgggggaggcgtggtccagccgtgggacgtccctcgagactcctccgtgtgccagcgttctggtattccacccttcagtacgccatgatatgcacgtgggtccnccacggccccaggcaaggggctgggagtgggtggctagttatagtggtatggaagggtaagtaatcaaagtactaatgacacggaccgttccggtaggaacgggccgtaacttccaaccctatcctccgaagtaacgaactaaacttaccaaagtaaccaccgtctacgtataccgtagacgtaaagtcggaactacgtaccgtagtaaacgtaacgaaccggaacgaaccgtaccggtacttaggttaacttaacgttacgtaggtacggaaccggtaggtaacgggtaagggttacggggaaggggggttacggttagggggtaacccgg

SEQ ID NO: 39052 - DNA, 306 bp, Homo sapiens
  misc_feature: GYAE6OF02JD5R7.33.38.D05.1.454.CMB.1.raw
  modified_base (254)..(256): a, c, t, g, unknown or other
  misc_feature (254)..(256): n is a, c, g, or t
  modified_base (258)..(259): a, c, t, g, unknown or other
  misc_feature (258)..(259): n is a, c, g, or t
  modified_base (261)..(306): a, c, t, g, unknown or other
  misc_feature (261)..(306): n is a, c, g, or t
tcagtacacacactcacgaccggtgctcgatttagtatctgatagttgggtttgggacagagttcactctcaccatcagcggcctccagtctgaagattttgcagtttattactgtcagcagcgtagcaactggtcttggacgttcggtcaagggaccaaggtggaaatcaaacgaactgtggctgcaccatctgtcttcattcttcccgccatctgaagtgtgtgtactgagcgggctggcaaggcgcatagnnngnnannnnnnnnnnnnnnnnnnnnnnnnnnnnnnnnnnnnnnnnnnnnnn

SEQ ID NO: 39053 - DNA, 622 bp, Homo sapiens
  misc_feature: GYAE6OF02H8SJP.33.38.D05.1.454.CMB.1.raw
  modified_base (245)..(245): a, c, t, g, unknown or other
  misc_feature (245)..(245): n is a, c, g, or t
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (578)..(578): a, c, t, g, unknown or other
  misc_feature (578)..(578): n is a, c, g, or t
tcagtacacacactcacgaccggtgctcgatttagtatctgatagttgggtttggtgctgggagaggagcccagcactagaagtcggcggtgtttccattcggtgatcagcactgaacacagaggactcaccatggagtttgggctgagcttgggttttcctcgttactcttttaagaggtgtccagtgtcaggtgcagctggtggagtcgtgggggagcgtggtccagccgtgggaggtccctnagctctctgtgcagcgtctggattcaccttcagtagccatgaatatcgcacgtcgggtccnccgacggccccagggcgaaggggctgggagtggggnggtctaggttatagttggtagtggaaggggtaaattaatacgaaattactatggacagtaacccgttcggaggaacgggaccgtagttaccacctaacttctaccgaagaacgtaactaacttaacccaaagaaccacgtcgtagttactactgaactaaacgtacggacacgtaccgtagaagtaacgaccgacgacgaccggtacgtaagttacttaattacgttaggtacggngtaaggtaaggtaagggttaggggtagggggtggttacgggggg

SEQ ID NO: 39054 - DNA, 285 bp, Homo sapiens
  misc_feature: GYAE6OF02JFFC3.33.38.D05.1.454.CMB.1.raw
  modified_base (252)..(252): a, c, t, g, unknown or other
  misc_feature (252)..(252): n is a, c, g, or t
  modified_base (257)..(285): a, c, t, g, unknown or other
  misc_feature (257)..(285): n is a, c, g, or t
tcagtacacacactcacgaccggtgctcgatttagtatctgatagttgggtttgggacagagttcacttctcaccatctagcggcctccagtctgaagatttgcagtttattactgtcagcgagtatacgtaactggcctcccatcgtacacttttggccaggggaccaagctggagatcaaacgactgtgctgcacatctgtctcatccttcccgcatctgaagtgtgtgtactgagcggctggcaaggcnatagnnnnnnnnnnnnnnnnnnnnnnnnnnnnn

SEQ ID NO: 39055 - DNA, 513 bp, Homo sapiens
  misc_feature: GYAE6OF02FHLAZ.33.38.D05.1.454.CMB.1.raw
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagcttgggttttcctcgttactcttttaagaggtgtccagtgtcaggtgcagctggtggagtcgtggggggagcgtggtccagcctggggagtcccctnagctctcctgtgcagcgtctggattcaccttcagtacgccatgatatgcactgggtccnccacggccccaggcaagggggcttgggacgtggggtggcaggttatagtggtatgaggggaatatcaatactagtgcagactcgagaaggcgattcacatcctcagagacatccaaagacacgctgtatctgacaagtgacagcctagatagacgacgacacgactgtatattacgtgtcgcgagaggagttggagggtagtgggacg

SEQ ID NO: 39056 - DNA, 533 bp, Homo sapiens
  misc_feature: GYAE6OF02F4ZQA.33.38.D05.1.454.CMB.1.raw
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
  modified_base (411)..(411): a, c, t, g, unknown or other
  misc_feature (411)..(411): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagcttgggttttcctcgttactcttttaagaggtgtccagtgtcaggtgcagctggtggagtcgtgggggagcgtggtccagcctgggacgtccctnagactctcctgtgcagcgtctggattcaccttgagtagccatgatatgccacgtgggtcccnccacggcccccaggcgaagggggctgggaggtggggtgctagttatagtggtagtggaagggtaataatcaatactatgacagctcggagacggctatcacatcnccagacacaattccaagacacgctagtatcgagacaagtcgacagtctagatacgacgacgacgacgctagtaatacttacgtgtcgacgaggtaggtaggttgggaggggtgtggggaccg

SEQ ID NO: 39057 - DNA, 686 bp, Homo sapiens
  misc_feature: GYAE6OF02IHK9C.33.38.D05.1.454.CMB.1.raw
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggtttttcctcgtttactcttttaagaggtgtccagtgtcaggtgcagctggtggagtcgtgggggaggcggtggtccagccgtggggacggtccctnacgactctccctgtgcagccgtcgtggtattccacctttnaaggtacgccaattgactatgccacgtggggtcccnccgacggccccgaggccgaaggggctgggaggtgggtggcgtagttatagtggtataggaagggtaataatacgaattactaagtcgacgacgtactccggtaggaacgggtccgtacttcacctactacctacaacgacgaactaaacttaccgaaagaaccgacgacgttacgtactacgtacgacgtaaagtcggtaacgacggtaccgtagtaacgtacggtaaccggaaccgaaccgtaccggtacgttacggttaaacttaaccgttaacggtcggttacggaccggtaaggtaaagggttaacgggtttaagggggtaacggggggttacggggttacggggggtaacccggg

SEQ ID NO: 39058 - DNA, 256 bp, Homo sapiens
  misc_feature: GYAE6OF02H89FA.33.38.D05.1.454.CMB.1.raw
  modified_base (244)..(244): a, c, t, g, unknown or other
  misc_feature (244)..(244): n is a, c, g, or t
  modified_base (250)..(251): a, c, t, g, unknown or other
  misc_feature (250)..(251): n is a, c, g, or t
  modified_base (253)..(256): a, c, t, g, unknown or other
  misc_feature (253)..(256): n is a, c, g, or t
tcagtacacacactcacgaccggtgctcgatttagtatctgatagttgggtttgggacagagttcactctcaccatcagcggcctccagtctgaagattttgcagtttattactgtcagcagcgtagcaactggtcttggacgttcggtcaagggaccaaggtggaaatcaaacgactgtggctgcaccatctgtcttcatcttcccgcatctgaagtgtgtgtactgagcggctggacaggcncatagnnannnn

SEQ ID NO: 39059 - DNA, 762 bp, Homo sapiens
  misc_feature: GYAE6OF02ICKAN.33.38.D05.1.454.CMB.1.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
tcagtacacacactcacgaccggtgctcgatttagtatctgatagttgggtttggtgctgggagaggagcccagcactagaagtcggcggtgtttccattcggtgatcagcactgaacacagaggactcaccatggagtttggctgagctgggttttcctcgttactctttttaaagaggttgtccagttgtcaggtgcagctggtggagtcgngggggagcgtggtccagcctgggaggttccctgagactctcctgtcgcagccgtntggtattcacttcagtagccatnaatatcgaccacgttcgggtcccgaccgacggcccccgaggaccgtaaggggctcgggaaggttggggtacggactaggttaacgtagttacggtagtaggtaacgggtaaagttaaactaaccgtaattaaacgtaacgttacggaacgtaaggtacccgttaacggtacggtaaaccgggggtacccgtaacgttttaaccccaaacccgttaaacgttccgtaacccgtaaacggtaacggtaaacctaaaccgttacccgtaaaaacggtaaaccgaacccggttacgtaaaccgtattacgttaaccgaacgtaaagtacgggtaaaccacggtaaccctaggtaacttaaccggaaccgaccgaaccggacggttaccttaggtaaaccttagttccgttaaggtagtaccggtaagggtaaggtaaggggtttagggtaagggggtacgggtttaacgggggg

SEQ ID NO: 39060 - DNA, 573 bp, Homo sapiens
  misc_feature: GYAE6OF02GD20F.33.38.D05.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (305)..(305): a, c, t, g, unknown or other
  misc_feature (305)..(305): n is a, c, g, or t
  modified_base (369)..(369): a, c, t, g, unknown or other
  misc_feature (369)..(369): n is a, c, g, or t
  modified_base (414)..(414): a, c, t, g, unknown or other
  misc_feature (414)..(414): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggggtttcctcgttactcttttaagaggtgtccagtgtcaggtgcagctggtgagtctgggggagcgtggtccagcctgggagtccctnagactctcctgtgcagcgtctggattcaccttnagtagccatgactatcgacacgtgggtcccnccgaacggccccgaggcaaggggctagggagtgggtgcagttactatggtatggagggaataantaaatactatcgactagtactcggtagacgggtctattccgaacnctacgtaccagacaactacgttaccaaagactacgctagtactcgtagactaagcgacgcgtacctagactacggtacgacgacgacgtatagttaactaacgttcgtaggtagcggtaagtacggtaacggttgggacggggttagtggggtaaccgg

SEQ ID NO: 39061 - DNA, 596 bp, Homo sapiens
  misc_feature: GYAE6OF02HDNN6.33.38.D05.1.454.CMB.1.raw
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
tcagtacacacactcacgaccggtgctcgatttagtatctgatagtgggttgggacagagttcactctcaccatcagcggccttccgagtctgaagattttgcagtttattactgtcagcagtatactaactggcctcccatgtacacttttggaccgacggggaccaagcctggagactcaaacgactgtggctgaccacatctgtctcactcctcccgctagtctagaagtgtgtacgtacgtggacggcgggtctcggacgaacgggtcactacgtagancncgngtnacaggncncgtctgagctcgngactactcgtcacgtnactgactcacgacncacgacgtcgtactacgtacgtacgtacgactacgacgtacgtacgtacgacgtacgacgacgaaccgtctacgtacgacgtacgtacgtacgtacgtaccgtcgttacgtacgtcgtacgtacgacgtacgagtacgacgacgtacggtactacgtcggtaggtacgtaacgtacgtacgtacggtacgcggtacgtacggaccgtacgtcgtaccgttccgtaccggttaccgtaccgtacgtacccgtacg

SEQ ID NO: 39062 - DNA, 672 bp, Homo sapiens
  misc_feature: GYAE6OF02HV8UJ.33.38.D05.1.454.CMB.1.raw
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcacatggagtttgggctgagcggtggtttcgcgtaacgtcgttaacgagttgtcagtgtcaggtncagcgtggtggagtcgngggggagngtggtccagcctagggagtccctgagacttctactgtgcagctctggattcaccttgatagcatgatactgctacgtgggtccncacggcccaaggcgtaaggggctaggagtggggtcaggaattatagnggtaagtggaagggtaacttaanactaaataactattacggactaacggtaccgttacggtaggtaacggtacccgttaattaccccgtaaactacttccgaacgtaaacgaacgtaaacctaacgtaaccgaaacgaaccgaaccgtaccgtagtaccgtacgtaagtaaactaaacgtaacggtaacgtaacgtacgtacgtaacgtaacgaacgaaccgaacggtacggtacgtacgtaacgttaacgttaacggtacgtacgtaacggtaaggtaacggtaacggttaagggtaacggggtacgggttacgggtaacgg

SEQ ID NO: 39063 - DNA, 791 bp, Homo sapiens
  misc_feature: GYAE6OF02IFTJ3.33.38.D05.1.454.CMB.1.raw
  modified_base (249)..(249): a, c, t, g, unknown or other
  misc_feature (249)..(249): n is a, c, g, or t
tcagtacacacactcacgaccggtgctcgatttagtatctgatagttgggtttggggctgggagaggagcccagcactagaagtcggcggtgtttccattcggtgatcagcactgaacacagaggactcaccatggagtttgggctgagctgggttttcctcgttactcttttaagaggttgtccagtgtcaggtgcagcgtggtggagtcgtgggggagcggtggtccagccgtgggacgtccccgtnagacctctccgtgtcgcacgtcgttctaggtacttcacccttcagtacgccatcgatatgctacgtcgggtcccgaccgaccggaccccgagggaccgaacgggggtcgtagggacgggttcggggtacggtcgtaagtttacgtaagttggggttaagtagggaaacggggtaagtttaaacgtaacgtaaaacgttaccgtaagtcgaacgtaacggtacccggtttaccgggtaacgggtaaaccgggtaccttaaaaccgttccgaaccctacgttacccgttaaaccaacgggtaaaccgtaacgttaaaccgttaacccgaaaacgtaaacccgtacgtaccgttacgttactacgtacgtaaacgtaaacgttcggaaccgtacgtacccgttaagtaacgtaacggaaccgtaacggaccggtacggttaccgttaacggttaacttaacgttacggtcggttaacggtacggtaaggtaaagggttacgggttaacgggggtaacgggggttacgggttacgggggtacccgg

SEQ ID NO: 39064 - DNA, 807 bp, Homo sapiens
  misc_feature: GYAE6OF02GQ6JW.33.38.D05.1.454.CMB.1.raw
  modified_base (179)..(179): a, c, t, g, unknown or other
  misc_feature (179)..(179): n is a, c, g, or t
  modified_base (198)..(198): a, c, t, g, unknown or other
  misc_feature (198)..(198): n is a, c, g, or t
  modified_base (739)..(739): a, c, t, g, unknown or other
  misc_feature (739)..(739): n is a, c, g, or t
tcagtacacacactcacgaccggtgctcgatttagtatctgatagttgggtttggtgctgggagaggagcccagcactagaagtcggcggtgtttccattcggtgatcagcactgaacacagaggactcaccatggagtttgggctgagcttgggttttcctcgttactctttttaagnggtcgtccagtgtcaggtncagctggtggagtcgtgggggagcggtggtccagccgtgggacgtcccctgacgactctaccgtgtgcaggcgtctggattccgaccttcgagtacggccctaatcggaattagtgccgtacggtcgggtccccggccggtaccgggccccccgaagggcccgggaaacgggggtcctacggggggtaagggttcgggggttacgacggttaaggtttaacgttagttggggtaaaggttacggggaaggggttaaaaggttaacgttaaaccggtaaaactttacgttaacgtacggtacgtaaaccgggtaacccgttacccggggttacggggaaaaccgggggtcccgttaaaccgtttaaccctaaaccccgtaactttaccccgtaacccggaagttaacggtaaacccttaaaccgttaaccccaaaacggtaaacccgaccggttaacccgttagttaaccgttaccgttacggtaactaaggttaccgaaccgtacgtccgtaacgtaagaccgaacgaccgacgtaccggngttacggtaattacgttacgtgtagacgaaggtaacggtaggttagggtacggggtaggtaccggggg

SEQ ID NO: 39065 - DNA, 264 bp, Homo sapiens
  misc_feature: GYAE6OF02FHTZS.33.38.D05.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (255)..(264): a, c, t, g, unknown or other
  misc_feature (255)..(264): n is a, c, g, or t
tcagtacacacactcacgaccggtgctcgatttagtatctgatagttgggtttgggacagagttcactctcaccatcagcggcctccagtctgaagatttgcagtttattactgtcagcagtatactaactggcctcccatgtacacttttgccaggggaccaagctggagatcaaacgaactgtggctgcaccatctgtcttcatcttcccgcatctgagtntgtgtatgagcggcnggcaaggcgcatagnannnnnnnnnn

SEQ ID NO: 39066 - DNA, 196 bp, Homo sapiens
  misc_feature: GYAE6OF02FMGAR.33.38.D05.1.454.CMB.1.raw
  modified_base (145)..(145): a, c, t, g, unknown or other
  misc_feature (145)..(145): n is a, c, g, or t
  modified_base (176)..(196): a, c, t, g, unknown or other
  misc_feature (176)..(196): n is a, c, g, or t
tcagtacacacactcacgaccggtgctcgatttagtatctgatagttggggtttggggggaagaggaagactgaccggtccccccaggagttcaggtgctgggcacagcggccctgggctgcctggtcaaggactacttccagtntgtgtactgagcgggctggcaaggcgcatgnnnnnnnnnnnnnnnnnnnnn

SEQ ID NO: 39067 - DNA, 165 bp, Homo sapiens
  misc_feature: GYAE6OF02HRDO7.42.73.G07.1.454.CMB.1.raw
  modified_base (161)..(165): a, c, t, g, unknown or other
  misc_feature (161)..(165): n is a, c, g, or t
tcagtgacgtatgtcacgaccggtgctcgatttagctctacgctcagggcacgaccggtgctcgatttagcagacgtctgtcgcgggctggcaaggcgcatatctgcctggtcaaggactacttcacatacgtcactgagcgggctggcaaggcgcatagnnnnn

SEQ ID NO: 39068 - DNA, 153 bp, Homo sapiens
  misc_feature: GYAE6OF02FOQEY.42.73.G07.1.454.CMB.1.raw
  modified_base (140)..(153): a, c, t, g, unknown or other
  misc_feature (140)..(153): n is a, c, g, or t
tcagtgacgtatgtcacgaccggtgctcgatttagctctacgctcgagggctcgaaaacaccgtcccaaagaactgcgagatgtcactctgttcccgccctcctcacatacgtcactgagcggctggcaaggcgcatagnnnnnnnnnnnnnn

SEQ ID NO: 39069 - DNA, 488 bp, Homo sapiens
  misc_feature: GYAE6OF01DXTW6.41.34.D01.1.454.CMB.1.raw
  modified_base (433)..(433): a, c, t, g, unknown or other
  misc_feature (433)..(433): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccaggaaagcccctaaattcctgatctatcaggcatctaatttggaaagtgggtccatcaaggtttagcggcagtggatcgtgggacagaattcactctcacgatcagcggcctgcagcctgatgatgtcgactaactttattactgaccaacactatgattacgttacccgntcactttcggcggaggaccaaggtggagtcaagcgaactgnggctgcacntctcg

SEQ ID NO: 39070 - DNA, 473 bp, Homo sapiens
  misc_feature: GYAE6OF01AUAJ7.41.34.D01.1.454.CMB.1.raw
  modified_base (407)..(407): a, c, t, g, unknown or other
  misc_feature (407)..(407): n is a, c, g, or t
  modified_base (469)..(469): a, c, t, g, unknown or other
  misc_feature (469)..(469): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtccatcaaggtttagcggcagtggatctgggacagattcactctcacgatcagcggctgcagcctgatgatgtcgcaacttatactgccaanctatgatagttaccgctcactttcggcgaggaccaggtggagtcagcgaactgtgctgcacntctg

SEQ ID NO: 39071 - DNA, 501 bp, Homo sapiens
  misc_feature: GYAE6OF01DFB93.41.34.D01.1.454.CMB.1.raw
  modified_base (404)..(404): a, c, t, g, unknown or other
  misc_feature (404)..(404): n is a, c, g, or t
  modified_base (484)..(484): a, c, t, g, unknown or other
  misc_feature (484)..(484): n is a, c, g, or t
  modified_base (495)..(495): a, c, t, g, unknown or other
  misc_feature (495)..(495): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagattcactctcacgatcagcggcctgcagcctgatgatgtcgcaacttattacngccaactactatgatagttacccgctctacgtttcggcggtaagggaccgtaaggtgggaggtcaaggtcgaaacgtggnggctagcaccntcgtcg

SEQ ID NO: 39072 - DNA, 537 bp, Homo sapiens
  misc_feature: GYAE6OF01E0ANK.41.34.D01.1.454.CMB.1.raw
  modified_base (409)..(409): a, c, t, g, unknown or other
  misc_feature (409)..(409): n is a, c, g, or t
tcagtctatactatcacgaccggtgctcgatttagatcgtctgtggtttggggtttggggagacccagtcaggacacagcatggacatgagggtccccgctcagctcctggggtctccctgctgctctggctcccaggtgccaaatcgtgaccatccagatgacccagtctccctccattctgtctgcatctgtcggagacagagtcaccatcacttgccggccagtccagacgtattgcacacgcgttgcctggtatcagcagaaaccagggaaagcccctaaattcctgactcgtatcaggcatctaattaggaagtcgggtcccatacaaggtttagcggcagtgatctgggacagattcactctcacgactcagcgcctgcagtctgatgatgtacactaacttntactcgaccaacgactatgacttacgttacccgcttactaccgtttccggacggtacggtaccgtaagggtcggaacgggtacaacggtccgtaaccgttcggtggcctcgaccaccctagtcgttcg

SEQ ID NO: 39073 - DNA, 493 bp, Homo sapiens
  misc_feature: GYAE6OF01EU4ON.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaactttattactgccaacactatgatagttacccgctcactttcggcggtagggaccaaggtggaggtacaaggcgaactgtcggctgacaccatctcg

SEQ ID NO: 39074 - DNA, 483 bp, Homo sapiens
  misc_feature: GYAE6OF01BFYXZ.41.34.D01.1.454.CMB.1.raw
  modified_base (460)..(460): a, c, t, g, unknown or other
  misc_feature (460)..(460): n is a, c, g, or t
  modified_base (478)..(478): a, c, t, g, unknown or other
  misc_feature (478)..(478): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtccatcaaggtttagcggcagtggatcgtgggacagaattcactctcacgatcagcggcctgcagcctgatgatgtcgctaacttattactgaccaacactatgatacgttacccgctcactttggcggaggaccaggtgaggtnagcgaatgtagctgcacntctcg

SEQ ID NO: 39075 - DNA, 538 bp, Homo sapiens
  misc_feature: GYAE6OF01ET5F7.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcaagaaaccgagggaaacgcccctaaattcctgatctatcaggcatctaattggaaagtgggtccagtctaaggtttagcggcagtggatcgtgggacagtaattcactctcacgatcgagcggctgcacgcctgatgatgtcgactaacttattactcgaccaacactatgtatacgttacccgcttccgtacgtttcgggacgggtaacgggtaccgtaagggtgggaacggtacgaacggaccggtaacgtggtcggtactcggaccacctagttcgttcg

SEQ ID NO: 39076 - DNA, 479 bp, Homo sapiens
  misc_feature: GYAE6OF01EQ0MF.41.34.D01.1.454.CMB.1.raw
  modified_base (466)..(466): a, c, t, g, unknown or other
  misc_feature (466)..(466): n is a, c, g, or t
  modified_base (475)..(475): a, c, t, g, unknown or other
  misc_feature (475)..(475): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaattggaaagtgggtccatcaaggtttagcggcagtggatcgtgggacagaattcactctcacgatcagcgctgcagcctgatgatgtcgcaacttattactgccaacactatgatacgttaccgctcactttcggcggaggaccaaggtgaggtcaagcgaactgngctgacacntctg

SEQ ID NO: 39077 - DNA, 736 bp, Homo sapiens
  misc_feature: GYAE6OF01C3RNP.41.34.D01.1.454.CMB.1.raw
  modified_base (95)..(95): a, c, t, g, unknown or other
  misc_feature (95)..(95): n is a, c, g, or t
tcagtctatactatcacgaccggtgctcgatttagatcgtctgtgttgggtttggggagacccagtcaggacacagcatggacatgagggtcccncctcagctcctcggggcgtccctcgctgctctggcgtccccacggtggccaaactagtgacactccacgatgacccacgtctcccctcccattctgtctgcatctgtcggagacagagtcaccatcacttgccgggccagtcagagtattgcacacgcgttggccgtggtatcagcacgaaaccgaggaacgacccctaacttacctcgatctactcacggacatacttaagttttaggaaaggttcgggggtcccctaagtacgtaaagggttttacggtaccgggacgtaacggtgggtaacgtcgttacgggggaactaacgaagttttaccctaacctcccgtttccaaccgggtaataccgtaacggccccgggtacccgttcggaccgaaccggtcccgtacggtaatcggtacgttcggttaccgtaccctaaactttacttttaccgaccggtaaccctaacctaacgtttaacttacggtaaacttccggtttaacccccgcctttaccgtacggtttcccggggaccggtaaccgggggtaaccgtaaggggttcgggtaacggtaccgtaaacgggtccgaaacgttcgggtacgggtctacggtacccaacccgttagttccgttccgg

SEQ ID NO: 39078 - DNA, 547 bp, Homo sapiens
  misc_feature: GYAE6OF01B8C7R.41.34.D01.1.454.CMB.1.raw
  modified_base (415)..(415): a, c, t, g, unknown or other
  misc_feature (415)..(415): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcaagaaaccgagggaaacgcccctaaattcctagatctatcaggcatctaattggaaagtgggtaccatcgtaaggtttagcgcaggtgatcgtagggacagtaacttcactctacacgatcagcgctgcagcctagatgatgtacgactaacttattacngaccaactactaatcgtaattaccgttacccgcttacgtaccgtttcgggacgggtacggtaccgtaagggtacggacggtacgaacggtccgtaacgtggtacggtctacgaccgaacctagttcgttacg

SEQ ID NO: 39079 - DNA, 550 bp, Homo sapiens
  misc_feature: GYAE6OF01CGC62.41.34.D01.1.454.CMB.1.raw
  modified_base (224)..(224): a, c, t, g, unknown or other
  misc_feature (224)..(224): n is a, c, g, or t
  modified_base (272)..(272): a, c, t, g, unknown or other
  misc_feature (272)..(272): n is a, c, g, or t
  modified_base (352)..(352): a, c, t, g, unknown or other
  misc_feature (352)..(352): n is a, c, g, or t
  modified_base (396)..(396): a, c, t, g, unknown or other
  misc_feature (396)..(396): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccggccagtcagngtattgcacacgcgttggcctggtatcagacagaaaccgagggaaacncccctaaattcctagactctatcaggacatactaagtttggaaagtgggtcccatcgaaggtttagcgacaggtgatcgnggacagtactcacgtctcacgtatcgacgtcggctgcacgtccngtatgtatcgtacgactaacttacttacgtactaccaactactaagtgtaacgttacgttaccctctacgtacgtttccggacgggtacgggacgaagggtggacggtacgaaggacgtaacggtggtcggtcgtacgccacctatccgttacg

SEQ ID NO: 39080 - DNA, 503 bp, Homo sapiens
  misc_feature: GYAE6OF01CO9WW.41.34.D01.1.454.CMB.1.raw
  modified_base (414)..(414): a, c, t, g, unknown or other
  misc_feature (414)..(414): n is a, c, g, or t
  modified_base (474)..(474): a, c, t, g, unknown or other
  misc_feature (474)..(474): n is a, c, g, or t
  modified_base (497)..(497): a, c, t, g, unknown or other
  misc_feature (497)..(497): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagccccctaaattcctgatctatcaggcatctaatttggaaagtggggtcccatcaaggtttagcggcagtggatcgtgggacagattcactctcacgatcagcggcctgcagcctgatgatgtcgctaacttattactgaccaanactatgtatacgttacccgcttactacgtttcgggcgggagggaccaagggtggacggtnaaggcgaactggtcgctgcaccntcgtcg

SEQ ID NO: 39081 - DNA, 772 bp, Homo sapiens
  misc_feature: GYAE6OF01BSDNK.41.34.D01.1.454.CMB.1.raw
tcagtctatactatcacgaccggtgctcgatttagatcgtctgtgttgggtttggggagacccagtcaggacacagcatggacagtgacggtccccgctcagctcctgggctcctgctgctctggctccaggtgccaaatgtagacatccagatcgacccagtctccctcattctgtctgcatctgcggagacagacgtcaccatcacgttcgccggccagtcagagtatcgacacacgtcgttgcctggtactcgagcaacgaaacgagggaaactaccccgtaaattcctagtacttctactcgagtctatacgttaagtttaggaacggtcgggtacccctagttacgtaaaggtttacgacggtacgtagggttacgtacgttcggtacgggacgtaagtaacttaccgtacttcgtaccaacgtacttaccgacgtaccggcccgtacggtaccgtaacggtccgttaggtaacgttacggtacgtttcggttaccggtaaccttaaacgtttttaccgttaacgttaccgaaacccttaaaccgttaacgtttaaacgttaaggttaaaccgtttaaccgtttaccccggtacctttaacccgggtttaccgggtttaaccggggtaccgggggttaaaaccggggttaacccggttaaacgggggttaaccggggtaaacgggtttaaaccgaaccgggtaaacggttaaccggtagggttaccggtaccgtacggtaaccctacccgtaggttccgttaaccgg

SEQ ID NO: 39082 - DNA, 735 bp, Homo sapiens
  misc_feature: GYAE6OF01DFP3W.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgaccaaatgtgacatccagatgacccagtcctccctcattctgtctgcatctgtcggagacagagtcaccatcacttggccggccagtcagagtattgcacacggtcgttggcctggtatcagcaagaaaccgagggaaaccacccttaaattccgtagtacttactactcgacggtctattacgttaagtttaggaaacggttcggggtaccctaagtacggttaagggtttacgcggtacgtaggtggtactacggtaggggaactaaggtaacctttcgaaccttccgtacgaaccgtactaccggacggtcccgggtaccttacggaccgtaccggtcccgtaggtaacgttacggtaacgttacggtaccgtaaccttttaaaccgtttaacttaccccgtaagacccctaaaactacgttaagttaccgtaacgtttaacccggttaccccgttacttacccggttaaccggtttccggggaacccgggtaaccgggtaaaccggtaaaggggttcgggtaaacggttaccgaaacgggtccggtaaacggttgggtaccggtacgtacggacccaccgttagtccgtttaccgg

SEQ ID NO: 39083 - DNA, 636 bp, Homo sapiens
  misc_feature: GYAE6OF01DEX9H.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctccattctgtctgcatctgtcggagacagagtcaccatcacttgccgggccagtcagagtattgcacacgcgttggcctggtatcagcagaaaccagggaaagcccctaaattcctagatctatcaggcatctaatttggaaagtcgggtccagtacaggtttagcggcagtggatcgtgggacagaattcactctacacgatcacgcggctgcagcctgatgatgtacgactaacgtttacttacgtagaccctaaacgtaaccttaagttacgtaacgtttaaccggttacccccgtcgtttacccgtaccggttttaccggggacccggggtaaacggggtaaacccggtaaaggggttacggggaaacggggtttaaccaaaacggggtcccggtaaaaccggttgggttaacgggtacccgtttacggaacccgtaacccgttaagttcccggttttaccggg

SEQ ID NO: 39084 - DNA, 549 bp, Homo sapiens
  misc_feature: GYAE6OF01AMMXG.41.34.D01.1.454.CMB.1.raw
  modified_base (433)..(433): a, c, t, g, unknown or other
  misc_feature (433)..(433): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgactaattattactgaccaacactatgattacgttacccgnttccgtactttcgggacggaacggggaccctaaagggtcgggtaaggttacgaaacgggtccggaaaaccgttggtacgggtaccttggacccgaaccctaagttccgtttaccgg

SEQ ID NO: 39085 - DNA, 542 bp, Homo sapiens
  misc_feature: GYAE6OF01CJE76.41.34.D01.1.454.CMB.1.raw
  modified_base (271)..(271): a, c, t, g, unknown or other
  misc_feature (271)..(271): n is a, c, g, or t
  modified_base (459)..(459): a, c, t, g, unknown or other
  misc_feature (459)..(459): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctccattctgtctgcatctgtcggagacagagtcacatcacttgccggcagtcagagtattgcacacgcgttggcctggtatcagcaagaaaccgagggaaacncccttaaattcctagatctatcaggctatctaatttggaaagtcgggtccagtcgtaaggtttagcggctaggtggatcgtagggacaagtacttcgactctacacgatcgagcggacctggcagcctgactgatcgtacgtactaactttatacctgaccaactactatagtaacttacgttacccnctacgtacgttacgggacggaggtaccgaagggtcggacggtagaacgacggtactggtcgctaggaccacctagtcgttacg

SEQ ID NO: 39086 - DNA, 543 bp, Homo sapiens
  misc_feature: GYAE6OF01D1TSN.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcaagaaaccagggaaacgccccttaaattcctgatctatcaggcatcttaatttggaaagtcggggtccagtacgaaggtttacgcggcagtggatcgtagggacagtattcactctcacgatcgacgcggactgacagcctagatggtatcgtccgtactaactttattactcgaccaactactatagtattacgttacccgcttcgtacgtttcgggacggtaacgggaccgaagggtcggaggtacgaggtacgaacgtggacggtctacgactactgtcgttacg

SEQ ID NO: 39087 - DNA, 527 bp, Homo sapiens
  misc_feature: GYAE6OF01A1KFO.41.34.D01.1.454.CMB.1.raw
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcaagaaaccagggaaacgcccctaaattcctgatctatcaggcatctaagtttggaaagtgggtaccatcgtaaggttagcgnagtggatcgnggacagtaattcactctcacgtactcgagcggcctgcagcctgatgatgtcgactaacttattactgacccaacactatgtacttacgttacccgctactacgttcggacgggtacggaccgtaagggtcggacgtacgaacggtcgaacgtggtcggtctcgaccacctgttcgttacg

SEQ ID NO: 39088 - DNA, 733 bp, Homo sapiens
  misc_feature: GYAE6OF01DD8ES.41.34.D01.1.454.CMB.1.raw
  modified_base (192)..(192): a, c, t, g, unknown or other
  misc_feature (192)..(192): n is a, c, g, or t
  modified_base (272)..(272): a, c, t, g, unknown or other
  misc_feature (272)..(272): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcgganacagagtcaccatcacttgccgggccagtcagagtattgcacacgcgttggcctggtatcagcaagaaaccagggaaacncccctaaagttcctagatctatcaggcatactaatttagggaaagttcggggtccctaagtacgtaagggtttaacgcggacgtaaggtcggattaccgtaggggaacctaaggtaaacttcgaacttcgtacgaacgtataccgaaggtcccgggaccttaggacccgaacggtccccgttaagggaacgttagggtaaacttccggggttaaccgacctttaaaaccgttttaacgtttaaacccgtacggaaccccaaaaccttaccgttaaagttcggtaaactttaaccggttaacccccgtacttacccgttaaccggttttcccgggggaccgggtaaacggggtaacccgtaaaagggggttcgggtaaaccgggtaacgaaaacgggtccggttaaaaccgttgggttaccgggtaccgttacggaaccaaccccgttagtaccgtttccgg

SEQ ID NO: 39089 - DNA, 598 bp, Homo sapiens
  misc_feature: GYAE6OF01AN0CI.41.34.D01.1.454.CMB.1.raw
  modified_base (443)..(443): a, c, t, g, unknown or other
  misc_feature (443)..(443): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccgagggaaacgcccctaaattcctgactctatcaggctatactaagtttggaaaggtcgggtacccagttacgaaggtttacgcggtcgtaggtcggatcggtagggaacaagtacttcgactcgtacacgtatcaggcgcctgctagcctagatgagtcgtcgactaacttacttacgtanacccgtaactacgttaatacgtacttacgttacccgtacttaccgttacgtttcccgggacgggtacgggtaaccgtaaagggtcggtaacgggttacaacgggtccgtaaacgttcggtacggcttacggaccctaccgtagtttccgtaccgg

SEQ ID NO: 39090 - DNA, 540 bp, Homo sapiens
  misc_feature: GYAE6OF01CXLOL.41.34.D01.1.454.CMB.1.raw
  modified_base (267)..(267): a, c, t, g, unknown or other
  misc_feature (267)..(267): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtatgcacacgcgtggcctggtatcagcagaaaccagggaancccctaaattcctgatctatcaggcatctaatttggaaagtcgggtccatacgaaggtttagcggcagtggatcgtgggacagattcactctacacgatcgagcgctagcagctagatgatgtacactaactttatactgtaccaactacttatacgtaactacgttacccgtcttaccgtacgtttcgggacggtacgggaaccgaagggtacggacggtacgaacggacgtaacgtggtacggccgttacgactaccctagttccgttacg

SEQ ID NO: 39091 - DNA, 592 bp, Homo sapiens
  misc_feature: GYAE6OF01E1446.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccggccagtcagagtattgcacacgcgttggcctggtatcagcagaaaccagggaaacgcccctaaattcctgatctatcaggcatctaattggaagtgggtcccatcaaggtttagcggcagtggatcgtagggacagtaattcactctcacgatcacggcgctgcagcctgatgatcgtcgactaacttattaccgtcgacccaaactacttaagtacgtaacgttaaccggtttacccccgcttacccgtaaccgttttccgggacgggtaaccggggtaacccgaaaggggttacgggaacgggttaacgaaacgggtccgtaaaccgttgggttaacgggtccttacggaccctaacccgtagttccgtttaccgg

SEQ ID NO: 39092 - DNA, 730 bp, Homo sapiens
  misc_feature: GYAE6OF01B9GTL.41.34.D01.1.454.CMB.1.raw
  modified_base (192)..(192): a, c, t, g, unknown or other
  misc_feature (192)..(192): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcgganacagagtcaccatcacttgccgggccagtcagngtatgcacacgcgtggcctggtancagcaagtaaccgagggaaactcccctaaattcctagactctatcgacggactatacttaaacgtttggaaacggttcggggtaccctagttaccgtaagggtttacgcgggtactagggtcggtacttacggtacggggaacctaaggttaaactttccgaaccgtttaccgtaaccgtaaccggtaacttacccggaacggtcccgggtacccgtacggtacccgtaacgggttacccgtacggtagttacgtaacggttcggttaccggtaaccttaaacgtttacgtttaccgtacgtaaccctaactaaccgtttaacgtacggttaaccgttaaccggtttaacccgccgtttaccgttaccggttacccgggtacggggtaacgggacccgtaagggtaccgggtaacggttaccgaaaggtccggtaaacgtggttaccggtccgtaccgacctaaccgtgttccgtttaccg

SEQ ID NO: 39093 - DNA, 554 bp, Homo sapiens
  misc_feature: GYAE6OF01DX7D9.41.34.D01.1.454.CMB.1.raw
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccggccagtcagagtattgcacacgcgttggcctggtatcagcaagaaaccagggaacgccccttaaattcctagatctatcaggctatctaagtttggaaacgtgggtacccatacgtaaggtttagcggtcagtggatcgtaggacagtattcactcncacgntcagcgctgcagctagatgatgtcgactaactttactactagacctaactactatacgtacgttacgttacccgtactacgtacgtttccgggacggtaacgggaccgtaagggtacggaacggtacaaggtcgaaacgttggtacggtccttacggaccctaacctgttcgttaccg

SEQ ID NO: 39094 - DNA, 643 bp, Homo sapiens
  misc_feature: GYAE6OF01CXEM0.41.34.D01.1.454.CMB.1.raw
  modified_base (517)..(517): a, c, t, g, unknown or other
  misc_feature (517)..(517): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggcagtcagagtattgcacacgcgttcggcctggtatcagacgaagaaaaccgaggaaacgacccctaaattcctagtactctatacaggctatacttaagtttagggaaagtcggggtacctagtacgtaaggtttacggcggtacgtaaggtggatacgtagggaactaagtaactttcaaccttccgtacgacgtatacgacgcccggctcgacgtacgcctagagtgatcggtaccgtaactaactttaacttacgtacgacctaactaccttaagttacgtaagtacccgttaacccncttaccgtacgtttacgggaccggtaaacggggtaccgtaaggggtagggtaacggttaccgaacggtaccgtaacggttacggttcggacccgttacggaccctaacgtacgttccgtttaaccg

SEQ ID NO: 39095 - DNA, 591 bp, Homo sapiens
  misc_feature: GYAE6OF01E27C0.41.34.D01.1.454.CMB.1.raw
tcagtctatactatcacgaccggtgctcgatttagatcgtctgtgttgggtttggggagacccagtcaggacacagcatggacatgagggtccccgctcagctcctgggggctcctgctgctctggctcccaggtgccaaatgtgacatccagatgacccagtctccctccattctgtctgcatctgtcggagacagagtcaccatcacttgccgggccaggtcagagtattgcacacgcgttggcctggtatcagcagaaaccagggaagcccctaaattcctgatctatcaggcatacttaatttaggaaaggttcggggtacccataccgtaaggtttacgcggcaggtggatcgtagggacagtatcactctcacgatcacgcgcctgcagtcctgatgatcggtacgactaacgttattacacgtaccaactacttagtacgtacgttaaccgttaccccgtcttaccgtacgtttccggggaccgggtaacgggtaacccgtaaagggtgggtaacggttacgaaacgggtacccgtaaggttcgggtacggtaccgtcggaacccctaccgtcgttcgttccgg

SEQ ID NO: 39096 - DNA, 754 bp, Homo sapiens
  misc_feature: GYAE6OF01DVGFQ.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctccattctgtctgcatctgtcggagacagagtccacatcacttcggccggccagtcagtagtattcgaccacgacgtcgttcggccttaggtactcgacgacaacgaaaccgaagggaaacacccctaaattcctgtactctatcgaggactatacttaagtttaggaaaggttcgggtaccctagttacgtaagggtttacgcggtacgtaggtggtacgtacggtgggaactaagtacttctaacctctaccgacgtaagtcgacgggccggtccgtggacccgacgtccgtaggtacgttacggacgttacggtacccggtaacttaaccgttttaacgttaaccgtaacgtaaccctaaaccgttaccgtttaacgttacggttaacgtttaacccggttaaccccgttaccgttaccgtttacccgggtttacccgggaaccggggtaaccgggtaacccgggttaaacggggtacggggttaaccgggtaacggtaaccgggtaaccgggtaaaccggttcgggtaccgggtacccgtacggtaaccccgtaacccgttaacggttccgtttaacccggg

SEQ ID NO: 39097 - DNA, 499 bp, Homo sapiens
  misc_feature: GYAE6OF01EPYVK.41.34.D01.1.454.CMB.1.raw
  modified_base (417)..(417): a, c, t, g, unknown or other
  misc_feature (417)..(417): n is a, c, g, or t
  modified_base (491)..(491): a, c, t, g, unknown or other
  misc_feature (491)..(491): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaaattcctgatctatcaggcatctaatttggaagtgggtccatcaagtttagcggcagtggatctgggacagaattcactctcacgatcacgcggcctgcagcctgctgatgtcgacaacttatacttgccaaatactaangtatacgttaccgctctacgtttcggcggaggaccaagggtggaggtacaaggcgaacgtggtggctgaccacntcgttacg

SEQ ID NO: 39098 - DNA, 560 bp, Homo sapiens
  misc_feature: GYAE6OF01A011N.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccggcagtcagagtatgcacacgcgttggcctggtatcagcagaaaccagggaacgcccctaaatcctgatctatcaggcatctaatttggaaagtgggtccagtcaaggtttagcggcaggtggatcgtgggacagtattcactctcacgatcgagcggctgcacgccgtgatgattcggtacgactaactttattactacgaccaacacttaatgtaacttaccgttacccgcttaccgtacgtttccgggacggtacgggtacccgtaaggggttcgggtacgggtacgaaacgggtccgtaaacgttgggtacggtccgtacggacccaccgtagttccgttcgg

SEQ ID NO: 39099 - DNA, 610 bp, Homo sapiens
  misc_feature: GYAE6OF01CPTOR.41.34.D01.1.454.CMB.1.raw
  modified_base (602)..(602): a, c, t, g, unknown or other
  misc_feature (602)..(602): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgaccaaatgtgacatccagatcgacccagtcctccctcattctgtctgctatcgtggtacggagacagatcacatctacgttggccggcagtcagagtatcgctacgacgtcggtggcctggtatcagacgaagaaacgacgggaaacctaccctaaacttctagacttacgatcgacgactattacgttaacgttagggtaaacgggtcgggtaccctaagtacgttaagggtttacggccggtagtaggtggtacgtacgtaggggtaactaagtactttaccgacttccgtactacgacgtacgacggtcgccgtagcgtacgcctaggagttagactcggtactacttaacgtttctacgtacacctaacgtacttagtacgtaacgttaccgtacctcttacgtacggttcggacggacggacgtaggtcgagacgaggtacgcgtgacgtcacgacaccgtntccgtacg

SEQ ID NO: 39100 - DNA, 555 bp, Homo sapiens
  misc_feature: GYAE6OF01ES3LE.41.34.D01.1.454.CMB.1.raw
  modified_base (333)..(333): a, c, t, g, unknown or other
  misc_feature (333)..(333): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaacgcccctaaattcctgatctatcaggcatctaatttggaaagtgggtccatcaaggttagcggnagtgatcgtgggacagatcactctcacgatcgagccgctgcagcctgatgatgtcgactaacttatactcgaccaactacctaatacggtaattaaccggttacccgcttaccgtaccgtttcgggacgggtaacgggtacccgtaaagggttcgggtacggtacgaaacggaccggtaaagttcggtcgggtacttacgaccgtacctacgttcgttaccg

SEQ ID NO: 39101 - DNA, 590 bp, Homo sapiens
  misc_feature: GYAE6OF01AXFGP.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctccattctgtctgcatctgtcggagacagagtcaccatcacttggccggcagtcagagtatgcacgacgcgttggcctggtatcagacagaaaccagggaaacacccctaaattcctagatctatcaggcatactaagtttgggaaaggttcggggtacctagtacgtaaggtttagcggtacaggtggatcgtagggaacagtacttcgactctacacgtatcgacggccgctagcagccgtagactgatcgtacactaactttataccgttcgaaccctaactacgttaatacggtaacttaccgttacccgtcttaccgtacggtttccgggacgggtaacgggacggtaacgggtggtaacggtaccgaacggtcgtaacggtggcgggtactacggacctaccgtagttcgttaccg

SEQ ID NO: 39102 - DNA, 647 bp, Homo sapiens
  misc_feature: GYAE6OF01DXGO6.41.34.D01.1.454.CMB.1.raw
  modified_base (209)..(209): a, c, t, g, unknown or other
  misc_feature (209)..(209): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (639)..(639): a, c, t, g, unknown or other
  misc_feature (639)..(639): n is a, c, g, or t
tcagtctatactatcacgaccggtgctcgatttagatcgtctgtgttgggtttggggagacccagtcaggacacagcatggacatgacgggtccccgctcagctccgtggggctcctgctgctctggctcccgaggtcgaccaaagtgtagacatccagatcgacccagtccctccctcctattctgtctgactactcgtcgtacgganacgagtactccaccagtccacgttcgcccgggaccagtaccaggtaagttacgtggaccaaccgcggtcggttcggcctaggttacacgaagactaaacggaaaccgtaagggaacctacccttaaagtctgacttacatcgaagtctatacgttaagttaggaacggttccggtaccattacggtaagggttacgcggagtagtaggacttcggaaggacagttacacacttanacggaacntaccgacggcgtacngacgtcnccgtanactaggtactcggtacaacctttaacgttactaccgacgtactaactacggtataacgtacgttacccgttaccacgttaccgttcgggttaccggagggtaccggacgtaggggtacgtaggtaacaacggtacgtacgtggctacgtccaacgcgtntccggttc

SEQ ID NO: 39103 - DNA, 623 bp, Homo sapiens
  misc_feature: GYAE6OF01A7FBU.41.34.D01.1.454.CMB.1.raw
  modified_base (193)..(193): a, c, t, g, unknown or other
  misc_feature (193)..(193): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctccattctgtctgcatctgtcgganacagagtccaccatcacttggccgggccagtcagagttatgcacacgtcgttggcctggtatcgagaccaaggaaaccgaagggaaacctaccccttaaattccgtgactctatcgaggactatacttaagttagggaaaggtcggggtaccaagtacgtaaaggtttacgcggacgtaggtagtacgtcgtagggaactaagtaacttcactcgtacgacgtactcgacggccgcgtggccacggtaccgtgattgagtcgtacgaccttaagtttaacttacgtacaccaaactacgtaattggtaacgttacccgttacccgtacgttacgtaccggttacgggacggtacgggtaaccgtaaggggtcggtaacggtacaaacgggcgttaccggtggacggtcacggaccaccgttgtcgttacg

SEQ ID NO: 39104 - DNA, 697 bp, Homo sapiens
  misc_feature: GYAE6OF01CFTH3.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctccccaggtgccaaatgtgacatccagatgaccccagtcctccctcctattctgtctgcatctgtacggagacagacgtccaccatcacttggccgggcagtcagagtattgcacacgtcgttggcctggtatcgagacgaaacgaaaccgaagggaaaccgtaccccttaaattcctagtacttctaacgcgagtctaacgttacgttaaggtttagggaacgggttccggtaaccctaagtaacggttaacgggttacggacggtacgtaaggtcggtacgttacggtacgggtaactaacggtaacctttaccgtaacgttcgtaaccgacgtaacgtacgaaccggggtccgtaccgtacggtacctacggtaccgttagaacgttcgttaacggtcgttaccgtaaccttttaacgttaacctacgacctaaacctaacgtaactacggtataaccgttaaccgtccgtactacgttacgtcgggaacggtaacggtacggtaaggacggtaacgtacgaacggtacgtaacgtgtacggcctacgaccctacgttatcgttaccg

SEQ ID NO: 39105 - DNA, 777 bp, Homo sapiens
  misc_feature: GYAE6OF01C8YRF.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtcgaccaaatgtagacatccagatcgacccagtcctccctcctattcctgttctgctatctggtacggagacagacgtcaccatcacgttcggccgggccagtcagtagtacgttgccacgacggtcggttggccttggtactcgacgacgaacggaaaaccggacgggaaaccgtaccccttaaagtttcccgagtaactttactaacgtacgaacggtacttaacgtttaacgtttaaaggtttaacggggaaacgggtttccggggtaaccttaacgtaacggttaaacggggtttcggaccgggtacgtaagggttacggacgtttcggaacggggaacttaacggtaaacttccgaacctttcgaacgtaaccggacgttaccgacggccggacctaggtacccgacggttctagtacgtaggtacgttacggtaccgttaaactaaccgttttaacgttaccaccggaaacttaacttacgtaacggttacgttaaccgtttacccgtaccgtaccgttaccgttaccgggtccggggtaacgggaccggggtaaccggtagggttaacggacgggtaacaacggtccgggtagtcgggtaacgtccgtaacgaccctacgtttagtcgtttacccgg

SEQ ID NO: 39106 - DNA, 800 bp, Homo sapiens
  misc_feature: GYAE6OF01CWY0M.41.34.D01.1.454.CMB.1.raw
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
tcagtctatactatcacgaccggtgctcgatttagatcgtctgtgttgggtttggggagacccagtcaggacacagcatggacatgagggtccccgctcagcctccgtggggctcctgctgctctggcctcccaggtcgccaaatgtgacatccagatcgacccagtcctccctcctattctgtctgctatcgtggtcggagacagacgtcaccatcctacgtcggccgggacagtcagagtatncacncgtcgtcggctgtacnacgacaacgaaaccgaggaacctaccccttaattccgtagtactctagtacgacgtactattacttaaaggtttagggtaaacggtcgggtaccctagtacggtaaggtttacggcggtacgtaggtaggtacgtacggtacggtaactaacggtacttacgtaccttaccgtaaccgacggtactacggaccggtcccggtactggacctaacggtccgtagtaacgttcggtacgttacggtaaccgttaaccctaacgtttttaacgtacccgtaaccgtaaaccccgtaaactttaaaccgttaagtttacccggttaaaaccttttacccccggttaacccccggtaccttttaaccccggggttaaccggtttacccggggggaacccggggtaaacggggtaaacccgggtttaaggggtaccggggtaaaccggtaacggtaacccgggttaaacgggtaacggtttcgggaacccggttacccggtaaccggacccgttaaccgttacccgttggttttacccccg

SEQ ID NO: 39107 - DNA, 684 bp, Homo sapiens
  misc_feature: GYAE6OF01AW9MO.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctccattctgtctgcatctgtcggagacagagtcaccatcacttgccgggccagtcagagtattgcacacgcgttggcctggtatcagcaagaaaccagggaaacgcccctaaattcctagactctatcgaggctatctaaagttggaaaggttgggtaccagtacgtaaaggtttagcggactaggtaggatcgtagggactagtaattcactctcacgactacgacggccggtcctaggacgacgtccgtagtactacggtattcggtaccggtaacctaacgtttactttaacccgtacgaccctaaacgtaaccttaagtacggttaaccgtttaaccggttaccccgtaccgttacccgttaaccggttttacccggggaaccggggtaaacgggttaacccggaaaggggttacgggtaaaccggggttaccaaacgggtacccggttaaacggttcgggttacgggtaccgttacgggaaccccttaaccgtagtttcccggttaaccgg

SEQ ID NO: 39108 - DNA, 907 bp, Homo sapiens
  misc_feature: GYAE6OF01EHA4D.41.34.D01.1.454.CMB.1.raw
tcagtctatactatcacgaccggtgctcgatttagatcgtctgtgttgggtttgggggagacccagtcaggacacagcatggacatgagggtccccgctcagctccgtggggctcctgctgcctcgtcggcctcccgaggtcgaccaaattgtgacatccagatcgaccagtcctccctctattctgtctgctacttcgtggtacggagaccgagtacgtaccaacctatcctaccgttccggaccccggggtacctacgtacgaaggtagtttacgttcgaccacgtacggtcggttcggtccgttaggtactccgaacgacgaaacggaaaccggaacggtaaacccttaccccgttaaacgtttccgaggttaacttacctaacgtccggaacggtaccttaaagttttacggttaaaggtttaacggggtaaacgggttccgggtaaccctaaggttaacgggtttaacggggtttacggaccgggtacggttagggttacggtacgtttaccggaagggtaacgttaagtaaacctttcccggactttacccgacgtaaccggagttacccggaccggggtccctaccgttacggacgttaccccggtcgttaaggaccgtttaggacccgtttggaaacccgttaaccgttttaaccttacgttaaccccgtaacccggtaaccctaacgtttaacgtaaacgtttaaccgttaaccccgggtttaaccgttaccccggtacgtttaacccgggttacccggggttaacggggaacccggggtaaacgggtaaacccggggtaagggtttaccgggacgggttaacccgaaccgggttaacgaaccgggtttgggaaccggttccgaaccgtaccctaaaccggttgtttccgttaaccgg

SEQ ID NO: 39109 - DNA, 579 bp, Homo sapiens
  misc_feature: GYAE6OF01DLFSR.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaaccagggaaacgcccctaaaattcctgatctatcaggcatctaatttggaaagtggggtaccatacgtaaggtttagcggactaggtggatcgtgggaactagtaattcatctacacgatcgagcggcctgcagcctagatgatgtacgactaaactttatactcgaccaaacgtactaagttcgacttaacgtttacccgaccttaccgtaccgtttaccggggacgggaacgggaaccgtaaagggtcgggaaggtaccgaaaggtccgtaaaccggttggtacggtccttagaccctaaccgtagttcccgttacg

SEQ ID NO: 39110 - DNA, 576 bp, Homo sapiens
  misc_feature: GYAE6OF01C5714.41.34.D01.1.454.CMB.1.raw
  modified_base (193)..(193): a, c, t, g, unknown or other
  misc_feature (193)..(193): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctccattctgtctgcatctgtcgganacagagtcaccatcacgttcgcccggcagtcagagtatgcacacgcgttgcctgtatcagcagaacgaggaacnccctaatcngatctancagctatacttaagttaggaacgtcgggtaccagtacgtaaggtttcgcggtacgaggtggtactcggtaggactaagtacttcactctacacgcgtcacgccggtcctgcacgcctgatcgtagtcgacgtactaacgtttacacgtaccgaacctaactacgttagtacgtaacgttaacccgtaccccgttcttaaccgttacggttaccgggacggtaacgggaccgtaagggtacggtacggacgacggtacctaaggtcgtcggactccgaactacctgttcgtccg

SEQ ID NO: 39111 - DNA, 721 bp, Homo sapiens
  misc_feature: GYAE6OF01B4C9Y.41.34.D01.1.454.CMB.1.raw
  modified_base (195)..(195): a, c, t, g, unknown or other
  misc_feature (195)..(195): n is a, c, g, or t
  modified_base (239)..(239): a, c, t, g, unknown or other
  misc_feature (239)..(239): n is a, c, g, or t
tcagtctatactatcacgaccggtgctcgatttagatcgtctgtggttggggtttggggagacccagtcaggacacagcatggacatgagggtccccgctcagctcctggggctcctgctgctctggctcccaggtgccaaatgtgacatccagatgacccagtcctccctccattctgtctgcatctgtcgganacagagtccaaccatcacgttcggcccggaccagtcagtagttntgacacacgcgttggcctggtatcagcaagaaaccgagggaaacgcccctaaattcctagactctatcgaggactatacttaagtttaggaaacgttcggggtaccaagttacgtaaaggtttacgcggactagggtagtacgtcggtagggacctaaggtaacttccgaacttccgtacgacgtacgtcgacgggcccggtacctgtaccacggtccgtaggtataggtacttacggtacccggtaacttaaaccgtttacgtttaaccgacgttaacccctaaacgtaccgtttaattaaccgggtaaccgtttaaccggttaacccccgttcgtttaaccccgttaccgggttttccggggaaccgggtaaacggggtaacccgtaaagggggttacggtaaccggttacgaaaccgggttaccggaaaccgttgggtaccggtcggtacgaacccgtaaccgttagttccgttaccgg

SEQ ID NO: 39112 - DNA, 742 bp, Homo sapiens
  misc_feature: GYAE6OF01DKB0Q.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatcgacccagtcctccctccattctgtctgcatctcggtacggagacagacgtcaccatcacgttcggccgggcagtcagtagtatcgacacgtacggtcgttacggtccgtaggtactacgagtaccgaacggaaaccgaaggggaaacctaccccttaaattccgtagtacttctagtcgacggtactaacgttaaggttacggtaacggtacgggtcctaagttaccggtaaggttacggcggtacgtaacgggttacggtagttacggtacggtaaaccgtagtaacgttacctaccgttacgtccgtaacgtacgtacggtacggcccgggtcccgtaaggcctacggtaccggttgtaaacgttcgtaacgttcggtaacctacgtttaaacttacgttacggtacaccgtaacttacgtacttacgtaacgtttaccgttaccgccttacgttaccggttacgggaaccgggtaccggtaaacggtacgggtaggtaacggtaacggtaaccggtacggtaaccggttcgggtaaccgtcgtacccggttaacccacccgttacttcccggttctttaacccg

SEQ ID NO: 39113 - DNA, 680 bp, Homo sapiens
  misc_feature: GYAE6OF01C70YF.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatcgacccagtcctccctccattctgtctgcatcgtgtcggagacagagtcaaccatctacgttggccggacagtcaagtagtattcgcaacgacgtcgtggtccgtggtactcgaagacaagaaaccgaacggggaaactaccccgttaaaacttccgtagaacttactacgtacgaggtacattacgttaagtttaacggtaaaggtacggggtaccccaagttaacggtaaaggttttacggcggtacgtaaggtaggtactacgtacggggactaacggtatttaccgacgttacttacaacggtactacggaacggccggccgttacgaccgtaggtcctaggtaatacggtacgtaggttaccgaacgtaaactttacgttacttacgaacctaaacttaaccgtatacggtaacgtttaccgtacccgtcttacgtacgttacgggacggaacgggacgaagggtcggtaagacgacggtacgacgttggacgtaccgtagacgaaccctgtccgtttacg

SEQ ID NO: 39114 - DNA, 759 bp, Homo sapiens
  misc_feature: GYAE6OF01AT5CT.41.34.D01.1.454.CMB.1.raw
  modified_base (59)..(59): a, c, t, g, unknown or other
  misc_feature (59)..(59): n is a, c, g, or t
  modified_base (122)..(122): a, c, t, g, unknown or other
  misc_feature (122)..(122): n is a, c, g, or t
  modified_base (136)..(136): a, c, t, g, unknown or other
  misc_feature (136)..(136): n is a, c, g, or t
  modified_base (469)..(469): a, c, t, g, unknown or other
  misc_feature (469)..(469): n is a, c, g, or t
tcagtctatactatcacgaccggtgctcgatttagatcgtctgtgttgggtttgggganacccagtcaggacacagcatggacatgagggtccccgctcagctcctggggctcctgctgctntggctcccaggtcnccaatgtgacatccagagtcgacctagtcctcccgtcagttctcgtctgctagttctcggtccggatacgagtactccaacctatccgtacgttccgggacccgggtcacggtccgtaagtacggtttgtccggactaccggtacgtccggttacggtaccgttaggtacctagaccgaaccgtaaacgaaaccggtacggggtaaacctcccttaaagttccgtacgtactactcgtacggactcgtacttacgttaggtacgtaacggtcggtacctagttacgtaaggttcgacgtcgtagtacggtatacggtggtaactagtaccgtnaccgttcacgtaaccgtgtaccgtacgggtccgtaccgacgtaccgtacgtacggtacgtacgttacggaccgttacggttaccgtaacttacggttaccgtaaccgttaccgtaaccgtaactaccgtaacgttaccgttacggttaacccgttaccctacggttaccgtaccggtttaccgggacgggttaccggaaaccggtagggtacgggtaaccgtacgggtaacggtcgtacggtacggtccggtaccgttacgacccttacggttaaccgttcggttacccg

SEQ ID NO: 39115 - DNA, 876 bp, Homo sapiens
  misc_feature: GYAE6OF01AFOC7.41.34.D01.1.454.CMB.1.raw
tcagtctatactatcacgaccggtgctcgatttagatcgtctgtgttgggtttggggagacccagtcaggacacagcatggacatgacgggtccccgctcagctccgtggggctcctgctgctctcggcctcccagggtcgacctaaattcggtagaacctactcccgagtactccgaacccctagttccctcccctactactttcgtcgttcctgcctacgttccgtacggtacgggaagaccgagtaccgtacccacgtactccgtacgttccgggacccggtaccagttccgaaggtagttcgttcgaccgtaccgtaccggtccggttccggtccgttacggtactaccgtaacgaaccggaaaaccggtaaacccggaaccgggtaaaccccgtaacccccgttaaacgttccgtaacgtaccgttaccgtacgtaccgaacggttacctaacgttaacgtttaaaggttaaccgggtaaacgggttccccggtaaccttaagttaaccggttaacgggttacggtaccggtacggtaaggtcggtacgtacgggacgtacgtaagttaccgttacctacctacccgtacgtaccggtacgtacccgcggggtacccgtccgttacggaccgtacccggtgtaccgtggtaactccgggttacttaccgaaccgtttactaccgtacacctaaccgtaactacgtactacggtaaccctttacccgtacgttcccgttaggttacccgggtacggtaaccgggtaccggtaacgaagggggtttaccggtaacgacccgggtaacggttcgtaccccgggtgggtaacccttccggaaccgtacccgtctttaccgggttccttaacccgg

SEQ ID NO: 39116 - DNA, 699 bp, Homo sapiens
  misc_feature: GYAE6OF01BVH9D.41.34.D01.1.454.CMB.1.raw
  modified_base (187)..(187): a, c, t, g, unknown or other
  misc_feature (187)..(187): n is a, c, g, or t
tcagtctatactatcacgaccggtgctcgatttagatcgtctgtgttgggtttggggagacccagtcaggacacagcatggacatgagggtccccgctcagctccgtggggctcctgctgctctggctcccagggtgccaaatgtgacatccagatcgacccagtcctcccctccattctgtctgcntcgtgtcggagacagagccaccatcacttcggcccggcagtcagtatagtcacacacgcgttcggcctaggtactacgagaccgaacggaaaacccggaacgggaaaccgtaacccccttaaacttcccgtaagacttactaactacggaacggtcctaattaacgttaagtttaagggaacggttccggggtaccctagtacgtaaggggtttacgcggtagtacggtcgtagtacggtagggaactacggtaacttaccgtacctcgtacacgtactacgacggccgtccgtgaccgtacgcctacgagtcgtagttccgtaccgtacttaactttacttaccgtaactacccaactaacgtacgttacgtaaccgttacccgttacccgttacccttaccggtaccgggtttaccgggccgggtaaccggaaccgggtaaggggttaggtaaccggtacgaacggtacggtacggtggtacggtactacggacctacgtgtccgttacg

SEQ ID NO: 39117 - DNA, 739 bp, Homo sapiens
  misc_feature: GYAE6OF01CXFOK.41.34.D01.1.454.CMB.1.raw
  modified_base (268)..(268): a, c, t, g, unknown or other
  misc_feature (268)..(268): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatcgacccagtcctccctccattctcgtctgccatccgtgtcggaagacagtagtccacctatccacgttcggcccgggcaagtcaagagtatcgcacacgtcgtggcctggtacncagacaagaaaccgaaggaaacgtacccctaaattcctagatactactacgacgactattacgtaaagtttacggtaaacgggtacgggtaccctaacgtaacggtaaggtttacggtcggtacgtaggtcggaagtcggtacggaagtacgtaactttacgaccgtactaccgaacggtacaccgtaacgggcccggccttagaccgaacgtccgttagagtacgttagttaccggtaacctaacgttaacccgtttaagttaaccctaccgtaaaccctaaagtaactttacggtacggtaacctttaccgggtaccccgttaacgtcccgtttacgggtttcccgggaaaggggtaaacccggtaagggttaaccggggtaagggtacggggtaaccaaagggttacccgtaaccggttggggtaaccggtaccgtacgaacctaccgttacccgttagtttccccgg

SEQ ID NO: 39118 - DNA, 687 bp, Homo sapiens
  misc_feature: GYAE6OF01EL5K6.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgaccaaatgtgacatccagatcgacccagtcctccctcctattctgtctgctatcgtcggtcggagacagacgtccaccatcctacgttcggcccggcctagtcagtagttatcgcacgtacggtcggttcggccgttggtactcgacgacaaacggaaaccgaagggaacctaccccttaaattccgagtactactacgcgacgtctaagtcttaaagttagggaacggtccggtacctagttacggtaaggttacggcggtagtaggtagtacgtcggtaggaactagtactactacttaccgtacgacgtactcgacggccgtctacgaccgtacgtactagtacgtagtacgtcgtaccgtaacgttaactttaccgtacgtaccgaacctaactagttaacgtacggtaacctttacccgtaaccccgtcgtttaccgtaaccgggttccggggaaccgggtaacgggtaaccgggtaaggggtaccggtacggtaaccgaggtacccggtagtcgggaccgtcgtacgacctaccttgttccgtccg

SEQ ID NO: 39119 - DNA, 874 bp, Homo sapiens
  misc_feature: GYAE6OF01D5SU1.41.34.D01.1.454.CMB.1.raw
  modified_base (323)..(323): a, c, t, g, unknown or other
  misc_feature (323)..(323): n is a, c, g, or t
tcagtctatactatcacgaccggtgctcgatttagatcgtctgtggttgggttggggagacccagtcaggacacagcatggacatgacgggtcccgctcagcctccgtgggctcctgctgctcgtcggctcccgaggtcgacctaaagtgtagacactccgagagtcgaccctacgtcctccctctacgttcgtgtcgtgacagtcgttacggacggaacgtacacggtacgtaccaacctactaccgtacggttcgggacccggtactaagtacgaagtacggttattcgacgaacgtcggtcgtacggtaccgtaggtacncggacgacgaacggtaaaccgacgggtaaaccctaccctttaaagttccgacgttactaccgttaagacgacgtactaacgtttacgttaaaggttcgggtaaacggttccggttaacctacggttaaaccggtttaaacgggtccggtccggtaaagtaggtttaccggggaacttccgggtaaacgggtaaaccttaaggttaaaccctcctaaaccggtccgttaaccgacttacgaacggtacggtcccggtaccgtcggtaaccgcgtttacgagtttacgtacgttacgttacggttaaccgacgttttaaacgttacgtaaccgtaaccgtaaccttaacggacgttttaacgaaccggttaccgttaacccgttaccgtccgttaaccggttacggggttaaacccggggaccgggttaaccgggttaacggggaacggtttaacgggtacccgggtaaaccgttaaccggtacgggttaccggttcggtacccgtacggaacccgttacccgtaccgttaacccgttcgggttttaaacccc

SEQ ID NO: 39120 - DNA, 643 bp, Homo sapiens
  misc_feature: GYAE6OF01DTDNW.41.34.D01.1.454.CMB.1.raw
  modified_base (178)..(178): a, c, t, g, unknown or other
  misc_feature (178)..(178): n is a, c, g, or t
  modified_base (636)..(636): a, c, t, g, unknown or other
  misc_feature (636)..(636): n is a, c, g, or t
tcagtctatactatcacgaccggtgctcgatttagatcgtctgtgttgggtttggggagacccagtcaggacacagcatggacatgagggtccccgctcagctccgtggggctcctgctgctctggctcccgaggtgaccaaatgtgacactccagatcgacccagtcctccctcctnttctgtctgctatcgtggtcggagacagacgtcaccatctacgttcgcccgggcagtcagtagtatcgaccacgtacggtcggttcggccgttggtactacgagaccgaaacgaaaccggaagggaaacctaccccttaattccgtagacttcgtagtcgagtctatacgttaagttaggtaacggtcggtacctagtacgtaggttcggacgacgtaggtggatcggtaggactaagtacttcacctcgtactacgtactacgacgtcccggtactcggacgacgtaccgtagactggtacgtcgtaccgtacttaacgttattaccgactaacctaacgtattacgtacgtaccgttaccgtccgtacttcgtaccgttacgggaccggtacgggaccgtaggggtacggtaacgtacggaggttccgtaagtcgggtacgtcgtacacctacgtnttcgtcg

SEQ ID NO: 39121 - DNA, 787 bp, Homo sapiens
  misc_feature: GYAE6OF01BLEDW.41.34.D01.1.454.CMB.1.raw
  modified_base (195)..(195): a, c, t, g, unknown or other
  misc_feature (195)..(195): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatcgacccagtcctccctccattctgtctgcatctggtcgganacagagtcaccatccacgttcggcccggacctagtcaggtacgttattcggaccaccgtacggtccggtttcgggcccgtttaggttactaccgacggaccgaaaccggaaaaccgaacgggggtaaaacctaaccccccgttaaaatttcccgtaagtacttaccgtaacgtaccgaggtacctaacgttactttaaaggtttagggtaaaacgggttcggggttacccctaagttacggtaaacgggtttaggccggtagtaagggttggtaactcggttaagggaacctaggtaaaccttttccgaaccttccgtacgtaccgtacgttaccgacggtcccgtccgtacgtaccgacggttcccgtaggacgtacgtacgtacggttaccgtaaccgttaactttaaccgttactaccgtaacccgtaacgtcttaaggtcgtaaaccgtttaccgttaccccgtacttacccgttaccgggtttccgggaacggtaacgggtaccggtaagggttacgggaccggttagaaccgggttacgtaaacgggtcgttacggacgttaccgacctaacgttgtcgttacccg

SEQ ID NO: 39122 - DNA, 852 bp, Homo sapiens
  misc_feature: GYAE6OF01CT9I6.41.34.D01.1.454.CMB.1.raw
tcagtctatactatcacgaccggtgctcgatttagatcgtctgtgttgggtttggggagacccagtcaggacacagcatggacatgacgggtccccgctcagctccgtggggctcctgctgctcgtggctccaggtcgaccaaatgtgacatccgagactcgaaccctgttcctcccctctattctcgtctacgctatcgtggtacggagacctaggactccaactacttaccgtacgttccgggacccggtacacgttaccgtagacgttatcgacctaacgtcggttcggtagtcccgtaggtaactcgtaacgaccgaacgtaaaccgaacgggtaacctacccctttaatcccgtagtcgtactacgtaccgtaggtaccttaagttacgtttaaacggtttaccggggtaaaaggttcccgggtacctaaggttaacggttacggttacggacggtacgtagggttacggtaaccgtcggtaacgggaacgttaaacggtaccttaacgtaaccgttccgaacgttaccgtagtaccgggtaccggtacccggtacctaacgggccgttacggttccgttaacggtaacgtacgggttaccctaacggtttacggtaaacccctttaaggtttaaacgtttcccgtaaccaacccgttaagtaactaaaccggttccgttaaacccgtttcccgttaacccgcgtttaccggtacccgggttaaccgggtaacggggtaccgtaaacgggttaaccgggtacgtaaggggtacccggttaaacggtcgtaccgggttaacggttccgtaaccgtccgttaaaccctacggttccgtttcttacccgg

SEQ ID NO: 39123 - DNA, 736 bp, Homo sapiens
  misc_feature: GYAE6OF01BZCJQ.41.34.D01.1.454.CMB.1.raw
  modified_base (197)..(197): a, c, t, g, unknown or other
  misc_feature (197)..(197): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatcgaccctagtcctcccctccattcctgtctgcatctgtcgganacagatcaccatcacttggcccggccagtcaagtacgttatgacacgtacgtcggttcggcctggtatccgagactaacggaaaccgaggggaaacctacccccgttaaaattcctagacttctatcgaggctattacttaagtttaggaaacggttcgggtaccccagtacgtaaggtttcgcggtactaggtggtaactcgtaagggacctaagtaacttccgacttaccgtactaacgtacttacgaccggtccggtaccgtacggaccgtaccggaccgttacggaacgttacggtacgttacggtacccgttaccttaaaaccgtttacgtttaacccgtccggtaaaccctaaacgtaccgttaaagttacgtaaccgtttaaccgttacccgtaccgttaccgttaccggttaccgggaaccgggtaaacgggtacccgtaaacgggtcgggtaaaccggtacggtaaacggtaccggtaaacgttcgggtaaccgtcgtacggtaacccgtaccctagttcccggttaccg

SEQ ID NO: 39124 - DNA, 688 bp, Homo sapiens
  misc_feature: GYAE6OF01BBW2T.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgctatctgtcggagacagagtcaccatcacttcgccggccagtcagagtattgacacacgtcgttcggcctggtatcgagacaacggaaaccgaaggggaaacctaccccttaaacttccgtagacttactagtcgaacggactattacgttaaacgtttagggtaaacgggtccgggtacctacgtacggtaacgggtttaggccggtacgtaggttacggagttcggtaagggtaccgtaaggtaacttccgtaacttcctacgaaccgtacgttccgaaccgggtccgtccgtacgcgtacgtccgtagtaagttcgtagtacgtaaccgtattaaaccgttacttaaccgtccaaccgtaacctaattacggtacgttaaacgtttacccgttaacccgtccttaaccgttaccggttacgggacggggtaacggtaaccggtagggtacggacgtaacgaacggtaccgtaggtcgaacgtcgacgacctactcgttccgttcg

SEQ ID NO: 39125 - DNA, 847 bp, Homo sapiens
  misc_feature: GYAE6OF01AXR0B.41.34.D01.1.454.CMB.1.raw
tcagtctatactatcacgaccggtgctcgatttagatcgtctgtgttgggtttgggggagacccagtcaggacacagcatggacatgagggtccccgctcagctcctggggctcctgctgctctggctcccaggtgccaaatgtgacatccagatcgacccagtcctccctccattctgtctgcatctggtcggagacagacgtcaccatcacttggcccgggcagtcaggacgtattgcacacggcgttcggccgtggtactcgagacaacgaaaccgtaacggggaaaccgtacccctaaactttccgtacggtactctacgtcgacggacgtaattacgttaaagtttagggtaaacggttccggggtacctaagtacggttaaaggggtttacggaccgggtacgtaagggtacggtacgttacggtacggggtaacgaaggttaaactttccgtaaccgttcccgtacgtaaccgtaacgttaccggaccggtacccggtccgtacggaccgtaccggtccgttaggagtttacggttacgttaccgtaccgtaaaccgttttaaactttacggtttaacccgtacggaaacccttaaacgtaaccgtttaaggtaactttaaccgggttaacccgggtttaaccccgtcccgtttaacccggttaaccggggttttacccgggggaaccgggggtaaaaccggggtaacccggggttaaacgggggttaaggggtaaacccggggttaaccggaaaacggggttcccgttaaaaccggggtttcgggtacgggtaccggttaccggaaccccgtttaacgtaaccgtttcggttaacccgg

SEQ ID NO: 39126 - DNA, 499 bp, Homo sapiens
  misc_feature: GYAE6OF02IPEX8.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatcgtgggacagaattcactctcacgatcagcgcctgcagcctgatgatgtcgctaacttattactgaccaacactatgaattacgttacccgcttctacgtttcgggcggagggaccaagggtggaggtacaagcgaactggtggctgcaccatctcg

SEQ ID NO: 39127 - DNA, 487 bp, Homo sapiens
  misc_feature: GYAE6OF02HTVFB.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgcttcactttcggcggagggaccaaggtggaggtcaagcgaactgtggctgcacatctcg

SEQ ID NO: 39128 - DNA, 506 bp, Homo sapiens
  misc_feature: GYAE6OF02F4RH3.41.34.D01.1.454.CMB.1.raw
  modified_base (234)..(234): a, c, t, g, unknown or other
  misc_feature (234)..(234): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcanacgcgttggcctggtatcagcagaaaccagggaaacgcccctaaattcctgatctatcaggcatctaattggaaagtgggtcccatcaaggtttagcggcagtggatcgtgggacagtaattcactctcacgatcagcgcctgcagcctgatgatgtcgactaacttattactgaccaacactatgaattacgttacccgctctactttcgggcggtacgggacgtaaggtaggaggtacaaggccgaagtggtcggcgtgcaccatcttcg

SEQ ID NO: 39129 - DNA, 544 bp, Homo sapiens
  misc_feature: GYAE6OF02H1VLO.41.34.D01.1.454.CMB.1.raw
  modified_base (407)..(407): a, c, t, g, unknown or other
  misc_feature (407)..(407): n is a, c, g, or t
  modified_base (424)..(424): a, c, t, g, unknown or other
  misc_feature (424)..(424): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaatcctgaatctatcaggcatctaatttggaaagtgggtcccatcaaggtttagcggcagtggatctgggacagaattcactctcacgatcagcggcctgcagcctgactgatgtcgactaacttattacngacccaaacaccttaangtaattacgttacccgcttacgacttttccgggacggagggacccgaagggtgggaacggttacgaacggtaccgtaaacgttggtacggcgttcggaccgtaacctagtacccgtttcg

SEQ ID NO: 39130 - DNA, 544 bp, Homo sapiens
  misc_feature: GYAE6OF02HVFPH.41.34.D01.1.454.CMB.1.raw
tcagtctatactatcacgaccggtgctcgatttagatcgtctgtgttgggtttggggagacccagtcaggacacagcatggacatgagggtcccgctcagctcctggggctcctgctgctctggctcccaggtgccaaatgtgacatccagatgacccagtctccctcattctgtctgcatctgtcggagacagagtcaccattccacttgccgggcagtcagagtattgcacacgcgttggcctggtatcagcagaaaccagggaaacgcccctaaattcctgatctatcaggcatctaatttaggaaagtgggtacccatcgaaggtttagcggacagtggatcgtaggactagaattcacttctacacgatcacgcgccgtgcgagctagatgatgtcgactaacgttattacgtcgacctaacacttatcgtataacgttacccgacttcgacgtttcggacggtaagggacctaagggttcggtaacggtacgaacggtacgaacgttggtcggtcgtagaccaaccgtatccgttacg

SEQ ID NO: 39131 - DNA, 518 bp, Homo sapiens
  misc_feature: GYAE6OF02JC9EN.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaaattcctgatctatcaggcatctaatttggaaagtggggtcccatcaaggtttagcggcagtggatctgggacagaattcactctcacgatcagcggcctgcagcctgatgatgtcgacaacttattactgaccaacactatacgattacgttacccgcttctacgtttcgggacgtagggaccaagggtcggaagggtccaaaggccgaaactggtacggctggaccacacgttctacgg

SEQ ID NO: 39132 - DNA, 543 bp, Homo sapiens
  misc_feature: GYAE6OF02IX2ZF.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccggccagtcagagtattgcacacgcgttggcctggtatcagcagaaccaggaaacgccctaaattcctgatctatcaggcatctaattggaaagtcgggtccatcaaggtttagcggcagtggatcgtgggacagaattcactctcacgatcagcgctgcagcctgatgatgtcgactaacttattactgaccaacacttatagtacttacgttacccgcttacgtaccgtttcgggacgggtacgggacccgtaaggggtaggaacggtaccaaagggtaccggtaacgttggttacggcgttaggaccctaaccgtagttccgttaccg

SEQ ID NO: 39133 - DNA, 506 bp, Homo sapiens
  misc_feature: GYAE6OF02JAL5B.41.34.D01.1.454.CMB.1.raw
  modified_base (428)..(428): a, c, t, g, unknown or other
  misc_feature (428)..(428): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaacgcccctaaattcctgatctatcaggcatctaattggaagtgggtccatcaaggttagcggcagtggatcgtgggacagaattcactctcacgatcagcggcctgcagcctgatgatgcgactaacttatactcgaccaacactatgatacgttacccncttactacgtttcggcggtaggaccgaagggtcggaggtacaaggtccgaacgtggtacggctggacctacatcgtcg

SEQ ID NO: 39134 - DNA, 507 bp, Homo sapiens
  misc_feature: GYAE6OF02HBMPZ.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatcgtgggacagaattcactctcacgatcagcggcctgcagcctgatgatgtcgctaacttattactgaccaacactatgattaacgttacccgcttctaccgtttcgggcggtacgggaccaagggtggaacggtcaaggcgaacgtggtggctgacaccatctcg

SEQ ID NO: 39135 - DNA, 544 bp, Homo sapiens
  misc_feature: GYAE6OF02IS13D.41.34.D01.1.454.CMB.1.raw
  modified_base (385)..(385): a, c, t, g, unknown or other
  misc_feature (385)..(385): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaacgccccctaaattcctgactctatcaggcatctaattggaaagtgggtcccatcaaggtttagcggcagtggatcgtagggacagaattcactctcacgatcagcgctgcagcctnatgatgtcgtacaacttattactgaccatactatgtaacttacgttacccgattccgtacgtttccgggacggtacgggaccgtaaggggtcggaacggtacgaaacggccgtaaacggttggtacggtacttacggacctaccgtacgtcgttaccgg

SEQ ID NO: 39136 - DNA, 526 bp, Homo sapiens
  misc_feature: GYAE6OF02I9A29.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgcccgggccagtcagagtattgcacacgcgttggcctggtatcagcagaaaccagggaaacgcccctaaattcctgatctatcaggcatctaatttggaaagtggggtcccatcaaggtttagcggcgagtggatcgtgggacagaattcactctcacgatcagcggcctgcagcctgactgatggtcgactaacttattactgaccaactactatagaacttacgttacccgcttctacgtttcggacggtaggaccgaagggtacggaggtacgaacggtacgaacgtggtggtactcgacaccgtagtcttcg

SEQ ID NO: 39137 - DNA, 554 bp, Homo sapiens
  misc_feature: GYAE6OF02IQ49L.41.34.D01.1.454.CMB.1.raw
  modified_base (271)..(271): a, c, t, g, unknown or other
  misc_feature (271)..(271): n is a, c, g, or t
  modified_base (363)..(363): a, c, t, g, unknown or other
  misc_feature (363)..(363): n is a, c, g, or t
tcagtctatactatcacgaccggtgctcgatttagatcgtctgtgttgggtttgggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaancccctaaatcctgatctatcaggcatctaatttggaagtgggtccatcaaggtttagcggcagtggatctagggacagaatcactctcacgntcagcggctgcagctgatgatgtacgactaacgtttattaactgacccaatacttaatgtaattacggttaacccgcttccgaacgttttcgggacggtaacggggacctaaaggggtcggtaagggtaccaaagggccggtaaacgttcgggtacggacgttcggacccgaaccgtacttacgttaccgg

SEQ ID NO: 39138 - DNA, 576 bp, Homo sapiens
  misc_feature: GYAE6OF02HGZJY.41.34.D01.1.454.CMB.1.raw
  modified_base (224)..(224): a, c, t, g, unknown or other
  misc_feature (224)..(224): n is a, c, g, or t
  modified_base (282)..(282): a, c, t, g, unknown or other
  misc_feature (282)..(282): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggcagtcagngtatgcacacgcgttggcctggtatcagcagaaaccagggaaacgcccctaaattccngactctatcaggcatacttaagtttgggaaagttcggggtaccccagtacgtaaaggtttacgcggtacaggtggatcgtagggacaagtaacttcactctacacgatcgacggcgctgcacgtctgatgagtgtacactaacttacttactgacctaactacttaatacgtaacttaccgttacccgcttaccgtacgtttaccggggacgggtaaccgggaccgtaagggtcgggtaaggtaccgaaggtaccgtaacgtggtacggcctacgacctaccttagtccttacg

SEQ ID NO: 39139 - DNA, 590 bp, Homo sapiens
  misc_feature: GYAE6OF02G6UAP.41.34.D01.1.454.CMB.1.raw
  modified_base (271)..(271): a, c, t, g, unknown or other
  misc_feature (271)..(271): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcaagaaccagggaaacnccctaaatcctgatctatcaggctatacttaagttggaaaggtcgggtaccagtcaaggtttagcggcaggtggatcgtggacagtaacttcgactctacgacgtatcgacggcgcctgcagcctgactgatcgtccgactaacgtttacttaccgtagtacccaacgtaaccgttattacggtaaactttaccgttaaccccggtctttaccgtaccgtttccggggaccggtaaggggtacccgtaagggtacggaacggttacgaacggtaacgtaacgtcgggtacgtcgtacggacccaccgtacgtaccgtcg

SEQ ID NO: 39140 - DNA, 585 bp, Homo sapiens
  misc_feature: GYAE6OF02GSMB2.41.34.D01.1.454.CMB.1.raw
tcagtctatactatcacgaccggtgctcgatttagatcgtctgtgttggggtttggggagacccagtcaggacacagcatggacatgagggtccccgctcagctcctggggctcctgctgctctggctcccaggtgccaaatgtgacatccagatgacccagtcctccctccattctgtctgcatctgtcggagacagagtcaccatcacttcgccgggccagtcagtagtatcgccacacgcgttcggcctggtactcagcaagaaaaccgagggaaacaccccgtaaattccagactctatcgaggcagtcctaattaggaaggtcgggtaccctatcgtaaggtttagcggtcgaggtgagtcgagggactagaacttcactctcacgactcgacggtcgcctgccaggcctgatcgagttgtacgaccttaattctaacctcgaacctaactacttattacgtacttaaccgttacccgcgttaccgtacgtttccgggacgggtacggtaaccgagggtacggaacggtacgaacggcgtaaccgtgtacggaccttcggaccctacgtacttcgttccg

SEQ ID NO: 39141 - DNA, 594 bp, Homo sapiens
  misc_feature: GYAE6OF02IBDAS.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccggccagtcagagtatgcacacgcgttggcctggtatcagcaagaaaccgagggaaacgcccctaaattcctgatctatcaggcatacttaagtttggaaagtgggtaccctagtacgaaggtttagcggctagtggatcgtaggactagaacttcactctacacgatcgagcgcctgcacgtcgtgagtgtagtcgtacgtactaactttacttactagaccgtaaactaccttagtagaacgttaaccgttacccgtaccttaccgtaccgttttaccggaccgggtaacgggaccggtaagggtacgggtaacggtaccgaaacggtacggtaacgttacggtcgtccggtacgaccgtaacccgtactccgtttaccg

SEQ ID NO: 39142 - DNA, 553 bp, Homo sapiens
  misc_feature: GYAE6OF02H5GO0.41.34.D01.1.454.CMB.1.raw
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcaagaaaccagggaaacgacccctaaatccctgatctatcaggcatctaatttggaaagtgggtcccatcgaaggtttagcggcaggtggatcgtggacagaattcactctcacgtatcgacgcgctgcagcctgatgatcgtcgactaacttattactacgacctaactactaagtgtaacgtaccgttacccgccttacgtaaccgtttcgggcggtaacgggaccgtaagggtacggaacggttaccaacggtacgtaacgtggtacggtcgtcggacctaaccgtattcgttacg

SEQ ID NO: 39143 - DNA, 550 bp, Homo sapiens
  misc_feature: GYAE6OF02IQ7A5.41.34.D01.1.454.CMB.1.raw
  modified_base (269)..(269): a, c, t, g, unknown or other
  misc_feature (269)..(269): n is a, c, g, or t
  modified_base (405)..(405): a, c, t, g, unknown or other
  misc_feature (405)..(405): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccggcagtcagagtattgcacacgcgttggcctggtatcagcagaaaccagggaaacnccctaaatcctgatctatcaggcatctaattggaaagtgggtccatacgaaggtttagcggcaggtggatcgtgggacagtaattcactctcacgatcgagcgcctgcagcctgatgatgtcgctaacttattacngacctaacactatcgaattacgttacccgtactaccgtaccgtttcgggacggtaacgggaccgtaagggtcggaacgggttaccgaaaggtccggtaaacgttgggtacgggtccgtacgacccgtaacctacgttcgttaccg

SEQ ID NO: 39144 - DNA, 768 bp, Homo sapiens
  misc_feature: GYAE6OF02IVDA1.41.34.D01.1.454.CMB.1.raw
tcagtctatactatcacgaccggtgctcgatttagatcgtctgtgttgggtttgggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcactgccggccagtcagagtatgcacacgtcgttggcctggtatcagcgaagaaaccgagggaaacacccctaaattcctgatctatcaggctattactaaagtttagggaaacggttcggggtacccctagttaccgtaaagggtttacggaccgggtacgtaagggttcggtacttccggtaggggtaacctaaaggtaaactttaccgtaaccttaccgtacccgaacgtactacggaaccggtcccggggtaccttaccgggacccgtacggtacccgtagggtaactaccgggtagttaccggttaccgttaacccgttaaaccttttaacgtttaacccgtaccggtaacccctaaacgttaaccttaagttacggtaaaccgttttaacccggttaaccccgtcgtttaacccgttaaccggtttaccgggggaaccgggtaaccggggtacccgtaaagggggtttccggaaacgggttaccgaaacgggttaaccggtaacggttggttaccgggtacgttaccgaccgttaacccgtagttcccgtttaacg

SEQ ID NO: 39145 - DNA, 545 bp, Homo sapiens
  misc_feature: GYAE6OF02HR92H.41.34.D01.1.454.CMB.1.raw
  modified_base (191)..(191): a, c, t, g, unknown or other
  misc_feature (191)..(191): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
  modified_base (494)..(494): a, c, t, g, unknown or other
  misc_feature (494)..(494): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctcattctgtctgcatctgtcgganacagagtcacatcacttgccgggccagtcagagtattgcacacgcgttggcctggtatcagacaagaaaccgaagggaaacacccctaaaattcctagattctaatcaggcatctaagtttaggaaagttcggggtcccagtacgtaaaggtttgcggactagtggatcgtggaacagtaattcactctacaacgtatcgagcggcctagcagcctgatgatgtcctactaacttacttaacncgaccaactctaatnaattacgtacccnctactacgttcgggacgtacgggacgtaaggnggtaacgtacgaagtccgaagttgtacggcgtacgacctaactgttcctag

SEQ ID NO: 39146 - DNA, 589 bp, Homo sapiens
  misc_feature: GYAE6OF02H1RV1.41.34.D01.1.454.CMB.1.raw
  modified_base (356)..(356): a, c, t, g, unknown or other
  misc_feature (356)..(356): n is a, c, g, or t
tcagtctatactatcacgaccggtgctcgatttagatcgtctgtgttgggtttgggggagacccagtcaggacacagcatggacatgagggtccccgctcagctcctggggctcctgctgctctggctcccaggtgccaaatgtgacatccagatcgacccagtctccctccattctgtctgcatctgtcggagacagagtccaccatcacttgccgggccagtcagagtatgcacacgcgttggcctggtatcagcaagaaaccgagggaacgaccccttaaactccgtagactctatcgagcattactaatttagggaaaggtcgggtaccctagtacgtaaggtttacgcggngaggtggatacgtgggacagtaacttcactcacacgactcgacgcgtccgtcgcgcgcgtagatagatcgttacgtacttaaccttacttaccgtcgacctaactactattacgtaattaccgtacccgtctaccgttacggttccgggacgggtaccggaccggtaagggtcgggaacggttacgaagggaccgtaacggtggtacggcgtacgtacaaccgttctcgttcg

SEQ ID NO: 39147 - DNA, 673 bp, Homo sapiens
  misc_feature: GYAE6OF02IS9EU.41.34.D01.1.454.CMB.1.raw
tcagtctatactatcacgaccggtgctcgatttagatcgtctgtgttgggtttgggggagacccagtcaggacacagcatggacatgagggtccccgctcagctcctggggctcctgctgctctggctcccaggtgccaaatgtgacatccagatgacccagtctccctccattctgtctgcattctgtcggagacagacgtcaccatcacttggcccggccagtcagtagtatgcacacgcgttgccgtggtatcagcaagaaaccgagggaacaccccttaaatcctgatctatcgacggctatacttaagtttagggaacggttcggggtacccagttactaagggttttaggcggagtaggtcggtattcgtagggacgagtaaacttccaacttctaccgaacgtactacgacggcccgggtccgtaggacctagccgtaggtaacgtgtacgtgttaccgtacttaacgtttacttaacgtacgacctaactacgttagttagtaacgtttaccggttaccctccgtttacctaccggttttacggggaccggtaacggggtaaccgtaacggggttaggggtaaccggtaccgaaagggtaacccggttaaggttacgggttacggtaccggttacggaccctaacccgtagtttacccgttccgg

SEQ ID NO: 39148 - DNA, 589 bp, Homo sapiens
  misc_feature: GYAE6OF02IHEOQ.41.34.D01.1.454.CMB.1.raw
  modified_base (396)..(396): a, c, t, g, unknown or other
  misc_feature (396)..(396): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcacatcacttgccggccagtcagagtattgacacacgtcgttggcctggtatcagcagaaaccgagggaaacgaccccttaaattccctagtatctatcaggctatctaagttaggaagtgggtccagtcgaaggttagcggataggtggactcgtagggactagtaatcactctcacgatcgagccggcctgaccngtcctgatgtagtcggttacgtacttaaactttattaccgtcgaaccctaactaacttaagtcgtaacttaaccggtttacccgaccttacgtaccgtttcgggaccgggtaagggacccggtaagggtcggtaacgggtaccaagggtaccgtaacgtgggttcggactacggtaaccacctacgtcgttcg

SEQ ID NO: 39149 - DNA, 793 bp, Homo sapiens
  misc_feature: GYAE6OF02GKQAK.41.34.D01.1.454.CMB.1.raw
  modified_base (252)..(252): a, c, t, g, unknown or other
  misc_feature (252)..(252): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctcctattctgtctgcatctgtcggagacagagtcacatcacttcgccggccagtcagagtattgcacacgtcgttcggctggtancgagacaacggaaaccgaagggaaacgtacccctaaaacttaccctacggattactacgtacgaggcctaataccttaagtttacgggtaaaggttacggggtaccctaacgttaccgttaaacgggttttaacggaccgggtacggtaaggttacggtaacggttccggtaacggggtaactaacggtaaacgtttacctaacgtacccgttacctaacgggtaactaccgtacgggtacccggtacccgtacggaccgtaacggtcccgttaggacgtttaggaacgttagggttccctaacgtttaaacctttaacgttaccgttaccggtacccaaacgtttaacgtaacttcggtaacgtttaacccgtttaaccccgtcgtttaacccgttaccgtttaccgggggaccggggttaacgggaacccgggtaagggttacggggaacggttaacggtaaacggtacccggttaaaagggttcggttcccgggtacgtaccggttaaccccggtacgtttacgttacccggtttccg

SEQ ID NO: 39150 - DNA, 763 bp, Homo sapiens
  misc_feature: GYAE6OF02F0YK0.41.34.D01.1.454.CMB.1.raw
  modified_base (193)..(193): a, c, t, g, unknown or other
  misc_feature (193)..(193): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctccattctgtctgcatctgtcgganacagatcaccatccacttcggccgggaccagtcagagtatgcacacgcgttgctgtatcagcaacgaaacgagggaaactcccctaaattccgtagatctatcaggcaattactaagttttagggaaacggttcggggtaccctaagttacgtaaaggggtttaccgcgggtacgtagggtcggtaagttacggtaggggtaacaaggttaacgtttacctaaccgtttccgttaccgtaaccggtaagtttacccgaacgggtacccggtacccgttcggaccgtaaccggtcccgttaagacggttaggtacgttcggttaccgtaacttaaacccgttttaacgtttaaccgttacccgtaacccttaaacgtaaccgttaagttaacggttaacgttaaccggtttaacccccgtccgtttaaccgttacccggtttaccggggtaaccgggttaacggggtaacccggtaaaggggttacgggtaaacgggttaacgtaaacgggaaccgttaacggttacgggtcgtaccggtaccgtaccgtacccgttagttcccgtttacg

SEQ ID NO: 39151 - DNA, 627 bp, Homo sapiens
  misc_feature: GYAE6OF02GCZXC.41.34.D01.1.454.CMB.1.raw
  modified_base (192)..(192): a, c, t, g, unknown or other
  misc_feature (192)..(192): n is a, c, g, or t
  modified_base (396)..(396): a, c, t, g, unknown or other
  misc_feature (396)..(396): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctcattctgtctgcatctgtcgganacagagtcaccatcacgttggcccggcagtcagagtatgcacacgtcgtggcctggtactcagcaacgaaaccgagggaaacctacccctaaattccctagtactactaactacgaggactaattacgttaagttagggaaaggtcgggtacccagttacgtaggtttacgcggtcaggtggtatcggaggactaagtacttcnctcgacacgatcgacgcggtctcgcgacgtctggatcgtagtcgtacgtacttaacttacttacgccgaacctaaactaccgttaatccgttaacgttaccggttacccgtccttacgttaccggttaccgggacgggtaaccgggtacgtaacggggtacgggtaacggtacctaagggtacccgtagttcgggacggttacgcggtacctacgttacgttccgtttacg

SEQ ID NO: 39152 - DNA, 534 bp, Homo sapiens
  misc_feature: GYAE6OF02IEFWI.41.34.D01.1.454.CMB.1.raw
  modified_base (193)..(193): a, c, t, g, unknown or other
  misc_feature (193)..(193): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
  modified_base (423)..(423): a, c, t, g, unknown or other
  misc_feature (423)..(423): n is a, c, g, or t
tcagtctatactatcacgaccggtgctcgatttagatcgtctgtgttggggtttggggagacccagtcaggacacagcatggacatgagggtccccgctcagctcctggggctcctgctgctctggctcccaggtgccaaatgtgacatccagatgacccagtctccctccattctgtctgcatctgtcgganacagagtcaccatcacttgccgggccagtcagagtattgcacacgcgttggcctggtatcagcagaaaccgagggaacgcccctaaatcctgatctatcaggcatctaatttggaagtgggtcccagtcaagttagcggnagtggntcgtggacagatcactcncacgatacgagcggcctgcagtccngagtgatcgtcgactaacttattactgacccaatactagtnagttacgttacccgcttactaccgtttcggacggtacggacgtaagggtaggacggtacgaacggtaccggtaacgtcggttacggctacggcctacctacgttcgttacg

SEQ ID NO: 39153 - DNA, 660 bp, Homo sapiens
  misc_feature: GYAE6OF02HGUE6.41.34.D01.1.454.CMB.1.raw
  modified_base (192)..(192): a, c, t, g, unknown or other
  misc_feature (192)..(192): n is a, c, g, or t
  modified_base (271)..(271): a, c, t, g, unknown or other
  misc_feature (271)..(271): n is a, c, g, or t
  modified_base (291)..(291): a, c, t, g, unknown or other
  misc_feature (291)..(291): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcgganacagagtcaccattcacttcgccgggcagtcagtagtattgcacacgtcgttggctgtatcagcacgaaaccaggaacncccctaaatcctgactctancagcatctaatttggaaagtcggggtaccagtactaagggtttacgacggcgaggtcggattcgtagggactaagtaattccgaacttccgtacaacgtattccgaggtacccgggtccttacggacctacgtccgttaggacttacggtaattcggttacgtaacgttaacctttaattaccgtacgaacccgtaacttaaccgtaagttacgtaacgttaccgtttaaccccgctttccgttaacggttacgggaccgggaacgggtaccggtaacggggtttcgggaaacgggttaccgaacgggtaacccgtaaacggttcgggtaccggtacgttccgaccgaaccgttacgttcgttacccgg

SEQ ID NO: 39154 - DNA, 599 bp, Homo sapiens
  misc_feature: GYAE6OF02I7FHS.41.34.D01.1.454.CMB.1.raw
  modified_base (275)..(275): a, c, t, g, unknown or other
  misc_feature (275)..(275): n is a, c, g, or t
tcagtctatactatcacgaccggtgctcgatttagatcgtctgtgttggggtttggggagacccagtcaggacacagcatggacatgagggtccccgctcagctcctggggctcctgctgctctggctccaggtgccaaatgtgacatccagatgacccagtctccctcattctgtctgcatctgtcggagacagagtcacctatcacttggccgggccagtcagtagtatgccacacgtcgttggcctggatcaagcaagaaccgagggaaacncccttaaatcctgatctatcagctatacttaagttaggaaagtcgggtacctagtacgtaaggttacgcggactaggtaggacgttcgaacgggtacaggtaacttaccacgttactacgacgtactagacggaccgctgccgagtccgtagactcgatcggtactacgtaactttataccgtgaaccctaaatacctagttacgtaacttacccggttaaccgcctttaaccgtcggtttaaccgggcgggtaaccgaccgtaagggtcggtaacgttacgacgtacggacgttcggtagcgtcgacccacgtactcgttacg

SEQ ID NO: 39155 - DNA, 690 bp, Homo sapiens
  misc_feature: GYAE6OF02II4A2.41.34.D01.1.454.CMB.1.raw
  modified_base (214)..(214): a, c, t, g, unknown or other
  misc_feature (214)..(214): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
tcagtctatactatcacgaccggtgctcgatttagatcgtctgtgttgggtttggggagacccagtcaggacacagcatggacatgagggtccccgctcagcctccgtggggcctcctgctgctctggctcccaggtcgaccaaatgtgacatccagatgacccagtcctccctcattctgtctgctatcgtggtcggaagacagacgtccacntccgtacgttcggacccgggctagtacaggtattagttggaccacgaccgtggttcggccttggtactcgagtcaaaggaaacccgtaagggaaaccaccccttaaagttcctagtacttacgatacgcgactatacgttaagttaggaacggttccgggacctaatacggttaagggttacncgggtactagggtaggtacgttacggtacgggtaanacgttaatttacccgaagtccctaacgtacgactacgtcgccgggtactagcgtacgtctagtatcggtatccgttacgtacttagttaacgtacttacgacctaaacgtacttaacgtagtaaccgtttaccgtacccgtcttacccggtacggttcgggtaacgggacggaccggtagggtcggtaaacgggtaccacggggtaactcggttacggttcggaccctacggaacccgtacgtaccgttcgtttacg

SEQ ID NO: 39156 - DNA, 805 bp, Homo sapiens
  misc_feature: GYAE6OF02F0CUI.41.34.D01.1.454.CMB.1.raw
  modified_base (195)..(195): a, c, t, g, unknown or other
  misc_feature (195)..(195): n is a, c, g, or t
tcagtctatactatcacgaccggtgctcgatttagatcgtctgtgttggggtttggggagacccagtcaggacacagcatggacatgagggtccccgctcagctcctggggctcctgctgctctggctcccaggtgccaaatgtgacatccagatcgacccagtcctccctccattctgtctgcatctgtcgganacagcgtcaccatcacgttcgccgggaccagtcgaagtacgttattggaccacgtaccggtcggttcggccgttaggtactccgaacgaccgtaaacggaaacccggtaaggggaaacctaccccttaaaagtttcccgtagtaacttacctaacgttccgaacggacctaacgttaacgttaaggtttaacgggaaacggttccgggtaccctagttacggtaaaggtttcggaccggtacgtaggtacgtacgtcggtagggaaccagtaacttccgaacttccgtacgaacgtactccgaacggtccggtacccgtgaccgttaccgtcgtacggacgttacgtacgttaggtacccttaacggtttaaaccttttacgttccgaaccgttaccctaaaccgttacgttaaggtccgtttaaaccgtttaacccgggtccccgttaaccgtttccgttaacccgggtttacggggaaccggggttaacggtaaccgggtaaggggttaccggggtaaactacccggtaaacggttccggttaaaccggttcgggttacggtcccgttacccggaccggtttaaccctaggtttaccccgtttaccgg

SEQ ID NO: 39157 - DNA, 608 bp, Homo sapiens
  misc_feature: GYAE6OF02HH7QG.41.34.D01.1.454.CMB.1.raw
  modified_base (257)..(257): a, c, t, g, unknown or other
  misc_feature (257)..(257): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctccattctgtctgcatctgtcggagacagagtcaccatctacttcggccggcagtcaagagtatgcacgacggtcgttcggcctggtancagacgaacgaaaccgaagggaaaccaccccttaaattccgtagacttctatacgagctactacgttaagttaggaaggtcggtacctagtacgtaaggttcgcgagaggtggtactcgtaggacaagtactcgactctacgacgtatacgacggccgtctcgacnggtcngtacgtgtagtcggtactacttaaacttagttacactacctaaactagtacttacgtaacgttaccgtacccgtacttaccgtccggttacgggaacggtacgggtaccgtaagggtcggtaacggtacgaacgtacggtaacgtgggtaccgtgtcccaacgtacttacgtcttaccgg

SEQ ID NO: 39158 - DNA, 620 bp, Homo sapiens
  misc_feature: GYAE6OF02FH4LT.41.34.D01.1.454.CMB.1.raw
tcagtctatactatcacgaccggtgctcgatttagatcgtctgtgttgggtttgggggagacccagtcaggacacagcgatggacatgagggtccccgctcagctcctggggctcctgctgctctggctcccaggtgccaaatgtgacatccagatgacccagtcctccctccattctgtctgcatctgtcggagaccagagtccaccatcacttgccgggccagtcagtgtattgcacacgcgttgcctggtatcagcagaaaccagggaaacgcccctaaattcctgactctatcaggctatactaagtttaggaaaggtcgggtaccccagtccgtaaaggtttacgcggtcaggttggatcgtaggggactaggaactttcacttctaccacgactaccgagccggtcctgcacgcctgatgatggtacacctaaacgtttacttactacgtaccctaaactaccgtaatacgtaaacttacgttacccgtacttaccttaaccgtttccgggaccgggtaacgggtacccggaaggggtcgggaacgggttaccgaaacggtaccgtaaccgtacggttacgggacttaccggacctacccgtacttccgttacg

SEQ ID NO: 39159 - DNA, 602 bp, Homo sapiens
  misc_feature: GYAE6OF02JPCT5.41.34.D01.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (540)..(540): a, c, t, g, unknown or other
  misc_feature (540)..(540): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatcgaccctagtcctcccctcctattctgtctgcagtctgcggagacagngtacacatctacgttggccggcagtcagtatatgacacncgtcgtgctgtancacgacagaacgaggaactacctaatcgngatactancgagacgtatacttaagttacggaagtccggtcctagtacgtaacggttcggcgtacgtaggtcgtagtacgtagggactagttaacttctacgtcctacgacgtactcgacgacgttctcgacgtcgtctagtctaggtactcgtacgattacgtacttcgaccactactaacgtagtcgtaactacccggttcctacgttacgttaccggtacgggacgggtaaccgtgggtaacgggtaccggtanaaccggtacggtaaccgtagttcggtcgttaccgacctaccggtccttagttcctttacccg

SEQ ID NO: 39160 - DNA, 674 bp, Homo sapiens
  misc_feature: GYAE6OF02FT92J.41.34.D01.1.454.CMB.1.raw
  modified_base (193)..(193): a, c, t, g, unknown or other
  misc_feature (193)..(193): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtcctccctcattctgtctgcatcgtgtcgganacagagtaccaccatcacgttcgccggcagcagagtatgcacacgtcggttcgcttcggtatacgacgacaacgaaaccgaacgggaaacctacccttaaagttccgtagattcgtaatcgacggactataacgttaacgttaggaacgtcgggtaccagttaccgtaaggtttacggacgtagtaggtaggtacgtaggttaacgggaactaacggttaacttaccgtaaccgttcgtaaccacggttacgtacggaacggtccgtaccgttcgaccgacgtactacggtaagttcgaacgttcgacggaactttaacgttaactacgtaacgtacccaacgtctaagtaaccgtagttaccgtaccgtacgttacgtccgttacgggaccggaacggttacgaacgggttcggtaacggaccgtaaacgcggttaaccgtggtaccgtacgtaccgtaccggacttacgttcgttaccg

SEQ ID NO: 39161 - DNA, 650 bp, Homo sapiens
  misc_feature: GYAE6OF02GL0UT.41.34.D01.1.454.CMB.1.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (484)..(484): a, c, t, g, unknown or other
  misc_feature (484)..(484): n is a, c, g, or t
  modified_base (599)..(599): a, c, t, g, unknown or other
  misc_feature (599)..(599): n is a, c, g, or t
tcagtctatactatcacgaccggtgctcgatttagatcgtctgtgttgggtttggggagacccagtcaggacacagcatggacatgagggtccccgctcgagctccgtggggctcctgctgctcgtggctcccaggtcgaccaaatgtgacatccagactcgacccagtcctccctctattctgtctgactntcgtgtcgganacagacgtcaccatctacgttcggccggaccaggtcaggtatacttgacacgtcgtcggtcgccgtggtactcgacgacgtaacgaaacggaacggtaacgacccttaaacgttccagtactactacgtcgaacggctaacgtacgttaagttacgggtaaacgtccggggtaccaggttacgtaagttcggaacgtcgaggttacgagttaccgtaggaacagtaacttcacgtacctagacgacgtacgacggtcgaccgttcgctaacgtgtctaagngtacgttcgaacgtcttaacgttacgtacttcgaacctagtacgtactacgtacgtaccgttacccgtaactcgtaacggttcgggaacggtacggtaacggtcggaaccggtanaaccgtacggtaacgcgtacggtcgaccggttctccgacttgttcgttacg

SEQ ID NO: 39162 - DNA, 682 bp, Homo sapiens
  misc_feature: GYAE6OF02JQ8DX.41.34.D01.1.454.CMB.1.raw
  modified_base (153)..(153): a, c, t, g, unknown or other
  misc_feature (153)..(153): n is a, c, g, or t
  modified_base (196)..(196): a, c, t, g, unknown or other
  misc_feature (196)..(196): n is a, c, g, or t
  modified_base (323)..(323): a, c, t, g, unknown or other
  misc_feature (323)..(323): n is a, c, g, or t
  modified_base (456)..(456): a, c, t, g, unknown or other
  misc_feature (456)..(456): n is a, c, g, or t
  modified_base (478)..(478): a, c, t, g, unknown or other
  misc_feature (478)..(478): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagntcgacccagtcctccctaccattctgtctgctatctgtcgganacagacgtcaccatcacgttcggcccggcctagtaccagtagttactgaccacgtacggtcgttcggccgttgtactcagacgaacgtaaaccgaagggtaaccacccttaaacttcccgtagactntacgtcgacggtactaattacgttaacgtttaggaaacgggtccgggttaccctaagttcggtaaacgggtttcgacgggacgtaagtggtacgtcggtacggatacgtacttctacgtcctaacgacgttanacgcggtaccgcgtacgtaccnggttaccagtagtggtaccttaggacctaacgtttaaacttcgttaaccgtccgtaaccgttaactacgtaacgttcgtaaacgtttcccgtacccgtacttccggttacgttaccgggacggtaacggcgttaaagggtcgaacgttacggaatcccgggtaatggttacccgactacgtacccgtaacttgttacccttccg

SEQ ID NO: 39163 - DNA, 753 bp, Homo sapiens
  misc_feature: GYAE6OF02JHL12.41.34.D01.1.454.CMB.1.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
tcagtctatactatcacgaccggtgctcgatttagatcgtctgtgttgggtttggggagacccagtcaggacacagcatggacatgacgggtccccgctcagctccgtggggctcctgctgctctggctcccaggtgccaaatgtgacatccagatcgacccagtcctccctcctattctgtctgacatctgtacggagacagagtcaccaatccgacttcggcccgggaccagtcaagtagttacgttgacctaacgaccgtcggttacggtacgtacggtagtacgacnggtaaacccagggaaaacnccgggtaaaaaggtccccctaaagtacctcgtaagtcctaaggccaaggtccaatttcggtaaaacgtttggggtaaaccgtagggggttacccaaaggtttacgaaacggtttagaccggtgtaagttacggtaggtacgtagggtaactacgtaaacgttctacgtacgtacgtaacgagtacgacgtacgggtaccctaggtaccgtagaccgttagaacgtagtaacgtacggtaacgttacgtaaaccgtttaagtacctaacgtaaccgtaacctacgtaacttacgtaaccgtaacgtttaacccgacgtttaccgaacggtttacgggtaaccgggtaacggggtaaccgtaacgggttacggtaaacggttaccggaaacggtaccggtaacgtacggttacggaccgttacgtaaccgttaccgtagttaccg

SEQ ID NO: 39164 - DNA, 804 bp, Homo sapiens
  misc_feature: GYAE6OF02FXF7D.41.34.D01.1.454.CMB.1.raw
  modified_base (138)..(138): a, c, t, g, unknown or other
  misc_feature (138)..(138): n is a, c, g, or t
tcagtctatactatcacgaccggtgctcgatttagatcgtctgtgttgggtttggggagacccagtcaggacacagcatggacatggacgggtccccgctcagctccgtggggctcctgctgctctggctcccaggtnaccaaatgtcgacatccagatcgacccagtcctccctcattctgtctgctatcgtggtacggagacgagtacgtcaaccgtatcctacgtcggacccggacagtacgagtaagttactacgacctaacgtcggtccggtttcggccgttaggtactcgaacgacgtaaacggaaaccggaacgggtaacccgttaccccttaaaagtttcccgaaggttaaccttcgttaaccgtaccggaacggtaccttaaagtttaccgttaaaggtttaacgggaaacgggttccgggtaaccctaaggttaaccgttaaagggtttacggacccggtaagttaagggtcggttaactaaccggggttacgggtaaactaaggttaaccttccgtaaccggttactaaccgtaacggttaccgtccgaaccgggtcccgggtactacggtaaccgtcggaactacgtaaggtcccgtaaggttacccgtaagtacccttaaagttaccgtaccgacgtaaacctaacgtactacggttcttaaccggttcgttaacccgcgttaccttaccggggtacggaaccggttaaggaccggttaggaaccggtaccgtaaggaacgttaccggaaggttgtccggtacgaccctacgacgttacgttacgtacccg

SEQ ID NO: 39165 - DNA, 843 bp, Homo sapiens
  misc_feature: GYAE6OF02IRIC7.41.34.D01.1.454.CMB.1.raw
  modified_base (197)..(197): a, c, t, g, unknown or other
  misc_feature (197)..(197): n is a, c, g, or t
  modified_base (831)..(831): a, c, t, g, unknown or other
  misc_feature (831)..(831): n is a, c, g, or t
tcagtctatactatcacgaccggtgctcgatttagatcgtctgtgttggggtttgggggagacccagtcaggacacagcatggacatgagggtcccgctcagctcctggggctcctgctgctctggctcccaggtcgaccaaatgtcgacatccagatcgacccagtctccctcattctgtctgcatcgtgtcgganacgagacgtaccaccactctaccttcggcccgggacctacggtcctaaggtacgttacttcgaccgaaccgtaccggtcggttaccgggtccttagggttacctcgtaacggacgaaaccggtaaaccggaaaggggtaaacccggtaacccctttaaagttccgtacgtacttaccgttataccggaacggtacttaagttaactttaaggtttacgggtaaaacggttccggggttaccaacggtttaacgtaacggggtttacggaccggtacgtaacgggttggtaaacttcgggtacggggtaaacaacgggtttaactaccttacggtacctttaccggaagtaccttacgacgggttccgtaccgtcgaccaacgggtcctaagaagtcgtaacggttggtaaccgttaacgttaaccgtttaactaccgtaacctaacccgttaaacgtaccttaacgttaactaacggtttaccgtaaccccgttacgtttaaccggttaaccggtttacggggaacggggtaacccggggtaacgggacgggttttaacgggggaaacgttaacccggaaagggttccgtaacccgggttgttaccgggttaaccgtcgtacccgtaaaccttnttccccggttac

SEQ ID NO: 39166 - DNA, 706 bp, Homo sapiens
  misc_feature: GYAE6OF02FJW7F.41.34.D01.1.454.CMB.1.raw
tcagtctatactatcacgaccggtgctcgatttagatcgtctgtgttggggtttgggggagacccagtcaggacacagcatggacatgagggtccccgctcagctcctggggctcctgctgctctggctcccaggtgaccaaatgtgacatccagatgacccagtcctcccctcattctgtcctgctatctggtcggagacgagagtcaccatccacgttcggcccgggccaggtcaggtagttatcggacacgacggtcggttcggccgttggtatacacggacaacgaaaaccgaacggggaaaccaccccctttaaagttccgtagtactactatacacggactacttacttaagttagggaaagggttccgggtaccctaagtacggttaaagggtttacggacggtacggaggtggtactacggtagggaacgtaaggtaacttctaccgttactaccgacgtagtaccgacggacccgtcgtcgtacacgtccgtagataggacttacgtacgtacttaaacgtttactacgtactaacctactaacgttatacgtaacgttaccttacccgtacttacccgttcggttcggggacccgggtaacggtaccggtaacggggtaccgggtaaggtaaccgaaacggtccggttaacggttgtacggttaccgtacggacccttacgtcgttcccgtttacg

SEQ ID NO: 39167 - DNA, 902 bp, Homo sapiens
  misc_feature: GYAE6OF02G3TLJ.41.34.D01.1.454.CMB.1.raw
  modified_base (209)..(209): a, c, t, g, unknown or other
  misc_feature (209)..(209): n is a, c, g, or t
tcagtctatactatcacgaccggtgctcgatttagatcgtctgtgttgggtttggggagacccagtcaggacacagcatggacatgagggtccccgctcagctcctggggctcctgctgctctggctcccaggtaccaaatgtgacatccagatcgacccagtcctccctccattctgtctgctactctgtcggagacagacgtcaccntcacttggcccggtctagtcagtacgttagtcgcacgacggtcggttcggccttgggtactacgacgacgtaaacggaaaccgaacgggtaaaccgtccccttaaaacgtttcccgtaggtaacttaccttacgtaccggaacggtacctaacgttaccgttaaaggttttaagggaaaccggttcgggtaaccctaagttaccggttaaacggtttacggccggtactacgggtacggtacgtacggtacgggaactaacgttaacgttaccgtaaccgttccgtaccggtaacgtaccgttaccgccgggacccggtacccgtacggaccggtacgtacccgttagggtacgttaccgggtacgttacccgggtaccgttaaccgttaaaccgttttaaccgttacccgttaccggtaaacccttaaacgtacccgttaaagttacccggttaaccgtttaacccgggttacccccgtacgttaacccgttttacccggggtttacccgggggaaaccgggtttaccccgggtaaaaccggggtaccggggttaacggggttaacccggtaacgggttaaacccgggttaaccggtaaacccgggtttccggggttaccgggttaccccgtttaaccgggaacccccttaacgggttacccgtttttaccggtaccccggtttttaacccg

SEQ ID NO: 39168 - DNA, 815 bp, Homo sapiens
  misc_feature: GYAE6OF02IU2VH.41.34.D01.1.454.CMB.1.raw
tcagtctatactatcacgaccggtgctcgatttagatcgtctgtgttgggtttggggagacccagtcaggacacagcatggacatgagggtccccgctcagctcctgggctcctgctgctctggctccaggtgccaaatgtgacatccagatgacccagtctccctcattctgtctgcatctgtcggagacagagtcacctatctacgttgcccgggctagtcagtagtattcgcaccacgtcggttgcctggtatacaggacaacggaaaaccgagggtaaactccccgttaaaattcccgtagtactactactccgaggctatacgtttaagttaaggtaaacggttcggggtaccctagttaccgtaaaggtttcggaccggtacacgggttaggtaacgttcggttacggggaacctaaggttaactttacccgacgtttacccgtaccgtaaccgttaacgtaccgtaacggacccgggtaccgtaccggacgtaccggtaccttaggtaacgttacgacggtttcggtaacccgtttaacgtttaaaccctttaagtttaacccgtacgtaacccgttaaaccgaaccttttaacgttacggttaaacctttaaccccgggttttaaccccggaccttttaacccgttaaaccgggtttcggggaaccccgggttaaggggtaaccccgggttaaagggttacggggttaaccggtaaccggttaaaaccgtccgggttaaccggtttacgggtaccggttaccgggttacccggtaaccgtaccccgttagtttaccccgtttcccgg

SEQ ID NO: 39169 - DNA, 715 bp, Homo sapiens
  misc_feature: GYAE6OF02HFXA2.41.34.D01.1.454.CMB.1.raw
  modified_base (515)..(515): a, c, t, g, unknown or other
  misc_feature (515)..(515): n is a, c, g, or t
  modified_base (531)..(531): a, c, t, g, unknown or other
  misc_feature (531)..(531): n is a, c, g, or t
  modified_base (548)..(548): a, c, t, g, unknown or other
  misc_feature (548)..(548): n is a, c, g, or t
  modified_base (555)..(555): a, c, t, g, unknown or other
  misc_feature (555)..(555): n is a, c, g, or t
  modified_base (688)..(688): a, c, t, g, unknown or other
  misc_feature (688)..(688): n is a, c, g, or t
tcagtctatactatcacgaccggtgctcgatttagatcgtctgtgttgggtttgggggagacccagtcaggacacagcatggacatgacgggtccccgctcagctccgtggggctcctgctgctcgtcggctcccgaggtcgaccaaagtgtgacactccagatccgaaccctagtcctccctctattcgtgtctgcctattcgtcggtggacgacgagtacgtaccacctatacgtaccgtcggcccggactacgacgtaggtaagtagtcgactacgacggtcggtacgtcgttaggtagtacagacgaacggaaccggaacgggtaaaccaccctttaacttcagtactacttacaccggtaggtacctactttaacgtttaagggttaacgggttaacgggttccgggttaccctaacgggttaacggttacggggttacggtaccggcggttaacggtcggtagtttcgggaacgtaacggtaatacgttacctcgtaacgtcgacgtanccgtacgccggttacncgtccggtacgacggtnaggtacncgttaccgactttaaccttacttactacgtacccaattacgtcgttactacggttaacttaccgggttaccttacgttccgttaccggtcgggacgggtaaccgtagggtagtacggaacgttagaacgtcgngttggccttggcctactacgttctgtc

SEQ ID NO: 39170 - DNA, 172 bp, Homo sapiens
  misc_feature: GYAE6OF01B4FUK.47.37.D04.1.454.CMB.1.raw
  modified_base (172)..(172): a, c, t, g, unknown or other
  misc_feature (172)..(172): n is a, c, g, or t
tcagagctcacgtacacgaccggtgctcgatttagtagcatactgttgggtttgggggaagaggaagactgacggtccccaggagttcaggtgctgggcacagcggccctgggctgcctggtcaaggactacttcctacgtgagctctgagcgggctggcaaggcgcatagn

SEQ ID NO: 39171 - DNA, 174 bp, Homo sapiens
  misc_feature: GYAE6OF01DL1E7.47.37.D04.1.454.CMB.1.raw
  modified_base (173)..(174): a, c, t, g, unknown or other
  misc_feature (173)..(174): n is a, c, g, or t
tcagagctcacgtacacgaccggtgctcgatttagtagcatactgttgggtttgggggaagaggaagactgacggtcccccaggagttcaggtgctgggcacagcggccctgggctgcctggtcaaggactacttcctacgtgagctctgagcgggctggcaaggcgcatagnn

SEQ ID NO: 39172 - DNA, 231 bp, Homo sapiens
  misc_feature: GYAE6OF02FT5CR.47.37.D04.1.454.CMB.1.raw
  modified_base (229)..(231): a, c, t, g, unknown or other
  misc_feature (229)..(231): n is a, c, g, or t
tcagagctcacgtacacgaccggtgctcgatttagtagcatactgttgggtttgggcggagggaccaaactgaccgtcctaggcgcagtctgggtctctcacccttgttctggtctggcctcctcagtctgggttcttgtcggaacaggtcagcccaaggctgccccctggtcactctgttcccgccctcctctacgtgagctctgagcgggctggcaaggcgcatagnnn

SEQ ID NO: 39173 - DNA, 179 bp, Homo sapiens
  misc_feature: GYAE6OF02FVF47.47.37.D04.1.454.CMB.1.raw
  modified_base (173)..(179): a, c, t, g, unknown or other
  misc_feature (173)..(179): n is a, c, g, or t
tcagagctcacgtacacgaccggtgctcgatttagtagcatactgttgggtttgggggaagaggaagactgacggtccccccaggagttcaggtgctgggcacagcggccctgggctgcctggtcaaggctacttcctacgtgagctctgagcgggctggcaaggcgcatagnnnnnnn

SEQ ID NO: 39174 - DNA, 130 bp, Homo sapiens
  misc_feature: GYAE6OF01BNHZ7.49.58.F03.1.454.CMB.1.raw
  modified_base (127)..(130): a, c, t, g, unknown or other
  misc_feature (127)..(130): n is a, c, g, or t
tcagagtcgagagacacgaccggtgctcgatttagtctgatcgagaagggaaaggggctggccctgacgtgtttctgttcccgccctcctctctctcgactctgagcgggctggcaaggcgcatagnnnn

SEQ ID NO: 39175 - DNA, 126 bp, Homo sapiens
  misc_feature: GYAE6OF02GVCMI.49.58.F03.1.454.CMB.1.raw
tcagagtcgagagacacgaccggtgctcgatttagtctgatcgagaagggaaaggggctggccctgacgtgtttctgttcccaccctcctctctctcgactctgagcgggctggcaaggcgcatag

SEQ ID NO: 39176 - DNA, 139 bp, Homo sapiens
  misc_feature: GYAE6OF02FX213.49.58.F03.1.454.CMB.1.raw
  modified_base (128)..(139): a, c, t, g, unknown or other
  misc_feature (128)..(139): n is a, c, g, or t
tcagagtcgagagacacgaccggtgctcgatttagtctgatcgagaagggaaagggggctggccctgacgtgtttctgttcccgccctcctctctctcgactctgagcgggctggcaaggcgcatagnnnnnnnnnnnn

SEQ ID NO: 39177 - DNA, 128 bp, Homo sapiens
  misc_feature: GYAE6OF02FQXGB.49.58.F03.1.454.CMB.1.raw
  modified_base (128)..(128): a, c, t, g, unknown or other
  misc_feature (128)..(128): n is a, c, g, or t
tcagagtcgagagacacgaccggtgctcgatttagtctgatcgagaagggaaagggggctggccctgacgtgtttctgttcccaccctcctctctctcgactctgagcgggctggcaaggcgcatagn

SEQ ID NO: 39178 - DNA, 136 bp, Homo sapiens
  misc_feature: GYAE6OF02FKCEG.49.58.F03.1.454.CMB.1.raw
  modified_base (122)..(122): a, c, t, g, unknown or other
  misc_feature (122)..(122): n is a, c, g, or t
  modified_base (128)..(136): a, c, t, g, unknown or other
  misc_feature (128)..(136): n is a, c, g, or t
tcagagtcgagagacacgaccggtgctcgatttagtctgatcgagaagggtaaagggggctggccctgacgtgtttctgttcccaccctcctctctctcgactctgagcggctggcaaggcncatagnnnnnnnnn

SEQ ID NO: 39179 - DNA, 534 bp, Homo sapiens
  misc_feature: GYAE6OF01EQQ3C.16.85.H08.1.454.CMB.1.raw
  modified_base (179)..(179): a, c, t, g, unknown or other
  misc_feature (179)..(179): n is a, c, g, or t
  modified_base (261)..(261): a, c, t, g, unknown or other
  misc_feature (261)..(261): n is a, c, g, or t
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
tcagtgtactactccacgaccggtgctcgatttagtatcactcagtcgcggggagctctgagagaggagcccagccctgggattttcaggtgttttcatttggtgatcaggactgaacagagagaacccaccatggagtttgggctgagcggtgtgtttctaggtggccatttaaaggngtcaatgtgaggtgcggctattggacgctgggggagaattggtacagcctggggggtccctgagactctcctgtgcagcctntggattcaccttcggcagttatgccatgacgtgggtccgccaggctccgaggggaaggggctgaaggtgggtctcgaggtattagtgttagtggtggtagcacatactacgcagactccgtgaagggccgttcaccatctccagagacaattcccaaagaacngtgctatatctgcatangacagacngagacgacgaanacgacgacatactattcgtgtcgacgacgcccgccccgtccggacctagtcgtactacggtaagtcgggtacg

SEQ ID NO: 39180 - DNA, 700 bp, Homo sapiens
  misc_feature: GYAE6OF01AVQRI.16.85.H08.1.454.CMB.1.raw
  modified_base (181)..(181): a, c, t, g, unknown or other
  misc_feature (181)..(181): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (369)..(369): a, c, t, g, unknown or other
  misc_feature (369)..(369): n is a, c, g, or t
tcagtgtactactccacgaccggtgctcgatttagtatcactcagtcgcggggagctctgagagaggagcccagccctgggattttcaggtgttttcatttggtgatcaggactgaacagagagaacccaccatggagtttgggctgagcggtgtcgtttctaggcggccaatttaaaggngtccaatgtgaggtgcggctattggacgctggggagaattggacagccgtggggggtccctgagactctcctgtgcagcctntggattcnccttcggcaggttatgccatggcgtgggcccgccaggctccagggaagggctagaagtggtctgagggtattaggtgttaggtcggtaggtagccganactactacggcagactccgtggaacgggccggttcacctatccgtaccaagggactaacgtaacttacccaaaacggaacctaagttcggtacctaattaacgtttctacggaacctaatttacgtacgactaaacggtaaccgtaggaaaccggtaaggaaaccgtaaacggacccgtaacccggtaacccttaacgttaccgtttaaaacgttacccggttcggaaccgggacccggtaacccggtacccccggtccccccccgtaccgggaccctacggttacccggtaccggtttaaaccgggttaaacgggttacccggggaaccg

SEQ ID NO: 39181 - DNA, 618 bp, Homo sapiens
  misc_feature: GYAE6OF01BPCIF.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggccctgttttggtcgtctatgatgataccgagcggccctcagggactccctgagcgattctccggctccaactctggtgacacggcccacctgaccatcaacgagggtcgaaggtcgggagtggaggccgactattactgtcaggtgtgggtatgggtgttagtgagtcgggctacgttttcgggcgggtacgggacccgtaggccgtcggacccgttccgtaacgggtccgacggaccccgaaacgggccgttaccggcccccccgttccgggtaccctacccgttcccgttcccggtttacccccctaacccccgtttccccgttacccggtaacggttaacccgg

SEQ ID NO: 39182 - DNA, 676 bp, Homo sapiens
  misc_feature: GYAE6OF01BORZK.16.85.H08.1.454.CMB.1.raw
  modified_base (222)..(222): a, c, t, g, unknown or other
  misc_feature (222)..(222): n is a, c, g, or t
  modified_base (528)..(528): a, c, t, g, unknown or other
  misc_feature (528)..(528): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttcggccccaggacagacggccttaataacctggtggggaancaacagttggaagacaaaaatgtgcacgtggtacatgcgagacggccgaggccacggccctgttttaggtcgtctatgatgataccgagcggccctcgaggactcccgtgacgtcggtaactttccgtccggtcctacccgtaaacgtccgttgggtacgaaccgaccgggccccaacccgttcgaacccacttaccgaaacgacggggtaaccgtaaagggtccgggaagttacggaacgggtcccgaaagtttaacgtaccgtggtacgagggttaggtcgggtagttacgggttagttacggngttagtccgggtacttacggtttaccgggacggtacgggtacccagggtacgtacggtaccgtaccgtaggtaccacggtacccgaagtcccgtcgcccccgtagtccaccgtccgtaccgttccccgccctcgtacgcgttaaacgg

SEQ ID NO: 39183 - DNA, 713 bp, Homo sapiens
  misc_feature: GYAE6OF01EPKFP.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctggtggggaagcaaacagttaggaagacaaaaatgtgcactggtacatgcagaggccaggccaggccctgtttggtcgtctatgatgataccgagcggccctcgagggactccctgagcgtattccgtccggcctaccaactctgggtcgacgaccggcccacccgtcgacccataccgaacgacggggtacggaagggtcggggaattacgggaacgggaccgtaactttaacgttacgttacgtacggagggttggtaggggtagttgggtttagttagggtagtacggtcggggtacttaccggttttccggggacggggtaacgggtacccgtacggtccgttacggtacccgttccggttaaggtacccgaccggaccccgtaaacgggtcccgttacccgggtaccccccgttccggttaccctaacccgttccccgttccccgggtttccccccggtccccctttaccccggtccggttaaacggttaaccccggg

SEQ ID NO: 39184 - DNA, 779 bp, Homo sapiens
  misc_feature: GYAE6OF01CO936.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttcggccccaggacagacggaccttaataaccgtggtagggggaagcaacagttaggaagacaaaaatgtgcactggtacatgcagaggccaggccacggcccttgtttcggtcgtctatgagtgactacgagccggccctgagggactcccgtgacgcgtacttcccgtccggtcctaccgtaaccttcgtcgggtacgaacccgaccggaccccacccgttacggaccctaacgttaacccggaaaacggtacgggggttaaccggtaacgggggtaccgggggtaagtacgggaaccggggtacccgtaacgttaacgtttaccgtacggttaccggtagggttgggtacggggttagttggggttaggtttacggtcggtaacgggttccggggtacgtttaccgggttttaccggggaccggggtaaccggggtaccccgtacggtaccggtaccgggtaccccggttccggttaaccgggtaccgaacccggtacccgaacggttcccgtaccccggtaccccccggttcggtaccctaccgttcccgttcccgttcccccgtccccgttacccgtccggtacggttaacccg

SEQ ID NO: 39185 - DNA, 667 bp, Homo sapiens
  misc_feature: GYAE6OF01ALBN1.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgacgtcagccaccctcggtgtcgttggccccaggacagacggccttaataacctggtgggggaagcaacattggaagacaaaaatgtgcactggtacatgcagaggccaggccacggcccttggtttggtcgtctatgatgataccgagcggccctcgagggactcccgtgagcgtacttccgtccggctcccaactcgtggtcgacgaccggcccaccctcgacccatacaacgagggtcgaagggtcgggatcggacggccgactacttacgtgtacgagggtcggtgggtagttgggttaggttacggtgtagtccgggacgttaccgttttcggggaccgggtacgggacccgaggtccgtacggtacccggttaccgtacggtccgaccggaccccgtaacgggtcccgtcccggtaccccccggttcgggtacccttaaccccgttcccgttacccgttaccccccgtaccccgtttacccgtccggtaaccggttaacccgg

SEQ ID NO: 39186 - DNA, 591 bp, Homo sapiens
  misc_feature: GYAE6OF01ED7D5.16.85.H08.1.454.CMB.1.raw
  modified_base (299)..(299): a, c, t, g, unknown or other
  misc_feature (299)..(299): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtggggaagcaacattggaagcaaaaatgtgcactggtacatgcagaggccaggccaggccctgttttggtcgtctatgatgatacgngcgcctcaggatccctgacgcgattccgtccggctccaactctggtcacacggccaccctgaccatcaacgacgggtacgaacggtcgggatggacggccgactattactgtcaggtgtggatggtagttgtagcgtcggcgtacgtttcgggcgggtacgggaccgacgtcgtacggtaccggtccgtacgttaccgacggacccgaacgggtcccgtccgggtccccccgttcgggtaccctacctcgttcccgtttacccccaccccgttcccgtcggtacgttaacgg

SEQ ID NO: 39187 - DNA, 594 bp, Homo sapiens
  misc_feature: GYAE6OF01EP3RR.16.85.H08.1.454.CMB.1.raw
  modified_base (268)..(268): a, c, t, g, unknown or other
  misc_feature (268)..(268): n is a, c, g, or t
  modified_base (482)..(482): a, c, t, g, unknown or other
  misc_feature (482)..(482): n is a, c, g, or t
tcagtgtactactccacgaccggtgctcgatttagtatcactcagtcgcggggagctctgagagaggagcccagccctgggattttcaggtgttttcatttggtgatcaggactgaacagagagaacccaccatggagtttgggctgagcgtggtcgttttctaggtcggcctaagttttaaaaggtgtccaatgtgaggtgcggctattggacgcgtgggggagaagttggtacaggccgtgggggtccctgacgactctcctgtcncagcctctggacttcaccgttcggctagttactgccatggacgtggtccgacaggcctccgaggggagggcgtaggaggtggtctacgaggtattagtggttagtggtagtagcacagtactagcgagactccgtagaacgggtcccgtacactacgtctaccgtagacgaactaacttacccgaaagtaaccagtacgtactaagtatcgtanaccaatactcgacgacgaaccgtagagaacgaacgaatacgaccgcagtatacgtagtgacgacgtaccggcctcccccgagcccgtagtacgcttacgtagtgggtaaccg

SEQ ID NO: 39188 - DNA, 810 bp, Homo sapiens
  misc_feature: GYAE6OF01DK2A2.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggccctcctctctcactgcacaggctctgtgacctcctatgtgctgactcagccaccctcggtgtcgttggccccaggacagacggccttaataacctggtagggggaagcaacagttggaagacaaaaatgtgcactggtacatgcagaggccaggcccacggccctgttttcggtcgtctatgatcgataccggagcggccctcgagggactcccgtgacgcgtacttctaccggctaccaactcgtggtacgaccgtaccggccctaaccccgtcgtacccacgttaccgaaaccgacgggggttaccgaaacggggttcgggggaacgttacgggaacggggtcccgtaaactttaacgtttaaacgttcggttaccggtaacggggtttagggttaggggggttaatttacgggggtttaggtttaacggttagggtaccgtttaccgggggttccgtttaaccggtttttccgggggaccgggtaaccgggggtaacccctagggtacccgttcgggaaccccggtttacccgtaacgggtaccgtaaccgggacccccgtaaacggggtccccgtaccccggttacccccccggttccgggttacccgttaccccgtttaccccggtttccccgtttaccccccgtaacccccggttcccggttaccgggttaccggttaaaccccggg

SEQ ID NO: 39189 - DNA, 566 bp, Homo sapiens
  misc_feature: GYAE6OF01AQVFK.16.85.H08.1.454.CMB.1.raw
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
tcagtgtactactccacgaccggtgctcgatttagtatcactcagtcgcggggagctctgagagaggagcccagccctgggattttcaggtgttttcatttggtgatcaggactgaacagagagaacccaccatggagtttgggctgagcgtggtctttttcttgtggcctattttaaaaggtgtccaatgtgaggtgcggctattggacgcgtgggggagaagttggtacagccgtggggggtccctgagactctcctgtgcagcctctggattcaccttcggcagttatgccatcggacgtcgggtcccgccgaggcctccgaggggaacggggctggaaggtgggtctcgaggttattaggttggttaggtggtaggtacgcacatactacgcagactccgagaacgggccgttcacctatctccgagacgacaattaccgaaagacatgactatntctgcatangacaagactagagacgaacgaagacacgcctatactactatcgcgacgacgcccgccccgtccggacctacgtcgaccgttacgtagtcgggtaccgg

SEQ ID NO: 39190 - DNA, 674 bp, Homo sapiens
  misc_feature: GYAE6OF01B1P2R.16.85.H08.1.454.CMB.1.raw
  modified_base (229)..(229): a, c, t, g, unknown or other
  misc_feature (229)..(229): n is a, c, g, or t
tcagtgtactactccacgaccggtgctcgatttagtatcactcagtcgcgggctgggcctaaggaagcagcactggtggtgcctcagccatggcctggaccgttctcctcctcggcctcctctctcactggcacaggctctgtgacctcctatgtgctgactcagccaccctcggtgtcggttcggccccgagggacacggacggccttaagtaacctgggtggggaancaacattggaacgacaaaaatgtgcacgtggtacatcgacagacggccaggcctacggtcccgttggttttcggtcgtctatgtatagacgtaccggacggccggccctcggacgggccttcccgtggacgtacgtacttccgtaccggcctaccgtaactcgtggtaaccgacgacccggaccctaccgtacgacctaacgtaccgaacggtacgggtacgtaacgggtacgggtacgtacgggaccggtaccgtaacttaacgttaaccgtaggttacggtaagggttcgggttagggtacgtgggtttagttaggtaggtacgtcgggtcttacggtttcggacgggtacggaccgagcgtcgtaccgtcgtgtacgacgtacgacgtcgtccgcccgtgtaccctcgtccgttccgtccctcccgtccggtagtcgtaccg

SEQ ID NO: 39191 - DNA, 750 bp, Homo sapiens
  misc_feature: GYAE6OF01CSWWV.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcgcctcctctctcactgcacaggctctgtcgacctcctatgtgctgactcacgcccacccgtcggtgtcgttcggcccaggacagacgtcttaataaccgtggtaggggaagacaacgtagttaggaaagaacaaaaagtgtacgactacgtaggtaactagtgacgaggacggaccgacggccgtaccggtcccgtttggttttacggtcgtactagtgtatagaacgtacggccgacccggtcctacgacgggtactacccgtagacgtcgtacttccgtcgtcgtcctaccaacgttcgtacggaaccgcccgaccctaccgtacgaaccgtactacgacgtacggaacgggtacgggaaccgggtaccggggagtaccgggaacggtaccgtaactttaacgttacgtacggtacggtaagggttcgggtaagggtaagttacggttaagtaggtagtaatacgttaagttacgttcggttaccgttcggtaacgttcggtaccgggtaccgtaacgggttcctacccggttacgtaggaaccgtacccgaaccgtaaacccggtcccccaaacccgttcgttaccgtacccttaacgttccccgtacccgttacccccgacccgtttaccgg

SEQ ID NO: 39192 - DNA, 634 bp, Homo sapiens
  misc_feature: GYAE6OF01AWA0I.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctggtgggggaagcaacattggaagacaaaaatgtgcactggtacatgcagaggccaggccaggccctgttttggtcgtctatgatgataccgagcggccctcgagggactccctgagcgattcgtccggctccaactctggtgaccacggcccaccctgacccatccgaaacgacgggtacgaaggtcggggattcggacgggtccgacttacttacgtggtacgaagggtcggtaggggtacgttgggtacggtttaagtcggtaagttccggggtacttaacggttttcggggaccgggtacggggtaccccaggtcgtacggacccgttcgtaagggtccacggtaccccgaagggtccctccggcccccgtcggtcctaccgttcgtccgttccccgccccttcgtccgtaggttaaccg

SEQ ID NO: 39193 - DNA, 679 bp, Homo sapiens
  misc_feature: GYAE6OF01B6YI9.16.85.H08.1.454.CMB.1.raw
  modified_base (486)..(486): a, c, t, g, unknown or other
  misc_feature (486)..(486): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagcccaccctcggtgtcgttcggccccaggacagacggccttaataacctggtggggaagcaacagttggaagacaaaaatgtagcacgtggtacatgacgagaggccaggccacggcccttggttttcggtcgttctatgtatgacgttaccgacggccgcccgttcgagggactccgtggacgtcggactttccgcccggtcctacccaacgttcgtgggtacgaccgacggcccacccgttcgaaccctagtaccgacggacggtacgggtccgaaacggggccggggtaatcgggaccggccgtaacgttatttaccgnggtacgtagggtggttaggaagttaggtaggtagtggtactagtattttaagtcgtttcgtttcgggactttcggacggggtacccgtagggtcctacccggttacgtaggtccgaacggaccccacggggacccccaaacccgtcgttacgacccttaacgtcccttaccgttaccccctccccgttaaccg

SEQ ID NO: 39194 - DNA, 630 bp, Homo sapiens
  misc_feature: GYAE6OF01DUIBG.16.85.H08.1.454.CMB.1.raw
  modified_base (241)..(242): a, c, t, g, unknown or other
  misc_feature (241)..(242): n is a, c, g, or t
  modified_base (618)..(618): a, c, t, g, unknown or other
  misc_feature (618)..(618): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtggggaagcaacattgaagcaaaaatgtnnactggtacatgcagaggccaggccaggccctgtttcggtcgtctatgatgacgtaccgagccggccctcgagggctcccgtgaacgcgtacttccgtccgcctcctaacgtcgtaggtcgacaccggccacccgtgaccgatacgaacgaggggtaccgaaggttcgggaatcggacggaccgtactagttacgtagtcgaagggttcggtgggtacgttgggttaggttagtgtacgtcgggtcgtacgttttcgggacgggtaggaccctacggtcgttacggacccgttcgtaacggtccgtaacgtcccgaacgggtcctacccggccccgttcggtcctacctccgttccgttaccccgacctttacccgngttagtaacccg

SEQ ID NO: 39195 - DNA, 763 bp, Homo sapiens
  misc_feature: GYAE6OF01DHVEB.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttcggccccaggacagacggccttaaagtaacctggtaggggaagcaactattggaagacaaaagtgtgcacgtggtacatgcaggacggccaaggccacggtcccttggttttcggtcgtctatgattgaactaccgagccggccctcgaacgggactccgtggacgcgtacttcgccggtctaccgaacgtcgttggcgaccgaccggtcccacctacgacctataccgaacggtacgggtacggtaacgggtcggggaatccgggaacgggacccgtaactttaagttcgtacggttcgtaagggttgggtaggggtgttagggtttcgtttaagggcgttaacgggttcccggggtacgttttaacccgggttttcggggggaaccggggtaacccgggtacccgacgggttacccggttacgggtacccccggtttaacggttaccgggttacccggaccgggacccctaacgggggtcccctccccggggttcccccctacggggtaccccttacccgtcccgtttaccccgggttccccccgtacccgtttacccggagggtcccgtttaaacggg

SEQ ID NO: 39196 - DNA, 688 bp, Homo sapiens
  misc_feature: GYAE6OF01EQA9Z.16.85.H08.1.454.CMB.1.raw
  modified_base (555)..(555): a, c, t, g, unknown or other
  misc_feature (555)..(555): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctggtggggaagacaacattaggaagacaaaaatgtgacatggtacatgcagagaccaggccacggccctagtgctggtcgtctatgatgatagcgaccgcctacgaggactccgtgacgcgtatcgtctggacctacctaactcgtacgggaaccgtccggaccctacccgtagacccaagtaccgaggaccggtaaggggttccgaaacgggtccgggggtaatacggggaacggtacccgtaattacgtttaaccgtacggtacgaacggggttggtacggggtaattaagggttaacgttagtacgtaattacgtaagtttagtcggtttacgttaccgggnttaccggtcggggtaaccctaggggttacccgtaacccggttacgtacgggtaccaccgggtaacccccaaagggaccccccaaacccggtcgtacgtaccctaaccgttcccgttacccgggttaccccccg

SEQ ID NO: 39197 - DNA, 742 bp, Homo sapiens
  misc_feature: GYAE6OF01DA9JQ.16.85.H08.1.454.CMB.1.raw
  modified_base (231)..(231): a, c, t, g, unknown or other
  misc_feature (231)..(231): n is a, c, g, or t
  modified_base (421)..(421): a, c, t, g, unknown or other
  misc_feature (421)..(421): n is a, c, g, or t
  modified_base (718)..(718): a, c, t, g, unknown or other
  misc_feature (718)..(718): n is a, c, g, or t
tcagtgtactactccacgaccggtgctcgatttagtatcactcagtcgcggggctgggcctaaggaagcagcgctggtggtgcctcagccatggcctggaccgttctcctcctcggcctcctctctcactgcacaggctctgtgacctcctatgtgctgactcacgccaccgtcggtcgtcgttcggcccaggacaggaccggtaccttaataaccgtgggtagggggaanacgtaactagttaggaagaactaaaaagtgtagacacgtggtacagtcgacaggacggaccgaggcccgacggtcccgtttggttttacggtcgtcttagtgtagtgaacgtaccggacgtcccggaccctagacgggtacctcccgtagacggtcgtactccgtaccgtctacccacgttcgtacggtnaccgtacccgccctacctacggaacctacgtaccgaacggtacgggtacggtaacgggtacgggagtacgggaccgtaccgtaacgttaacgttacgtacgtacggtacgggttcgggtagggtagttgggttaggttacggttggtacgggtaccgtacggtttaaccgggttcgggaacgggtaccgggtaccggacgttcgtaccggtacccgttcggtaccggtacgacccgaccggaccggtaccgtcccgtaccccggttcgtcccgttaccgttccgtcccgttaccccnccgtacccgtacggtcgttaaccg

SEQ ID NO: 39198 - DNA, 786 bp, Homo sapiens
  misc_feature: GYAE6OF01DYVTT.16.85.H08.1.454.CMB.1.raw
  modified_base (238)..(238): a, c, t, g, unknown or other
  misc_feature (238)..(238): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagcccaccgtcggtcgtcggttcggccccgaggacgaggtaccggtaccttaacgtaaccgtgggtagggggaanacgaactagttaggaagaacaaaatgtgactacggtaggtaacagtggacgacggacggaccgacggacccgacggtccctttggttttacggtcggttctaagtgtaagttcggaacgttaccggacggtcccggtcccgtacggacggtacgtcccgtaggtacggtcgtaacgttcccggtccggtccgtacccgtaacgtcggtttcggacggtaccgacccggtacccgtaacctacggaccctacgtaacgaacggtaccggggtacgggtaacgggttacggggtaggtacggaacggtacccgtaacgttacgttacgttacggtacgtacgggtggttagggtggttacggttaggttacggtgtacggtacgggtacgttaccggtttccgggacggtacgggacccgtagtcggtaccgtaccggtacgtacggtccgaccggtaccgacggtcccgtacgtcccccggttacgtacccgttccgttccccgtttcccgtaccccgtcccgttaccggttacggtacgttaaccggg

SEQ ID NO: 39199 - DNA, 814 bp, Homo sapiens
  misc_feature: GYAE6OF01CZRYH.16.85.H08.1.454.CMB.1.raw
  modified_base (224)..(224): a, c, t, g, unknown or other
  misc_feature (224)..(224): n is a, c, g, or t
tcagtgtactactccacgaccggtgctcgatttagtatcactcagtcgcggggctgggcctaaggaagcagcactggtggtgcctcagccatggcctggaccgttctcctcctcgcctcctctctcactgcacaggctctgtcgacctcctatgtgctgactcacgcccaccgtcgtgtcgtcggacccaggacagacgtacttaacaaccgtggtaggggaanacaaacgtagttagggaacgaaactaaaaagtcggtagacctaacgtggtaacagtacgcgaaggacggaccgacgggcccgtaaccgggtccccgttttaggtttttccgggccggtttacctaagttagtacgtacggtacgtaacccggacggtccccggtacccggtacggaacgggttacctcccggttagacggtacgtaaccgttcccggtccggtaccttaccgtaaccgttcggttacggggacgtaacccgacccggtcccgtaaccgtacgaacctacgttaaaccggaacggtacggggtacggtaacgggtacgggtacgtacggacgggtaccgtaacgttaacgttaccgtggtacggtagggttgtacgggttggttacggtgtttaggtacggacggttccgggtacgttacggtttcggggaacgggtacccgggaccgtagtacccggtacgtcccggtaaccgtcgggtaacccgaccgaaccggtcggtcccgttacccggccccggttccgtcccttaacccgtcgttcccccgttaccccaccgttacccgtacgtcgttaacccgg

SEQ ID NO: 39200 - DNA, 726 bp, Homo sapiens
  misc_feature: GYAE6OF01BYXT4.16.85.H08.1.454.CMB.1.raw
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
tcagtgtactactccacgaccggtgctcgatttagtatcactcagtcgcggggagctctgagagaggagcccagccctgggattttcaggtgttttcatttggtgatcaggactgaacagagagaacccaccatggagtttgggctgagctggtctttttcttgtggcctaattttaaaaggtgtccaatgtgaggtgcggctagttggacgcgtgggggagtaagttggtacaggccgtggggggtccctgagactctcctgtgcagtcctcgtggtcagcgtacagtaaccaaccacgtgattggcggtccgccagcctcgagggaggggcgtggaagtggtctcgtagttatagaaatgatggtanacaanactctacgccgactcggtagacgggccattccactactcctaccgagaacgactaacttacccgaaagaaccgtacggtagtaaccttaccgttaacgaaaagtacgaaacgtagtacccgtaggaaaccgggaaccggaacgggaacccgtaccggtacccgttaatttacgtttaattacggttaagttacggttaaggttacggggttaggttaaaccgggtttcccggggtaccccgggttacggggggtaccccgggtaaacgggggttacccggttaccgggttacccggtaaccccggtttacccgttaccccggtaccgtaccccgtcccccggtaaaccccgg

SEQ ID NO: 39201 - DNA, 903 bp, Homo sapiens
  misc_feature: GYAE6OF01C64NW.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttcggccccaggacaggacggtaccttaataacctggtagggggaagcgacattaggaagacaaaaatgtgcactggtacatgacagaggccacggccacggtcccttggtttgtccgtcttagtgtagtgactaccggacgtccggtccctcggagggactcccgtagacgcgtacttccgtacggtcctaccgtaaccgtcgtagggttccgaaaccgtaacccgggtaccccaccccgtaacggtaacccgtaaacgttaccggaaaaccggaaccgggggttacggtaaaacggggttcccggggggaagttacgggaaccgggttaccccggaaagtttaacggttttaaccggtcggtttaacggtacgggggttagggttgggggttaaacgtttacgggggttttaggttaacgggtttgggtaaccggggtttaccggggttaccgttttaaacccgggggtttttccgggggacccggggggtaaacccgggggtaccccgttaaaccggccggtttaaacccgggggtaccccggtttacccgggttaacggggtaaaccctcccggggtaaacccccggaaaacgggttccccggttaacccccgggtcccccggtttacccggggaaccccttacccgtttcccggtttaacccccgttaccccccggtaacccctttccccccgtagggggttacccttaaaacccggg

SEQ ID NO: 39202 - DNA, 846 bp, Homo sapiens
  misc_feature: GYAE6OF01DUMGO.16.85.H08.1.454.CMB.1.raw
  modified_base (178)..(178): a, c, t, g, unknown or other
  misc_feature (178)..(178): n is a, c, g, or t
  modified_base (476)..(476): a, c, t, g, unknown or other
  misc_feature (476)..(476): n is a, c, g, or t
tcagtgtactactccacgaccggtgctcgatttagtatcactcagtcgcgggctgggcctaaggagcagcactggtggtgcctcagccatggccctggaccgttctccctcctcgcccttcctctctcactgcacaggctctgtacgtaccctcctagtgtcgctgactcacgacccncccgtggttgttcggttcggccccgaggacacggaccggtacctttaactaaccgtgggtaggggaacactaaacgtgttaggaacgaacaaaagtggtcgactacgtacgacagtcgcaaggtacggccacggccgaacgtccccgtttggtttcggtactcgtagcgtagtacgaacgtacggacggccggtcctacggacggtactcccgaggacgtccggtaccttcccgtaccggtcctaccgtaaccgttcggttacgggactacccggaccccggtaccctacccgtaacnccgtaacgtaacgtaacgggtacggtaacgggtacgggtacgggtacgtacggacgtccgtaacgtttacgtacggaacggttggtacggtttaggttaggggttgttagggtttacggtacggttaggttacccgggtacgggtttaccgtttaacccgggggtttccggggaacccggggttaaccggttaccggtaccggttacggttaccccgtacggggttaccgtaacccgggaccgtacccgggacccgggtaaccggtttccccggaccccgtttccccccggttcggtaacccgtttcccgttcccgtttaacccccgttacccccgtacccgtttacggtaaccggtacgttaacccggg

SEQ ID NO: 39203 - DNA, 770 bp, Homo sapiens
  misc_feature: GYAE6OF01CPURQ.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtcgacctcctatgtgctgactcagcccaccgtcggtgtcgttcggcccaggacagacgtacttaactaccgtggtaggggaacactaactagttaggaaacgaactaaaaagtgtacgactacgtggtacagtgacgaaggacggaccgacggaccgtaccggttcccgtttaggtttcggtcgttactagtgtagtacgacgtaccggacgcccgacccgtacgtaggtacctccgtaggacgtacgttacgttcccggtacccggtaccttacccgtaacgttcggtacgggtacgacccggtcccggtacccaacccgttacgacccgtaagtaacccggtaaacgggtacggggtaacggtacggggtaccggggtaacgtcgggaacccgggttaccgtaacgtttaacgttacgtacggtaacgggtggttacggggtagggttaacggttgggttaggtttagtacgggtacggttaccgggtacgtttaccgggtttcgggaaccgggttacgggaccgtagttccgaacggtccgttacgtacggccaccggcgacggtcccgtcccgtcccgtacgtcctaccgtccttacccgtccctaccgtccgtagtcgtaccg

SEQ ID NO: 39204 - DNA, 835 bp, Homo sapiens
  misc_feature: GYAE6OF01AZR5X.16.85.H08.1.454.CMB.1.raw
tcagtgtactactccacgaccggtgctcgatttagtatcactcagtcgcgggctgggcctaaggaagcagcactggtggtgcctcagccatggcctggaccgttctcctcctcggcctcctctctcactgcacaggcctctgtcgacctcctagtgtcgctcgactcacgccccgtacccgtcggtcgttcggttccggccccgaggacgacggtaccggtaccttaaacgtaccgtgggtacggggaacgacaaactagtaaggaacgaacgtaaaagtgtcgactacgtagtacagtcgacgaggacggccgacggcccgaccggtcccgtttggtttcggtcgtctagtcgtatacgacgtaccggaccggtcccggaccgtacggacggtactccgtacggacgtcgtacgttcccgcgtacctaccgtacgttcgtacggaccgacccggaccgtacccgtaaccgtaccgaccacggtaaccggtaaccggtacggtacgggtacgggttacgggacggtaaccgggtaccgggtaacttacgtttacgttaaccggtggttaaccggtggggttaggttagggttacggttgggtttacggttaccggtagggttaccggtaccggggtttaaccgttttccggggttaacgggggacccgggtaccgggtccgtaacgtccgggttaacccggtacccgttagggtacccgcccggttaaccggcccgttacggtcccccgttaccccgggtcccggttccctaaccggttcccctttaccccgttaccctccccgttcccgttaaccgttcggaccgttaacccgg

SEQ ID NO: 39205 - DNA, 800 bp, Homo sapiens
  misc_feature: GYAE6OF01EJSDV.16.85.H08.1.454.CMB.1.raw
  modified_base (688)..(688): a, c, t, g, unknown or other
  misc_feature (688)..(688): n is a, c, g, or t
  modified_base (778)..(778): a, c, t, g, unknown or other
  misc_feature (778)..(778): n is a, c, g, or t
tcagtgtactactccacgaccggtgctcgatttagtatcactcagtcgcggggctgggcctaaggaagcagcactggtggtgcctcagccatggccaggaccgttctcctcctcggcctcctctctcactgcacaggctctgtgacctcctatgtgctgactcacgcccacccgtcggtgtccgttcggccccaggacacgaccggtaccttaaacgtaaccgtgggtagggggaacgaccgaaactagtttacgggaaagaaccgtaaaaaaagttcggtacgtaccgtaacgttacggggtaaccagttcggacgaagggacgggacccgaacgggaccccgaccgggtccccgtttaggttttttcgggccgtttactagttcggaagttggaaccgttaccgggacggcccgggtcccgtacggaacggggtaccttcccgtagacggtacgtaaccgtttcccggtcccggtacctacccgtaacgttccgtacgggttacgaaccgtacccgggacccctacccggtacgaacccgtacgtaaccgaaacgggtacgggtacgggtaacggggtcggggaatacgggacgggacctaacttagttacgtgtacgagggttggagggtagttgggtagttaggacgtcgtcgggtcgttaccggttacgggcggtacggaccnggtcgtacgtacccgtcgtacggtccgaccgtacccgacggtccgtcccgtaccccggtctacccgtaccgttcgtacccggttaccccncccgttactcggtacgtaaccg

SEQ ID NO: 39206 - DNA, 1002 bp, Homo sapiens
  misc_feature: GYAE6OF01EFQKU.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtcgtacctcctagtgtgctgactcacgccctacctcggtcgtcggttccggcccgaggacgacggtaccgggtacctttaaactaaccggttgggtacgggggaaacgacaaaccgtagttacgggtaaacgtaaacgtaaaaacgtggtacggaccttaacggttacggtaactagtacggaaccggaacgggaacgggtacccggaacgggtaccccgttaacccggggttccccggtttttacgggtttttacggggttaccggtttacccgttaaggttaccggaagttaccggttaaaccgacccggggtaaccgggtcccgggtaccccggtaaccggtaccggggttaccttccccggtaaggtacggtacccgttaccgggtttcccgtacccgggtccgtaacccgttaacggttccggttacggggtaaccgacccggtacccggtaccccgtacccgtaacgtaaccctacggtaaccggtaacgggtaccgggtaacggggtaaccgggtacgggggtacgtacgggaaccggtacgtaacgtttacgttacggttacggtacgggttacggttacggggtagggtaggttcggttagggttagtacggttacggtccgggttacggtttaccgggttaccgggaccggggtaccggtaacccggtacgttaccgggtaccggtacccggttccggtaccggtaacccgtacccggtaacccgtacccgggtccccggttaccccgggtacccccggttacgggttacccccgttccgtttaaccccgttcccccgggttaccccttaccccccgggttaacgttcccgggtaacgggtttaacccgg

SEQ ID NO: 39207 - DNA, 888 bp, Homo sapiens
  misc_feature: GYAE6OF01CGDYU.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtcgctgactcagcccaccctcggtgtcgttcggccccaggacagacggtccttaataccgtggtggggaagcactattaggaagacaaaatgtgcacgtggtacatgcagacggccacggccacggtcccttggttttcggtccgttcgtacgtgtagtcgtacgtaccggacggccggccccttaggtacggtaccgtccccgtagacggtacgtaactttcccgtcccggtaccttaccgtaaccgtccgtgggtaccgaaccgtacccggtaccccgtaccctaccggaacctaaccgtaaccggtaaccggtaacggggtaccgggtaacggggtaccggggtaacggttaacggggtaaccggtaaccccggttaaaccgtttaaggttttaaccggttaccgggttaacccgggttacggggtttaggggtacgggttaagggtttagggtttcgggttttaacgggttagggttaccggttaccggggttacccgtttaccgggtttttacccggggaccggggtaacccggggtacccggtaccggttcccgggttaaccgtaccccgggttacggtaaccgggtaccgtacccgggtaacccgttaaccggggtcccgttaccccgggttccccccggttacggttaccccgttaccgtttcccggtttccccggttccccccgttacccggtttccccggtaacgttaaccgggtttaacccgg

SEQ ID NO: 39208 - DNA, 707 bp, Homo sapiens
  misc_feature: GYAE6OF01EYPTA.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagcccaccctcggtgtcgttcggcccaggacagacggccttaataaccgtggtggggaagcaacagttaggaagacaaaaatgtgcacgtagtacatgacagaggccaggccacggtcccttggttttcggtcgtctagtgatgactaccggagccggcccgtgacgggtactcccgtggacgcgtacttccgtcccggctacccgaacttcgtcggtacgaccgacccggaccctaccccgtcgaacccactaccgaaacgtacgggtaccggaagggttcggggagtacggacggaccgtaacttagttaaccgtggtacgtagggtggtacgggtagttgggttagttaggcggtacggtcgggtacgttaccggtttacggggaccgggacgggtaccctaggtccgtacggtacccgtacgtacgggtccgaccggaccccgtaagggtcccgtaccccggtcccccggtcggtaccctacccgttacccgttccccggttacccccgtaccccgttccgtaccggtaaggttacccgg

SEQ ID NO: 39209 - DNA, 827 bp, Homo sapiens
  misc_feature: GYAE6OF01BCF91.16.85.H08.1.454.CMB.1.raw
  modified_base (137)..(137): a, c, t, g, unknown or other
  misc_feature (137)..(137): n is a, c, g, or t
  modified_base (233)..(233): a, c, t, g, unknown or other
  misc_feature (233)..(233): n is a, c, g, or t
tcagtgtactactccacgaccggtgctcgatttagtatcactcagtcgcggggctgggcctaaggaagcagcactggtggtgcctcagccatggcctggaccgttctcctcctcggccctcctctctcactagcacnggctctgtgaccctcctatgtgctgacctcgacgccctcccgtcggtgtcggtcggcccaggacacgaccgtaccttaagaccgtggaggggaacncgaacgtagttaggaaacgacaaaagtgtacactacgtggtacagtgcgaaggacggccgacgggcccgaccggttcccttggttttcggtcgttactagtcgtatacgaacgtaccggccggacccggtccctaggacgggtacctccgtacgggaacgtcgttaccgtccgtcccggtctacccgtacgtcggtcggtaccgaccgacccgtcccgaacccgtacgaccacgtaccggaacggttacgggacggtacggggtaccgggagtaccggacgccgtaacttagtccgtcgtgtacggtgggttagggtaggtaggttagggttacggttgggtacgtccgggttcggtacccgggttttacgggttaccgggggacgggtacccgggtaaaccctacgggtacccggttaccggggtaaccccggttaccggtaaccggtccggtaaacccccgggacgggttacccggttcccccggaaccccgggtttccccccggttaccgggttaacccccgtacccgttttccccggttacccccgttaccccccggtacccgtttcccccgggtaaaggttaaccccgg

SEQ ID NO: 39210 - DNA, 562 bp, Homo sapiens
  misc_feature: GYAE6OF02GC90O.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggcccccaggacagacggccttaataacctgtgggggaagcaacattggaagcaaaaatgtgcactggtacatgcagaggccaggccaggcccctgtttggtcgtctatgatgataccgagcggccctcagggatccctgagcgattctccggctccaactctggtcgacacggccaccctgaccatcaacgacgggtcgaagtcggggatggaggccgactattactgtcaggtgtgggatggttgttagtgagtcgggctacgtttcgggcggtacgggacccagtcgtcgaccgtccgtaggtccacgcccgtaagggcctacggcccccgtggtccacgttctcggttccccacccgtccgtccgacgttaaccgg

SEQ ID NO: 39211 - DNA, 571 bp, Homo sapiens
  misc_feature: GYAE6OF02GDRXN.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaaataacctggtgggggaagcaacattggaagacaaaaaatgtgcactggtacatgcagaggccaggccaggcccctgtttggtcgtctatgatgataccgagcggccctcgagggactcccgtgacgcgtattctccggctccaactcgtggtgacacggccacctgaccatcaaacgtagggtacgaaggtcgggatggacgccgactattacgtgtacgaggtgtgggagtggtgttagtgagtcgggctacgtttcggcggtagggacccgagtcgtacgccgttcgtaggtcacgtcccgaaggcctccgccccgttcggtacctacgtccgttccgttcccgccctccgtcgtacgttaccg

SEQ ID NO: 39212 - DNA, 618 bp, Homo sapiens
  misc_feature: GYAE6OF02HPQLP.16.85.H08.1.454.CMB.1.raw
  modified_base (309)..(309): a, c, t, g, unknown or other
  misc_feature (309)..(309): n is a, c, g, or t
  modified_base (432)..(432): a, c, t, g, unknown or other
  misc_feature (432)..(432): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtggggaagcaacattggaagacaaaaatgtgcactggtacatgcagaggccaggccaggcccctgtttggtcgtctatgatgataccgagcggcctnagggatccctgagcgattcgccggctcccaactcgtggtcgacacggccaccctgacccatcaacgagggtacgaagtcggggatgaggccgactatactgtcaggtgtgggatggtgttagngtagtcgggtctacggttttacgggccgggtacggggaccccgaaggtccgtcggtacccgtccgttaacgggttccgacggccccgaaacgggccctcccggtaccccccgtccgggtacccgtaccgttcccgttccggtttacccccctacccccgttcccgttaccggaccggttaacccgg

SEQ ID NO: 39213 - DNA, 612 bp, Homo sapiens
  misc_feature: GYAE6OF02F6N20.16.85.H08.1.454.CMB.1.raw
  modified_base (448)..(448): a, c, t, g, unknown or other
  misc_feature (448)..(448): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagacaaaaatgtgcactggtacatgcagaggccaggccaggccccctgttttggtcgtctatgatgataccgagccggccctcgagggactccctgagcgtattcctccggctcccaactctggtcgacacggcccaccgtcgaccatacaacgacgggtacgaaggtcggggatggacggccgactattacgtgtcaggtgtgggatggtgttagngagtcgggctacgtttcgggcgggtacgggacccaggtccgtcgacccggtccgtagggtccacggacccgaacgggtcccgtaccggtccccccgtacgggttcccaccgttcccgttccggttcccccgtccccgttacccggttccggaacgttaacccgg

SEQ ID NO: 39214 - DNA, 600 bp, Homo sapiens
  misc_feature: GYAE6OF02G9WLH.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggcttaataacctggtgggggaagcaacattggaagacaaaaatgtgcactggtacatgcagaggccaggccaggcccctgtttggtcgtctatgatgataccgagcggcctcagggatccgtgagcgattctccggctccaactctggtcgacacggccacctgaccatacaacgagggtacgaaggtcggggatggacggccgacgtattacgtgtcgaggtggtgggtagtggttgttaggtgtacgtcgggtcgtacgtttacggcgggacgggacccgagtccgttcggacccggttcgtaggtccgacggacccgaacggccgtaccggtcccccgtcggtaccgtaccgttccgtccggttaccccggtcccctccggttaccggtagttaaccgg

SEQ ID NO: 39215 - DNA, 552 bp, Homo sapiens
  misc_feature: GYAE6OF02HZGEW.16.85.H08.1.454.CMB.1.raw
  modified_base (290)..(290): a, c, t, g, unknown or other
  misc_feature (290)..(290): n is a, c, g, or t
  modified_base (398)..(398): a, c, t, g, unknown or other
  misc_feature (398)..(398): n is a, c, g, or t
  modified_base (442)..(442): a, c, t, g, unknown or other
  misc_feature (442)..(442): n is a, c, g, or t
  modified_base (502)..(502): a, c, t, g, unknown or other
  misc_feature (502)..(502): n is a, c, g, or t
tcagtgtactactccacgaccggtgctcgatttagtatcactcagtcgcggggagctctgagagaggagcccagccctgggattttcaggtgttttcatttggtgatcaggactgaacagagagaacccaccatggagtttgggctgagctggctttttcttgtggccattttaaaaggtgtccaatgtgaggtgcggctattggacgcgtgggggagaattggtacaggccgtggggggtccctgagactctcctgtgcagcctcgtggattcaccttcggcagttacngccatcgacgtggtccgccaggctccgagggaggctgaggtggtctacgaggtatagtgttagtggtggtagcacatactacgcagactcgtagaagggtcccgttanacctatctccgagacgaacaacttccaaagaacatgacttaatntctgaccatatgacaagaacctggaagtacgaacgtaagacgacggactatcctattacngtcgcgtacgacccgtcccctcggccagtcgacctcggtagcgggtaacg

SEQ ID NO: 39216 - DNA, 554 bp, Homo sapiens
  misc_feature: GYAE6OF02FQ27Y.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgaacactggtacatgcagaggccaggccaggccccctgttttggtcgtctatgatgataccgagcggccctcagggatccctgagcgattctccggctccaactctggtgacacggccaccctgaccatcaacagggtcgaagtcgggatgaggccgactattactgtcaggtgtgggatgggtgttaggtgagtcgggctacgtttcgggcggagggacccagctgaccgtccgtaggtccagcccgaaggtctacggcccccgtcggtccacgtcgttcggttccccgtcccctccgtccgagttaaccg

SEQ ID NO: 39217 - DNA, 604 bp, Homo sapiens
  misc_feature: GYAE6OF02GUAVC.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagacaaaaatgtgcactggtacatgcagaggccaggccaggccccctgttttggtcgtctatgatgataccgagcggccctcagggctcccgtgagcgattccgtccggctccaactctggtgacacggcccaccctgacccatccgaacacgggtacgaaggtcggggatggacgggccgacgtattacgtcgtcgaggtgtgggattgggtgttaggtgtagtcgggctacgttttcgggcgggtagggacccgagtcgtcggaccgttccgtacgggtccacggtacccgagggtccctccggtcccccgtcggttcccgaccgttccgttccgttcccccgaccccttccgttaccgaccggttaaccg

SEQ ID NO: 39218 - DNA, 591 bp, Homo sapiens
  misc_feature: GYAE6OF02IRIG4.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagacaaaaatgtgcactggtacatgcagaggccaggccaggccccctgttttggtcgtctatgatgataccgagcggcctcgagggatccctgagcgattcctccggctccaactctggtcgacacggccaccctgaccatcaacgacgggtacgaaggtcggggatcggaggccgactattactgtcgaggtggtggagtggtgttagtgagtcgggctacgttttcgggcggacgggaccagtcgtcggtacccgttccgtaggtcgacgcccgaagggtcccgtaccgcccccgttcggtccctaccgttccgttcccgtttacccccaccccgttccctaccggtaagttacccgg

SEQ ID NO: 39219 - DNA, 588 bp, Homo sapiens
  misc_feature: GYAE6OF02IVGCJ.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctggtgggggaagcaacattggaagacaaaaatgtgcactggtacatgcagaggccaggccaggcccctgtttggtcgtctatgatgatatcgagcggcctcgagggatcccgtgagcgattcgccggctccaactctggtcgacgacggccaccctgaccatacaacgagggtcgaaggtcgggagtggaggccgtactagttactgtacgaggtggtagggtagtgggttgttaggtgagtcggtcgttacgtttcgggacggtacgggacccgagtcgtacgaccgtaccgtaggtcacggtacccgaaggtccgtccgtcccccgttcggtacctaccgttccgttaccgttccccacccgttcgtcggtaacgg

SEQ ID NO: 39220 - DNA, 640 bp, Homo sapiens
  misc_feature: GYAE6OF02FU1JK.16.85.H08.1.454.CMB.1.raw
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (550)..(550): a, c, t, g, unknown or other
  misc_feature (550)..(550): n is a, c, g, or t
tcagtgtactactccacgaccggtgctcgatttagtatcactcagtcgcggggagttctgagagaggagcccagccctgggattttcaggtgttttcatttggtgatcaggactgaacagagagaacccaccatggagtttgggctgagcgtgcgttttctaggtggccattttaaaggtgtcaatgtgaggtgcggctattggacgctgggggagaattggtacagccgtggggggtccctgagactctcctgtgcagcctctggattcaccttcggcagttatgcatgacgtgggtccncaggcctcgagggaagggctggaagtggtctgaggtnttagtgttagtggtggtagcactatactacgactagacctccgtaggaacgggccgttcaccctatcctaccgagacgactaacttccaaagtaacctagtacgccttaatacgttctaggactaattaagtcggactaacggtaacctagggacgaacggaaaccgaacggaaccgaccgggaccttaaacgttaccttaagttttaccgnggttacggaccggtaacggaccccggcccccggttaccgggaccttacgtccgtaccggttaccgtaacggtcggggtacgtaaccccgg

SEQ ID NO: 39221 - DNA, 647 bp, Homo sapiens
  misc_feature: GYAE6OF02HAJDX.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccacctcggtgtcgttggccccaggacagacggccttaataacctggtgggggaagcaacattggaagacaaaaatgtgcactggtacatgcagaggccaggccaggcccctgtttggtcgtctatgatgactaccgagccggccctcgagggctcccgtgagcgtattccgtccggccttaccaacgtctgggtcgaacaccggcccaacccgtgaacccataccaaacgtacgggtacgaaggtcggggatggaacggccgtaacttagttacgtggtacagggtggtagggtatgggttgttaggtgagtcgggacttacggttttcggacgggtaccgggaccctaggtcgtcggtacccgttaccgtacggtaccgaccggtacccgacgggtcctccggtaccccctcgggttaccctaccgttccgttccggtttacccccgaccccgtttacccgtccggtaacgttaacccgg

SEQ ID NO: 39222 - DNA, 581 bp, Homo sapiens
  misc_feature: GYAE6OF02JB8MP.16.85.H08.1.454.CMB.1.raw
  modified_base (362)..(362): a, c, t, g, unknown or other
  misc_feature (362)..(362): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggcccccaggacagacggccttaataacctgtgggggaagcaacattggaagacaaaaatgtgcactggtacatgcagaggccaggccaggcccctgttttggtcgtctatgatgataccgagccggccctcgagggactccccgtgagcgattcctccggcctccaactcgtggtgacnccggccacccgtgaccatccaacgacgggtacgaaggtccggggatggacggccgacttattacgtgtcgaggtcggtgggagtgggttgttaggtgtagtcgggtctacgtttcgggcgggacgggacccgagcgtcgacccgtcgaggtcacgacccgaggcctcgccccgtcgcctaccgttcgttccgttccccgtccctccgtcgtacgtaccg

SEQ ID NO: 39223 - DNA, 741 bp, Homo sapiens
  misc_feature: GYAE6OF02H4NRO.16.85.H08.1.454.CMB.1.raw
  modified_base (710)..(710): a, c, t, g, unknown or other
  misc_feature (710)..(710): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttcggccccaggacagacggccttaataacctggtagggggaagcaacattggaagacaaaaatgtgcactggtacatgcagaggccaggccaggcccccttgttttggcttctatgatgataccgagccggccctgacgggacttcccgtgacgcgtacttccgtccggcctacccaacttcgtcgggtacgaccgtacccggccctaccctcgaaccactacgaaacgacggggtacgaacggggttcggggatacgggacgggtacccgaactttaagtttaccgttacgtccggtaaggggttcgggttaggggttagtttagggtttagtttacgggttagggtaaccggttccggggtacgttttaacccgggttttcggggaaccgggggtaccgggtaaccccgtagggtccgtaccgggtacccgttaccggtacgggtacctaccggtaccccggacggtcccgtcccccgtcccccggttacggtacccgtacccgttcccgttcccggttaccccccnccccgtttcctacccgggttacgtaacccgg

SEQ ID NO: 39224 - DNA, 719 bp, Homo sapiens
  misc_feature: GYAE6OF02H49H6.16.85.H08.1.454.CMB.1.raw
tcagtgtactactccacgaccggtgctcgatttagtatcactcagtcgcgggctgggcctaaggaagcagcactggtggtgcctcagccatggcctggaccgttctcctcctcggcctcctctctcactgtacaggctctgtgacctcctatgtgctgactcagcccaccctcggtgtcgttcggcccaggacagacggaccttaaataaccgtggtagggggaagacaacattaggaagacaaaaatgtgcacgtggtacatgcaggaggccaggccacggcccctggttttcggtcgtctatgatgaataccgagcggccctcgaggactccctaggagcgtacgttccgtccggcctaccaacgtccgttaggtacgtacgaccgggacccacccgtacgaccccataccgaaaccgtacggggtacggtaacgggtcggggaacttgggaccggacccgtaacttagttacgttaggttacgacggggttgttaggggagtttgggttaggtttagggtcggtaggttccgggtaccgtttacggttttccggggacgggtaccgggacccgtacggtccgttacggtaacccgttcgtacgttcgaccgacggtacccggagggtccctcccgggtacccccgtacgggttaccctaccgttcccttaccgttcccccctaccccgtttcccgttaccggacggttaaacccgg

SEQ ID NO: 39225 - DNA, 588 bp, Homo sapiens
  misc_feature: GYAE6OF02GPFJR.16.85.H08.1.454.CMB.1.raw
  modified_base (448)..(448): a, c, t, g, unknown or other
  misc_feature (448)..(448): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgttgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcgagggatccctgagcgattctccggctccaactctggtgacacggcccaccctgacccatcaacgagggtacgaaggtcggggatcggaggccgactattactgtcaggtgtgggagttggtgttagtgagtcgggntacgttttcgggcggtacgggacccgaggtcgtcgacccggtccgtaaggtccgacgacccgaaggtccgtccggtcccccgtcggtcccaccgttccgttccgttcccgtcccccgtccctccggtacgtacgtacccg

SEQ ID NO: 39226 - DNA, 666 bp, Homo sapiens
  misc_feature: GYAE6OF02H7K15.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctggtaggggaagcaacagttggaagacaaaaatgtgcactaggtacatgcagacggccaggccacggcccccttggttttcggtcgtctatgatgagtaccgagccggccctcgagggtactcccgtgagcgattccgtccggctaccaactcgtgtacgaccgaccgccctaccctcgaccatccaaacgagggtaccgaagggtcggggaagtcggacgggtaccgacttacgttacgtcgtaccgtagggttcggtaggtaggttgggttagttaggtaggtagtaccggggtacttaccggttttaccggggcgggtacgggtaccccgagtacgtaccggtaccgttaccgtacggtacgaccggaccccggtaaggggcccttaccggcccccgttacggtcctaccgtccgttccggtcccccgtcccttccgttaccggtacgtacgg

SEQ ID NO: 39227 - DNA, 733 bp, Homo sapiens
  misc_feature: GYAE6OF02JE5XD.16.85.H08.1.454.CMB.1.raw
  modified_base (688)..(688): a, c, t, g, unknown or other
  misc_feature (688)..(688): n is a, c, g, or t
  modified_base (701)..(701): a, c, t, g, unknown or other
  misc_feature (701)..(701): n is a, c, g, or t
  modified_base (724)..(724): a, c, t, g, unknown or other
  misc_feature (724)..(724): n is a, c, g, or t
tcagtgtactactccacgaccggtgctcgatttagtatcactcagtcgcggggagctctgagagaggagcccagcccgtgggtattttcaggttgttttctatttggtgatcgaggactgaacagagagaacccaccagtggtagtttgggctggagtcgtggtctttttcgttggtcggtcctaagttttaaaaggtgtcctaatgtgaggtgcggcttagttggacgcggtagggggagtaagttcggtacgacggtccggtcggggggtccctggacgtacctccgtccgtggtcgccgacgtccgtcgttcggtacttcctaccgttcggactagttactcgaccgtagtcggacggttcggtcccgaccgcggtccgtaccggaaggggaacgggtcgtaggagggttcggtccgtacgtaggttacgttaggttggttaggtgggtagtacgcgaacgtaacgttacgacgtacgacgtaccgtccggtaggaacgggtcccgttaacaccgtacgtactaccgaagaccgtaaactaaccttaaccgaaacgtaatacgtaccgtaacttagttactacgtacgtaactacgtaacgtaacgtacgaaccggtaaacgtggaaaacggaagtaacccggaacgtaccgaccgtacctagttacctagttacgtcgcggacnccggacccgtccnccgactgtccgacgtcgtacggngtaacccgg

SEQ ID NO: 39228 - DNA, 587 bp, Homo sapiens
  misc_feature: GYAE6OF02GWKAZ.16.85.H08.1.454.CMB.1.raw
  modified_base (519)..(519): a, c, t, g, unknown or other
  misc_feature (519)..(519): n is a, c, g, or t
  modified_base (560)..(560): a, c, t, g, unknown or other
  misc_feature (560)..(560): n is a, c, g, or t
  modified_base (572)..(572): a, c, t, g, unknown or other
  misc_feature (572)..(572): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttcggccccaggacagacggccttaataacctggtgggggaagcaacattggaagacaaaaatgtgcactggtacatgcagaggcaggccacggccccttggtttggtcgtctatgatgactacgagccggcctgacgggactccgtgacgcgtattccgtccggctaccaactcgtggtcgacgaccgccaccctacgaacccactaccgaacgacgggtacgaacgggtacgggatacggacggaccgtaacttacgttacgtaggttacgagggttggtagggtagttgggttgttaggtgtaggtcgggtacttcggttcgggcggacggtaccngcgtcgccgtcgtagcgacgaccgagctacgcccgtcgtcnctctccgtcccncctcgtacgataccg

SEQ ID NO: 39229 - DNA, 759 bp, Homo sapiens
  misc_feature: GYAE6OF02FLV1T.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagcccaccctcggtgtcgttcggccccaggacagacggccttaataaccgtggtaggggaagacaacattggaagaacaaaaatgtagcacgtggtacatgcaggaggaccaggccacggcccccttaggttttcggtcgttctatggtaatggtaactaccggagcccggtaccctcggaacgggacttccccgtaggacgtacgtactttccgtccggtcctacctaacctcgtacgggtacaccgtaaccccgggccctaccccgtacgaaccctactaccgtaaacggaacggggttacgtaacggggttacggggagtacggggtacggaccccggtattaaacttacgttacgtcggtagggtacgggtagggttagtacgggtttaggttagaggtacggtccgggacgtttaaccgggttttcgggaccgggggtaccggtaccgtacggtcgtacggtaccccgttacgtacggttccgacggacccgtaacgggtccgtacccggccccccgttcggtaccttacccgttaccgttcccggtttcccccgaaccccgtttcccgtacgggaagttttaaccccggg

SEQ ID NO: 39230 - DNA, 696 bp, Homo sapiens
  misc_feature: GYAE6OF02HM5FJ.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagcccaccctcggtgtcgttcggccccaggacagacggcccttaataaccctggtgggggaagcaactagttggaagacaaaaatggtgcactggtacatgcagaggccaggccacggcccccttgttttcggtcgtctagtgatcgataccgaggcccggccctcgacgggctcccgtagagcgtattccgtccgctaccactcgtggtcgaccgccgaccctaccctacgaccactacaacgacgggtacgtaagggtcggggatacggacgggacccgtacgttaactttacgtcggtacgtagggtacggtgggtaggtttagggtaggtttaggagtcgtcgggtccttacgggtttccgggacgggtacgggacccgtacgtccgtaccggtacccggttaccgttacgtaccgacggtacccggtaacggtcccggtacccggtccccccgttaggtccccgtaccgttacccgttcccgggttcccccgtcccccggtttccggttaccggtaccggttaaccgg

SEQ ID NO: 39231 - DNA, 755 bp, Homo sapiens
  misc_feature: GYAE6OF02GX1V7.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtcgacctcctatgtgctgactcagccacctcggtgtcgttcggcccaggacagacggtccttaataaccgtggtaggggaagcaacagttaggaagacaaaaatgtgcacgtaggtacatcgacaggacggccacggaccgacggtccccgttggttttacggtcgttactagtgagtgacgtaccggagccggccctcgacgggactcccgtaggacgcgtacttccgtccggtactaccgtaacgttcgtacgggtcgaccgtaccggccctaccgtacgaacctacgtaccgaacggtacgggtacggtaaacgggtcggggtaactagggaccgggtaccgtaacgttaacgttacggtcgtacggtagggttggttacggggttagtttacgggttagttaacggtcggtaaccggttccgggttaaccgtttaccgggtttaccggggaccgggtaaccggtaccgtaacggttcccgtacgggtacccgttacggtacggtaccgacccgtaccggaacggtcccggtacccggtaccccgtacggacccttacccgtccgttacccgttaccccttacccggtccgttacggtaacgttacccgg

SEQ ID NO: 39232 - DNA, 654 bp, Homo sapiens
  misc_feature: GYAE6OF02FUS3I.16.85.H08.1.454.CMB.1.raw
  modified_base (225)..(225): a, c, t, g, unknown or other
  misc_feature (225)..(225): n is a, c, g, or t
  modified_base (316)..(316): a, c, t, g, unknown or other
  misc_feature (316)..(316): n is a, c, g, or t
  modified_base (386)..(386): a, c, t, g, unknown or other
  misc_feature (386)..(386): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagcccaccctcggtgtcgttcggccccaggacagacggccttaaataacctggtgggggaancaacattaggaagacaaaaatgtgacacgtggtacatgcagacggccaggccgacggccccttggttttggtcgtctatgatgataccggngccgcctcgaggactccgtgagcgtatcgtccggctaccgtaactcgtgtcgacgacccggcctacccgngaccactaccaacggtacgggtacggaagggtccggggatggacgggccgaatttacgttactggtacgtaagggtcgggttagggaagttgggttagttaggtcgtacggttcgggacgttacggtttcggggacgggtaccgggaaccgtcggacgttccggaaccggttccgttagggtaccacgtcccgaacggggtcctcccggtcccgtccggtactccgttccgtacggttccccctacccgtcccgttaggacgttaccg

SEQ ID NO: 39233 - DNA, 613 bp, Homo sapiens
  misc_feature: GYAE6OF02IKEOP.16.85.H08.1.454.CMB.1.raw
  modified_base (391)..(391): a, c, t, g, unknown or other
  misc_feature (391)..(391): n is a, c, g, or t
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcgtgtcgttggccccaggcagacggccttaataacctggtggggaagcaacattaggaagacaaaatgtgcactaggtacagtgcagacgcgaggcacggcccctgtttgtcgtctatgtatagacttaccgacgcggtccctacgacgggactccctggagcgtacgttccgtccgacgtcctaacctcgtaggtcgacgaccgccacctcgaccacnccgaacgtacgggtacgaggttcggggattcggacgggtacccacgttattacgtgttcgagggttcgagggtgtggtagttagtgagtacggcttaacggtttcgggcggacggaccctggccttacgcccgtctacgggacacggacccgtaaggtcctccccggtcccgtcgcttaaccgtccgttcctaccccgacccctcggttacgacgttaaccg

SEQ ID NO: 39234 - DNA, 758 bp, Homo sapiens
  misc_feature: GYAE6OF02H66SO.16.85.H08.1.454.CMB.1.raw
  modified_base (225)..(225): a, c, t, g, unknown or other
  misc_feature (225)..(225): n is a, c, g, or t
tcagtgtactactccacgaccggtgctcgatttagtatcactcagtcgcgggctgggcctaaggaagcagcactggtggtgcctcagccatggcctggaccgttctcctcctcggcctcctctctcactgcacaggctctgtgacctcctatgtgctgactcacgcccacccgtcggtgtcgttcggccccaggacagacggacttaataccgtggtaggggaancaactagttaggaagaacaaaaagtgtgacacgtaggtacacgtgacgaggacggaccgaaggccgaacggccccgtttgtttggtcgttctatgatgaactaccggaggcgccctcgaggactccgtaggacgtacgctttaccgtccggtacctacccgtaaccttcggttcggtagacccgaacccgggtccctaacccgtcgaacccaacgtaccgaaaccggagggttacccggaaaggggtaccgggtaggtacggacggtaccggtaattaacgttagtcggtacggtagggttagggtacgggtagtggttaggttacggttagggtaggttaccgggtacgtttaccgggttttaccggggacgggtaaccggggacccgtaggtacccgttaccggtaacccggtccggttaacggcgtacccggacccggtacggtccggtaccccggtccccggtcggttaccctaccgtccgttacccggttccccggtccccgtttaccgtaccggtacggttaacccg

SEQ ID NO: 39235 - DNA, 711 bp, Homo sapiens
  misc_feature: GYAE6OF02HK023.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagcccaccctcggtgtcgttcggccccaggacagacggccttaataacctggtaggggaagcaacattggaagacaaaaatgtagcacgtggtacatgcagaggccaggccaggccccttggtttcggtcgtctatgatgactaccgagcggccctcgagggactccgtgacgcgtacttcgtccggtctacccaactcgtggtcgaccgacggcccaccgtcgacccatacgaacgacgggtacgaacgggtcgggatcggacggtaccgattacttacgtcgtcgtagggtggtagggtagtttcgggttagttaggtcgtacggtccgggtacgtttaccgggttttccggggaccggggtaaccggggtacccgaggttcccggttaaccggtacccggttaccggttaaccggttccgaccgggtaccccggtaacggttcccggtccccggtaccccccgttacgggtaccctacccggtttcccgttccccggttacccccctaccccggtttcccggttacccggttacggttaacccgg

SEQ ID NO: 39236 - DNA, 788 bp, Homo sapiens
  misc_feature: GYAE6OF02GDP9A.16.85.H08.1.454.CMB.1.raw
tcagtgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttcggccccgggacagacggtaccttaataaccgtggtgggggaagcaactagttaggaagacaaaaatgtgctacgtggtacagtcgacgaggacggccacgggccgacgggtcccccttggttttcgggtccgttcgttagtgtacgtaggaacgttaaccgcggaccggccccgtacggacgggtacctcccgtaggacgcgtacttccgccggtcctaccacttcgtggtacgaccgacccggtaccacccgtcgaccactaccgaacggtacgggtaccgaagggtacggggtagtacgggacggcccgttaactactttacgtagtacggtagggtgggttaggggtgttacgggttagttagtgggtacggtcgggtacgttacggtttcgggaccgggtaccgggaccctaagggtccctaacgggtaccccgttacggtacggacccgaacggtaccccggtaacggtccccggttacccggtaccccccggtttaccgggttacccttacccccgggttccgttttaccccccgggtccccccggttaccccgtttaccccggttacgggtaaccggtttaacccggttaaacccggg

SEQ ID NO: 39237 - DNA, 754 bp, Homo sapiens
  misc_feature: GYAE6OF02F8H52.16.85.H08.1.454.CMB.1.raw
  modified_base (271)..(271): a, c, t, g, unknown or other
  misc_feature (271)..(271): n is a, c, g, or t
tcagtgtactactccacgaccggtgctcgatttagtatcactcagtcgcggggctgggcctaaggaagcagcactggtggtgcctcagccatggcctggaccgttctcctccgtcggcctcctctctcgactgccagagctctgtcgaccttccgtatgtcgctagctcacgccctaccgtcgttcgtcggttacggccctaggaccgacggtacccggtacttaaacgtaaccggtgggtaggggaactacgtaacgtaagtacggaaanaaccgtaaaagtcgtacggaacctacggttagtacctgtcgacgaggtacgaccgccggaaccgtaccggtcccgtttgggttccgtaccgttacgtacgtagtaacgtcggtaaccgtaccggtaaccgtccggtacccgttaaggcggtttaacccgtccggtaggtaccgtcgttacccgtcccggtccgtccgttaaccgtagttcggtaaccgtcgaaccgtcccgaccgtactaccgtaccgtactaaaccggacggttaacgggcggttacgggtaccggtaagcggtaaccgtccgttaacgtactcgtaacggtgtacggtcggtagtcggtgttaggttcgacgtcggtggttaccgttcgtaccgggtcgaccgtagcgtacgccgtacgttcgacgtcgaccgcgtacggccctacggtccctacgcccgttctacccggtccgttaccgcccgtacctacgtaactccgg

SEQ ID NO: 39238 - DNA, 541 bp, Homo sapiens
  misc_feature: GYAE6OF01D9Z6U.10.20.B09.1.454.CMB.1.raw
  modified_base (195)..(195): a, c, t, g, unknown or other
  misc_feature (195)..(195): n is a, c, g, or t
  modified_base (298)..(298): a, c, t, g, unknown or other
  misc_feature (298)..(298): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcgagggccgtcagaatattgctaccaacttagcctggtatcaaacaaaagcctggccaggcctcccagacctcctcatctctggtncatcttcgaggccacgtggtcgtcccagccaggttcaggtggcaggtgggtctagggaacaggagttcactctacaccatcagcgcctgcagtctagaagtattttgacttagtttattactgtacagctaagtataatgtacttgggttttacttacgtacgttttcggaccctagggaacctaaaggttcgtatttcgaaggtacgtaatggtgcgttgacctacattcttcgttctctac

SEQ ID NO: 39239 - DNA, 564 bp, Homo sapiens
  misc_feature: GYAE6OF01CREI3.10.20.B09.1.454.CMB.1.raw
  modified_base (196)..(196): a, c, t, g, unknown or other
  misc_feature (196)..(196): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggganagacgccaccctctcctgcgaggggccggtcaagaatattgactaccaacttagcctggtaatacaaacaaaagcctggaccaaggcctcccagacctcctcattcctctggtcgcattcttcggagggcccacgtggtcgtccccagcctaggttcaggtcggctaggtggggtctagggaacaggtagttcactctacaccatcgagcggctgctagtctagaatatttgactagtttatactgtacagtctagtaataagtgtaacgttggttttactcgtacgtttcggaccgtaggaacctaaggtggtatttcgaaggtacgtaagttggtggacttgacctactattctgttccttgtacg

SEQ ID NO: 39240 - DNA, 607 bp, Homo sapiens
  misc_feature: GYAE6OF01DIVHP.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagcccaccctctcctgcgaggggccggtcagaatattgactaaccaacttagcctggtatacaaacaaaagcctggccaggcctcccagacctcctcatctctggtgcatcttcggacgggccacgtggtcgtcccaggcctaggttcaggtggcaggtgggtctaggaacagtagttcactctacacatcacggcggcctgcagtctagaagtattttgcttaagtttacttactgtacaggtactaagttataagtggtaactttgggttttattccgtaaccgttttccggacccgttaggggaacctaaagggttcggtaacttttacggaaacggtaaccgtaaacgttgggtcggtaccgttgacccgtaaccctatttccgtcggtttcccttacgttaaccc

SEQ ID NO: 39241 - DNA, 508 bp, Homo sapiens
  misc_feature: GYAE6OF01AJQIZ.10.20.B09.1.454.CMB.1.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctcccagactcctcatctctggtncatcttcgagggccactggtgtcccagccaggttcagtggcaggtgggtctgggaacagagttcactctcaccatcagcggcctgcagtctgaagtatttgctagtttattactgtcagctagtataatgtacttgggttttattctactttcggcctgggacctaagtcggtattcgagtacgtaagtgtggctgctacatctgtcttcgtac

SEQ ID NO: 39242 - DNA, 504 bp, Homo sapiens
  misc_feature: GYAE6OF01BLB56.10.20.B09.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (418)..(418): a, c, t, g, unknown or other
  misc_feature (418)..(418): n is a, c, g, or t
  modified_base (499)..(499): a, c, t, g, unknown or other
  misc_feature (499)..(499): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaagcctggccaggctcccagactcctcatctctggtncatctcgaggccactggtntcccagccaggttcagtggcagtgggtctggaacagagttcactctcaccatcagcgctgcagtctgaagtatttgctagtttattactgtcaactatcgtaccgngtcggccgtccggggcctacgtttcggcccgtgggaccaaggtggagtatcgaaacgactgtggctgcacatctgtcttcntcccg

SEQ ID NO: 39243 - DNA, 531 bp, Homo sapiens
  misc_feature: GYAE6OF01AEDAT.10.20.B09.1.454.CMB.1.raw
  modified_base (194)..(194): a, c, t, g, unknown or other
  misc_feature (194)..(194): n is a, c, g, or t
  modified_base (292)..(292): a, c, t, g, unknown or other
  misc_feature (292)..(292): n is a, c, g, or t
  modified_base (394)..(394): a, c, t, g, unknown or other
  misc_feature (394)..(394): n is a, c, g, or t
  modified_base (515)..(515): a, c, t, g, unknown or other
  misc_feature (515)..(515): n is a, c, g, or t
  modified_base (527)..(527): a, c, t, g, unknown or other
  misc_feature (527)..(527): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaagcctggccaggctccagactcctcatctctggtncatcttcggagggccacgtggtcgtcccagccaggttcaggtggcaggtgggtctggaacagtagttcactctcaccatcagcggctgctagtctagaagtntttgctagttttattactgtcagctagtataatgtacgtttgggttttactcgtaccgtttcggcccgttagggaacctaaggtcggtactttcgagtacgtaatggtcggctgcctactnttctcgttcttntacg

SEQ ID NO: 39244 - DNA, 576 bp, Homo sapiens
  misc_feature: GYAE6OF01CNGMV.10.20.B09.1.454.CMB.1.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaacaaaagcctggccaggcctcccagactcctcatctctggtncatcttcgagggccacgtggtcgtcccagccaggttcagtggcaggtgggtctggaacnggagttcactctcaccatcagccggctgcagtctagaagtattttgcttagttttattactgtacagtctaagttaattaagttgtaacgtttgggtttttaacttcgttaaccgtttttccgggaccccttaggggaaccctaaaggttggtaacttttccgaagtaaccgtaacgttggtggaccttggacctaccctattccgttcgttccttcgtaccg

SEQ ID NO: 39245 - DNA, 517 bp, Homo sapiens
  misc_feature: GYAE6OF01BUU0Q.10.20.B09.1.454.CMB.1.raw
  modified_base (314)..(314): a, c, t, g, unknown or other
  misc_feature (314)..(314): n is a, c, g, or t
  modified_base (389)..(389): a, c, t, g, unknown or other
  misc_feature (389)..(389): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtntcccagccaggttcagtggcaggtgggtctggaacagagttcactctcaccatcagcagcctagacgcctgaatnttttggcgttttaatctgtcagcagcgtgccagtcggcctgtccgtttcccttcggccctgggaacctaaaggtggaatataccgaaaacgtattggtgctgacctacctattcctgttccttcgtac

SEQ ID NO: 39246 - DNA, 630 bp, Homo sapiens
  misc_feature: GYAE6OF01D4MJQ.10.20.B09.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccgagggganagacgcccaccctctcctgcaggggccggtnagaatattgctaaccaacttagcctggtatacaaacaaaagcctggccaggcctccagacctcctcatctctggtgctatcgttcggacgggtccacgttcggtcgtcccagtcccgtagggttcaggtcggcgtagggttggggtcgtagggaaactaggtacgttccacttcctacaacctagtaccgacggccggtccctggacctagttctaggtaaggttattttgaccttagttttacttacgtgttcaagtctaagttaattagtgtacgttttgggttttaacttccgttaccgttttccggacccgttagggtaaccctaaaggttcggtactttacgaaggtacgtaagtggtacggccttagacctacgtacttcgttacgttcttctaccg

SEQ ID NO: 39247 - DNA, 516 bp, Homo sapiens
  misc_feature: GYAE6OF01EORKF.10.20.B09.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (400)..(400): a, c, t, g, unknown or other
  misc_feature (400)..(400): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcagggccgtnagaatattgctacaattgcctggtatcaacaaagcctggccaggctccagacctcctcatctctggtgctatcgttcggacgggccacgtggtcgtcccagccgaggttcaggtggctaggtgggtctagggaacaggtagttcactctacaccatcagcggctgcagtctgaagtntttgcttagtttatactgtcagtctaagtataatgtaacgttggtttattctacgtttcggccgtaggacctaaggtgtattacgagtacgtatgtgctgctacatctntctntac

SEQ ID NO: 39248 - DNA, 608 bp, Homo sapiens
  misc_feature: GYAE6OF01AS9PD.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgccaccctctcctgcgagggccgtcagaatatgctaccaacttagcctggtatcaaacaaagcctggccaggcctacccagacctcctcactctcgtggtgcattctcggacgggccacgtggtcgtccccagccgtaggttccaggtcggcgtaggtcggggtctaggaacgaggtacgttcacttctaccaacctagtccgaggtccggcctggactacgtactagaagttatttcgacttagttttacttacgtgtacagtctagttaatagttcgtacgtttggtttactcgtacgtttccggaccgttagggaaccgttaaaggtcgttaacgttcgaaggtaaccgtagttgggtcggtcctacggtacctaaccgtacgtttcgttacgttccttcgtaccg

SEQ ID NO: 39249 - DNA, 505 bp, Homo sapiens
  misc_feature: GYAE6OF01DFIYZ.10.20.B09.1.454.CMB.1.raw
  modified_base (194)..(194): a, c, t, g, unknown or other
  misc_feature (194)..(194): n is a, c, g, or t
  modified_base (502)..(502): a, c, t, g, unknown or other
  misc_feature (502)..(502): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctcccagactcctcatctctggtgcatcttcgagggccactggtgtcccagccaggttcagtggcaggtgggtctggaacagagttcactctcaccatcagcggcctgcagtctgaagattttgctagtttattactgtcagtcagttataatgtacttgggttttattctactttcggcctgggacctaagtggtatttcgagtacgaatggtgctgctacatctgtcttntcc

SEQ ID NO: 39250 - DNA, 634 bp, Homo sapiens
  misc_feature: GYAE6OF01CTSHM.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcgacgggccgtacagaatattcgaccttaaccaacttagccttggtaatacaaacaaagcctggaccaggcctccagacctcctcatcgtctggtgctatcgttcggacgggccacgtggtcgtcccagccgaggttcaggttggcgtagggttcgggtcgtaggaactaggtacgttccaccttctaccgaacctacgtaccgtacggacccggtcctggacgttacgtacgttaaggtaacgttattttcgacgtttaggttttacttacgttcgtacgagtacgtaagttaacttagttacgttagtttcggtttttaactcgttaaccgtttcggaccgttaggaactaaggttcgtattacgacgtaacgtactggtcgcgtataccgtaccttatacgtttcgtccttcgtacccg

SEQ ID NO: 39251 - DNA, 550 bp, Homo sapiens
  misc_feature: GYAE6OF01EFW25.10.20.B09.1.454.CMB.1.raw
  modified_base (194)..(194): a, c, t, g, unknown or other
  misc_feature (194)..(194): n is a, c, g, or t
  modified_base (547)..(547): a, c, t, g, unknown or other
  misc_feature (547)..(547): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcgagggccggtcagaatattgctaccaacttagcctggtatcaaacaaaagcctggccaggcctcccagacctcctcatctctggtgctatcgttcggacgggcccacgttggtcgtccccgagtcccgtaggttccaggtggcgtaggtcgggtctagggaacaggtagttcactctcacctatcgacgccggtcctggctagtctagaagtatttgactagttttactacgtgtacagtctaagttataagtgtacgttggttttatcgtacgtttcgccgtagggaactaaggtgtattcgagtacgtagtgtgctgctacattctgttctntac

SEQ ID NO: 39252 - DNA, 525 bp, Homo sapiens
  misc_feature: GYAE6OF01BJ27X.10.20.B09.1.454.CMB.1.raw
  modified_base (195)..(195): a, c, t, g, unknown or other
  misc_feature (195)..(195): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (512)..(512): a, c, t, g, unknown or other
  misc_feature (512)..(512): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccggtcagaatattgctaccaacttagcctgtatcaacaaagcctggccaggctccagactcctcatctctggtgcatcgttcgagggccacgtggtcgtcccagccaggttcagtcggcaggtgggtctaggaacagagttcactctacacatcgagcggctgcagtntgtaagtntttgctagtttattacgtgtcagctagttataagtgtacgttgggtttacttctacgtttcggccgtacggtaactaaagttggtactttacgagacgtagtggtcgctacgctaccnttctgtcttctac

SEQ ID NO: 39253 - DNA, 551 bp, Homo sapiens
  misc_feature: GYAE6OF01AJBL9.10.20.B09.1.454.CMB.1.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
  modified_base (405)..(405): a, c, t, g, unknown or other
  misc_feature (405)..(405): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcgagggccggtcagaatattgctaccaacttagcctggtatcaacaaagcctggccaggcctccagactcctcatctctggtnctatcgttcgagggccacgtggtcgtcccagccgtaggttcaggtggctaggtcgggtctaggaacagtagttcactctacaccatcgagccggcctgctagtctgaagtnttttcgcttagtttacttacgtgtcagtctaagtataatgtacgtttggttttactctacgtttcggccgttagggaacctaaggtgtacttcgaaggtacgtagttggtcggtctacggacctacgtatctcgttccttcgtacc

SEQ ID NO: 39254 - DNA, 537 bp, Homo sapiens
  misc_feature: GYAE6OF01EF9YN.10.20.B09.1.454.CMB.1.raw
  modified_base (193)..(193): a, c, t, g, unknown or other
  misc_feature (193)..(193): n is a, c, g, or t
  modified_base (284)..(284): a, c, t, g, unknown or other
  misc_feature (284)..(284): n is a, c, g, or t
  modified_base (370)..(370): a, c, t, g, unknown or other
  misc_feature (370)..(370): n is a, c, g, or t
  modified_base (443)..(443): a, c, t, g, unknown or other
  misc_feature (443)..(443): n is a, c, g, or t
  modified_base (534)..(534): a, c, t, g, unknown or other
  misc_feature (534)..(534): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcagggccagtcagagtgttggcgcctacgtagcctggtaccaacagaaacctggccaggcctccaggcccctnatctatggtgcatccaagacgggccacgtggcatcccagccaggttcagtggctaggtgggtctgggacagacttcactctcaccntcatcagcctggacgtcctagaacgtattgttgacgttagtttaacttacttgtactaacgtatccgtaacgngtcggcccggtccggggtacctaccgttccggcccgtacgggaccaaggtggatacgtacgaaacgtactggtcgctgctacatctctctntac

SEQ ID NO: 39255 - DNA, 547 bp, Homo sapiens
  misc_feature: GYAE6OF01D8HGF.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctccagactcctcatctctggtgcatcttcgagggccactggtgtcccagccaggttcagtggcagtggtctggaacagattcactctcaccatcagccggctgcagtctagaagtatttgctagtttattacgtgtcagctaggttactaatgactttagggttttatcgtacttttccgggaccttacgggaacctaaggtgtactttacgacggtaacgtaacgttggtcggtcgtgtacctaaccgtattccctaggttcccttcgtaacccg

SEQ ID NO: 39256 - DNA, 534 bp, Homo sapiens
  misc_feature: GYAE6OF01DW8VZ.10.20.B09.1.454.CMB.1.raw
  modified_base (194)..(194): a, c, t, g, unknown or other
  misc_feature (194)..(194): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (529)..(529): a, c, t, g, unknown or other
  misc_feature (529)..(529): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaattagcctggtatcaacaaaagcctggccaggcctccagactcctcatctntggtnctatcttcggaggccacgtggtctccagccaggttcagtggcaggtgggtctaggaacagtagttcactctacacatcagcgcctgcagtctagaatatttgctagtttattactgtacagctagttataagtgtacgttgggttttactcgtacgtttcggaccgtgggacctaaaggtggtactttcgaaggtacgtaagttggtggctgacctacctattccgttgttccttntaccg

SEQ ID NO: 39257 - DNA, 512 bp, Homo sapiens
  misc_feature: GYAE6OF01AVHMX.10.20.B09.1.454.CMB.1.raw
  modified_base (193)..(193): a, c, t, g, unknown or other
  misc_feature (193)..(193): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (409)..(409): a, c, t, g, unknown or other
  misc_feature (409)..(409): n is a, c, g, or t
  modified_base (499)..(499): a, c, t, g, unknown or other
  misc_feature (499)..(499): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaattagcctggtatcaacaaaagcctggccaggctcccagactcctcatctctggtgcatcttcgaggccactggtcgtcccagccaggttcagtggcagtgggtctggaacagagttcactctcaccntcagcggcctgcngtctgaagtatttgctagtttatactgtcagnagtataagtgtacgttgggtttattcgtacgtttcggcccgtagggtacctaaaggtgtatttcgagtacgtaactggtcgctagctacnttctgtcttctac

SEQ ID NO: 39258 - DNA, 888 bp, Homo sapiens
  misc_feature: GYAE6OF01A3DK2.10.20.B09.1.454.CMB.1.raw
  modified_base (196)..(196): a, c, t, g, unknown or other
  misc_feature (196)..(196): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccgagggganagacgcccaccctctcctggcgacggggccggtacaagaattattcgaccttaaccaactttagccttaggtaactacaaacaaaagcctaggccaggcctacccagacctcctctatctctggtcgctactcgttcggacgggtcctacgtggtcgtaccccgagtccgtaggttcaggttcggctagggtgggtcctagggaaacctaggtacgttccaaccgttccttacccgaacctacgtccgaccgggtccgggtacccttcggcctaaggtttccgttaacggtaaaaggttaacgtttttcggaaccgtttaaggttttttaacgttaaccgttcggttaccgtaaggtaccgttaaaggtttaacgttaaacggtttcgggtttaaccggttttttacgggggttttttaacctttaaccccggtttttaacccggttttacccgggggttaaacccccccggttaagggggggttaaaacccccttaaaaggggttttacccggggttttaaacgtttttacccgggaaaacggggtttaaaccccgggtttaaaacggttttacccgggggtttaccggggtaaccccgtttaaccgggaacccccgtttaaaaccccgtttacggttttaaccccgttttcggggttttaaccccctttttacccgttaaaaccccccgg

SEQ ID NO: 39259 - DNA, 591 bp, Homo sapiens
  misc_feature: GYAE6OF01DH5RS.10.20.B09.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggganagagcccaccctctcctgcagggccgtnagaatnttgctaccaattgcctggtatacaacaaaagcctggccaggcctccagactcctcatctctggtgctatcgtcggagggccacgtggtcgtcccagcctaggttcaggtggcaggttgggtctagggaacagtagttcactctacacctatcgagcggcctgctagtctagtaagttattttgcttagtttattaccgtgtctagtctaagttaattaagtcgttacgtttagggtttttattccgttacgtttccgggacccgttagggaaccgtaaaggttggttaactttacgaaggtaaccgtaagttggtcggccttacgacctaacctagttccgttacgttcctttacgtaccg

SEQ ID NO: 39260 - DNA, 504 bp, Homo sapiens
  misc_feature: GYAE6OF01A1UHZ.10.20.B09.1.454.CMB.1.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggganagagccaccctctcctgcagggccgtcagaatatgctaccaacttgcctggtatcaacaaaagcctggccaggcctcccagacctcctcatctctggtncatctcgaggccactggtctcccagccaggttcagtggcagtgggtctggaacngagttcactctcacatcagcgctgcagtctgaagtntttgctagtttatactgtcagctagtataatgtacttggtttatctacttcggcctagggaacctaaggtcgtattcgagtacgtaatggtcggctgactacctatctcgttcttctacg

SEQ ID NO: 39261 - DNA, 651 bp, Homo sapiens
  misc_feature: GYAE6OF01DLQT5.10.20.B09.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggganagagcccaccctctcctgcagggccgtcagaatattgctaccaattagcctggtatacaactaaaagcctggaccacggctcccagacctcctcactctcgtggtnctatcttcggaggcctacgtcggtcgtcccagccgtaggttcagtcggcgaggttcggtcgtaggaacgacggtagttcactcctccacctactcgacgccggtcgtcgacgtacgtacgtagtaagttagttttgaccttaaggttttacttaaccgttgtacgtacgtacgtaagttaattaagttacgttacggtttacgggtttttactttaccgttaccggttttccggacccgttacggggtaaacccgtaaaaggttcgggtaacttttacggaacggttaacgtaacggttggttcggtactacgaccgtaaccgtacttcgttcgttcctttctaacccg

SEQ ID NO: 39262 - DNA, 598 bp, Homo sapiens
  misc_feature: GYAE6OF01C0RZY.10.20.B09.1.454.CMB.1.raw
  modified_base (195)..(195): a, c, t, g, unknown or other
  misc_feature (195)..(195): n is a, c, g, or t
  modified_base (304)..(304): a, c, t, g, unknown or other
  misc_feature (304)..(304): n is a, c, g, or t
  modified_base (427)..(427): a, c, t, g, unknown or other
  misc_feature (427)..(427): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcgagggccggtcaagaatattgctaccaacttagcctggtatacaaacaaaacgcctggccaggcctacccagacctcctcatctctggtncatcttcggacggccacgtggtcgtccccagcccgtaggttcaggtcggacagggttcgggtactagggaaacaggtagtttcacttcacaccatcagccggcctggctagtcgtagtaagtnttttaggcttagttttattacgtgtactagtactagttaattaagtgttaacgtttagggtttttactcgttaccgtttccggacccgttagggtaacctaaaggttggtaactttcgaaacggtacgtagttggttcggactcgactacctacttgtcgttctttcctac

SEQ ID NO: 39263 - DNA, 516 bp, Homo sapiens
  misc_feature: GYAE6OF01A5FF4.10.20.B09.1.454.CMB.1.raw
  modified_base (316)..(316): a, c, t, g, unknown or other
  misc_feature (316)..(316): n is a, c, g, or t
  modified_base (392)..(392): a, c, t, g, unknown or other
  misc_feature (392)..(392): n is a, c, g, or t
  modified_base (513)..(513): a, c, t, g, unknown or other
  misc_feature (513)..(513): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagccttggtatcaacaaaagcctggccaggctcccagactcctcatctctggtgcatcttcgagggccactggtntccccagcctaggttcagtggcaggtgggtctggaacaggagttcactctcaccatcagcgctgcagtctgaagtntttgcttagtttacttactgtacagactagtaataagtgtacttgggttttatcgtactttcggcctagggacctaaggtgtatttcgagtacgtaagtgtggctgacactatctgttctntac

SEQ ID NO: 39264 - DNA, 763 bp, Homo sapiens
  misc_feature: GYAE6OF01B5VE4.10.20.B09.1.454.CMB.1.raw
  modified_base (262)..(262): a, c, t, g, unknown or other
  misc_feature (262)..(262): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctcctgcgacgggccggtcagaatattgacctaccaacttagcctggtaccctnaaacaaagcctggccaggcctcccagacctcctcatctctggtcgcatcgttcggacggggccacgtgggtcgtccccaaggtccctagggtttccaggttcggaccgtagggttcgggggtctaggggaaacagggtacgtttcaccttccgttaccaaccctagtccgacgggtcccggacccgttcggaccgtaggttccgtaaggtaaacggttacttttttcggaccgtttaagggtttttaactttacgttacggttacctaaggtacttaaagggtttaaacttaaaggtttcggttaaaccggtttttgggggttttttaaccttttaccggttacccgtttttcccggggaccccggtttaggggtaaacccttaaaaaggggtttcggttaacgttttaccggaaacggtaacccggtaaacggttgggtacggtacgttacggtacccgtaacccgttacttcccggtttcgttcccgtttcctaacccg

SEQ ID NO: 39265 - DNA, 533 bp, Homo sapiens
  misc_feature: GYAE6OF01AJ0IJ.10.20.B09.1.454.CMB.1.raw
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtncatcttcggagggccactggtcgtccccagccaggttcagtggcagtgggtctggaacngagttcactctcaccatcagcgcctgcagtctgaagtntttgactagttttatactgtcagctagtataatgtacgtttgggttttacttctacgtttcggcccgttagggaaccctaaggtgtactttcgaagtaccgaattggtcgctcgacctaccgtattcttcgtccttcgtacc

SEQ ID NO: 39266 - DNA, 533 bp, Homo sapiens
  misc_feature: GYAE6OF01BIUOP.10.20.B09.1.454.CMB.1.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
  modified_base (387)..(387): a, c, t, g, unknown or other
  misc_feature (387)..(387): n is a, c, g, or t
  modified_base (513)..(513): a, c, t, g, unknown or other
  misc_feature (513)..(513): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccgtcagaatattgctaccaacttagcctggtatcaacaaaagcctggccaggctcccagactcctcatctctggtncatcttcgagggccactggtgtcccagccaggttcaggtggcagtgggtctggaacagagttcactctcacatcagcgctgcagtctgaagtntttgactagtttatactgtcagtctagtataagtgtacgtttgggttttattcgtacgtttcggccgtagggaacctaaggttgtatttcgaagtaccgtaagttggtacggctagacctaacctnttacctgttccttactaccg

SEQ ID NO: 39267 - DNA, 522 bp, Homo sapiens
  misc_feature: GYAE6OF01C9AGG.10.20.B09.1.454.CMB.1.raw
  modified_base (194)..(194): a, c, t, g, unknown or other
  misc_feature (194)..(194): n is a, c, g, or t
  modified_base (512)..(512): a, c, t, g, unknown or other
  misc_feature (512)..(512): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcagggccgtcagaatattgctaccaattagcctggtatcaacaaaagcctggccaggctcccagacctctcatctctggtgcatcttcgagggccacgtggtcgtccccagcccaggttcagttggcgtaggtgggtctagggaacagtagttcactctcaccatcacgcgcctgacagtctagatattttgctagttttatactgtacagtcaagttataagtgtacgtttggttttacttctacgtttcggaccgttggaactaaaggtgatttcagtacgtatggtgctgctacatntgtcttctac

SEQ ID NO: 39268 - DNA, 578 bp, Homo sapiens
  misc_feature: GYAE6OF01A1GSL.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctcccagataccactggagaagtagtgattacgcagtctccagccaccctgtctgtgtctccaggggaaacagccaccctctcctgcagggccagtcagagtgttggcagcaggttagcctggtaccagcagaacgtggccaggctccaggctcctcgtatatggtgcatcccaccgagggccacgtggtatcctcgaggctagggttcccgtggccaggtgggtctggggacaggtagttcacttgtccactatcagcacgcctgctagtctagaagtatttgcttagtttattactgtcagtctagttataatgtctcggcccgtcggtacggtttccggaccgtaacgggaccggagggttacggtaaacttaccggaaaacgtacgttaggtacgggtcgtacggaccctaaccgtacgttccgtagtttcttccgtaacgtttccccg

SEQ ID NO: 39269 - DNA, 888 bp, Homo sapiens
  misc_feature: GYAE6OF01ACOYK.10.20.B09.1.454.CMB.1.raw
  modified_base (353)..(353): a, c, t, g, unknown or other
  misc_feature (353)..(353): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctccgtggcgacggggtccgtacagtaattattcgacctaacctaacgttacgccgttaggttaactaccaaaaccgaaaacggtcctacgggacccaacgggccctacccgaagtacccttccctactacttccgtcgtgggtcnctacttccggttaccggacgggaccctacgttcgggtaccgtacccgacggtaccgtaggttcgagggtcggcgtagggtcgggtactacgggaaactaggtacgtttaccaccttacccgtacctaaccgtagttacccggaacgggtcccgggtacccttcgggtaaccgtaaggtttaccggttaagggtaaaacgttttcgtttttacgggaaccgttttaacgttttttaaccgttaccgtcggttaccggtaacgtaccgtttaaaggtttaacgttaaacggtttcgggtttaaccgggttttttacggggtttttaaaccttttcccgggttaaaccccgggtttttcccggggtaacccccggtttaaggggggtaaaaccccttaaaggggtttcggttaaaccgttttaaccggaaacgggttaacccggtaagggttttccgggacgggttacccgtttaccggaaaccccttaaccggtttggttttaccccgttacggttttcccctttaagtacccccgg

SEQ ID NO: 39270 - DNA, 563 bp, Homo sapiens
  misc_feature: GYAE6OF01B00X6.10.20.B09.1.454.CMB.1.raw
  modified_base (382)..(382): a, c, t, g, unknown or other
  misc_feature (382)..(382): n is a, c, g, or t
  modified_base (553)..(553): a, c, t, g, unknown or other
  misc_feature (553)..(553): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagcccaccctctcctgcagggccggtcagaatattgctaccaacttagcctggtatcaacaaaagcctggccaggcctccagactcctcatctctggtgcatccgttcgagggccacgtcggtcgtcccagccagggttcaggtggctaggtgggtctagggaacaggtagttcactctacaaccntcgagccggcctcgcagttctagtaagtatttgacttagtttattactgtacagtctagttattaagtgtaacgtttgggtttttaacttcgtaccgttttcggcccgttagggaccctaaaggtcgtatttcgagtacgtatggtggacctggacctacctattaccttntcttctaccg

SEQ ID NO: 39271 - DNA, 609 bp, Homo sapiens
  misc_feature: GYAE6OF01D6G7Y.10.20.B09.1.454.CMB.1.raw
  modified_base (194)..(194): a, c, t, g, unknown or other
  misc_feature (194)..(194): n is a, c, g, or t
  modified_base (285)..(285): a, c, t, g, unknown or other
  misc_feature (285)..(285): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcagggccggtcagaatattgctaccaacttagcctggtatacaacaaaagcctggccaggctcccagactccncatctctggtgcatcttcgacggccacgtggtcgtcccagccgagttcagtggcaggtgggtctggaacagtagttcactctcaccatcacgcggcctggctagtctagtaacgtattttggcttagtttacttacgtgttacgacgtactaagttaacttaagtacgttaccgtttaggggttttttaacttccgttaaccgtttttccgggacccgttaggggtaaccctaaaggtagggttaactttaccgaaggtaaccgttaacgttgggtcggcttaggccctaaccgtaattcctttacggttcctttccgtaaccc

SEQ ID NO: 39272 - DNA, 867 bp, Homo sapiens
  misc_feature: GYAE6OF01C3C5X.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctcgagggganagacgcccaccctctcctgcgacgggccgtcaagaatattgactaccaattgccttaggtaactacaaacaaaacgccgtggccaggcctacccagaccttcctcacttcctcgtggtcgctacgttcgttcggacggcctacgtggtcgtcccagtaccgtaggttcaggtcggtaccgtaggggttcgggtaccgttagggaaaacgtaggtaccggtttaccaccgtttcctaccgtaaccgtacgtacgaaccgggtccggtacccgtaggtaccgtaacggttaccgtaaggttaaacggtttacgtttttacggtacgttttaaacgtttttaacgtttacgttcggtaaccgtaaggttaaccgttaaaggttaaacgtttaaacgtttcggtttaaaccgggtttttttaacggggttttttaacctttacccggttttaacccgggtttttaccccggggtacccccggtttaaggggggtaaaacccctttaaaacgggggttttacggtaaaccgtttttaaccgggaaaaaccgggttaaccgggtttaaacgggtttacgggtttaacccggggtccgtttaaacccgggacccctttaaaccccggtttagttttcccggttttaaccgttacccggtttttaacccgttaacccccgg

SEQ ID NO: 39273 - DNA, 597 bp, Homo sapiens
  misc_feature: GYAE6OF01C7IRZ.10.20.B09.1.454.CMB.1.raw
  modified_base (433)..(433): a, c, t, g, unknown or other
  misc_feature (433)..(433): n is a, c, g, or t
  modified_base (572)..(572): a, c, t, g, unknown or other
  misc_feature (572)..(572): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgccaccctctcctgcgagggccggtcagaatattcgctaccaacttagcctggtatacaacaaaagcctggccacggctcccagacctcctcactctcgtggtgctatctcggacgggtccacggtggttcgtccccagacccgtaggttcaggtggcgtagggtgggtcgtagggaactaggtacgttcactctacaccatcgacggccggtcctgcagttctaggtaagttnttttgacgtttagtttattacgtgtcagtctaagttatagttgttacgtttggttttactctacgtttcgaccgtagggtaactaaggttcgtattcgaacggtaaccgtaagttcggtggaccttggacctaaccgtntttccgttcgttcttaccgtacccg

SEQ ID NO: 39274 - DNA, 652 bp, Homo sapiens
  misc_feature: GYAE6OF01DVWRH.10.20.B09.1.454.CMB.1.raw
  modified_base (224)..(224): a, c, t, g, unknown or other
  misc_feature (224)..(224): n is a, c, g, or t
  modified_base (308)..(308): a, c, t, g, unknown or other
  misc_feature (308)..(308): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagcccaccctctcctgcgagggccgtnagaatattcgcctaaccaacttacgcctggtatacaaacaaacgcctggccaggcctcccaagacctcctacatctcgtggtcnctatcgttacggacgggtccctacgtcggtcgtacccgagtcccgtaggttcaggttcggaccgtagggtgggtcctagggaaacctaggtacgtttccaccgttcctaccgaacccagtaccgacggaccggtcccgtacggccgtaacggttcgtaggtaagttacttttacggactttaaggttttacttacgtacgtcgagtccgaggtccgtacgtcccgtaccgtttcgggcggtacgggtcgtacccgtacggtttcgggacggtaacgggaacctaaaagtaggaacgtacgaaagtacgtggtacggctacggactaacgtattcgtgttctccg

SEQ ID NO: 39275 - DNA, 559 bp, Homo sapiens
  misc_feature: GYAE6OF01D9SMQ.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagcccaccctctcctgcagggccgtcagaatattgctaccaacttagcctggtatcaacaaaagcctggccaggcctcccagacctcctcatctctggtgcattcttcggaggccacgtggacgtcccagtcaggttcaggcggcggtgggtctggggacaggtacttcactctcacatcagcagcctgcagtctgaggtaccttggagtttatacgtgtcagctagttacactataaccgtcggtcccttcgggtacggtaccggttcggaccgtaagggaccgtaagggtcggtaaccctacgaaaccgtacgtggacggtctacggaccaccgtacttctgttccttctacgttccccg

SEQ ID NO: 39276 - DNA, 677 bp, Homo sapiens
  misc_feature: GYAE6OF01DEPLD.10.20.B09.1.454.CMB.1.raw
  modified_base (195)..(195): a, c, t, g, unknown or other
  misc_feature (195)..(195): n is a, c, g, or t
  modified_base (386)..(386): a, c, t, g, unknown or other
  misc_feature (386)..(386): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggganagacgccaccctctcctgcagggccgtcagaatattgctaccaattagcctggtatacaacaaaagcctggccaggcctcccagacctcctcactctcgtggtgcatcttcggacgggccacgtggtcgtcccagccgtaggttcagttggacgtaggttcgggtctagggaactaggtacgttcacttcnctaacctactcgacgccgggtacctggacctaggtactagtaaagttactttttgctttaagttttacttaccgttgtacgtaagtaccgtaagttaagttaagttacggttaacgtttttaggggttttttaacttccgtttaaccgttttcccggggcccgtttaggggtaaccctaaaagggtttcggtaaacgttttccgaaacggttaaaccggtacgtttagggttacggggtacttaccggtacctacccgtaagttcctttacggttcctttccgttaacccg

SEQ ID NO: 39277 - DNA, 829 bp, Homo sapiens
  misc_feature: GYAE6OF01BVWBH.10.20.B09.1.454.CMB.1.raw
  modified_base (639)..(639): a, c, t, g, unknown or other
  misc_feature (639)..(639): n is a, c, g, or t
tcagcatagtagtgcacgaccggtgctcgatttagtgtagtgtgaagggggaggaactgctcagttaggacccagacggaaccatggaagccccagcgcgagtcttctcttcctcgtgctactcgtcggcctaccagaacaacacgtgacgaagtaaattagttagacgacgacgtacgtcctacgacgaccctaccgttgtctgtcgttccacgggagggagacgaccgaccctccgtctccgtagacggacgggtccgtagaagtaattgtcgtacctaactaacgttcgcgttagtactaacaaaacgtaaccgtcgtccgacgacggtccctaccgacgtacctcctactacttcccgttggtcggtcacttcgttaccggtacgggaccgtacctaggttcggtccccgtaaccgaccggtaccggttacggttaacgacgggtcggtaaccggttggggtttaccgggtacgttaaaccgggaaacgttacgggtttaccttacccgtaccttaccgtaaccgtaacccgtgttaccggaccgggtccgtaccgttcgaaccgttacggttaacgttaaggttaacgtttaagtttccggaagtttttaacgttttacttacgttcgtaacgngttaacgtaagttaagttaacggttcggtttacggttttaaggttttccttacccgggttaccgttttacccgggacccggttaacggtaaaaccgttaagggttacgtttaccgtaacggtaacgtacgtttagtacgggttcacgtccggtaacctcgttattaccgtctttaacgttcccgttaccg

SEQ ID NO: 39278 - DNA, 601 bp, Homo sapiens
  misc_feature: GYAE6OF01D1409.10.20.B09.1.454.CMB.1.raw
  modified_base (195)..(195): a, c, t, g, unknown or other
  misc_feature (195)..(195): n is a, c, g, or t
  modified_base (303)..(303): a, c, t, g, unknown or other
  misc_feature (303)..(303): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcgaggggccgtcagaatattgctaccaacttgccttaggtatacaaacaaaagcctggccaggcctcccagacctcctcactctctggtncattcgttcggacgggccacgtggtctcccagccgaggttcgaggtcggcgtagggtcgggtacgtaggaactaggtacgttcactcgtaccacctatcaggcgacctgctagtctaggaattgttttagacgttagtttaactttcgtagttcagtcaagttataagttgtagtttcggttttattccgttacgtttccgggaccgttagggtaaccctaaaggttcggttaactttcggaacgtacgtaacgttggtcggcttacgacctacctacgttcttcgttcctctacccg

SEQ ID NO: 39279 - DNA, 663 bp, Homo sapiens
  misc_feature: GYAE6OF01B1DP5.10.20.B09.1.454.CMB.1.raw
  modified_base (228)..(228): a, c, t, g, unknown or other
  misc_feature (228)..(228): n is a, c, g, or t
  modified_base (465)..(465): a, c, t, g, unknown or other
  misc_feature (465)..(465): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctccgtgcgaggggcccgtnaagaattattgacctaccaacgttagcctaggtataccaaacaaagcctaggccaggcctacccagtacctcctcattcctcgtggtcgcctagttccgttcggacgggtccctacgttcggtcctccccgagcccgtaaggttcaggtcggccgtagggttcggggtctaggaactaggtacttccactctaccaccgtatcgacggtcgccctagcgtacgttcgtagtaagttnttttcgactttagttttacttacgtgttacgagtacttagtaactcgtaacgtttacccgtggtccccttaccggttacttaccggtttcgggggacccgggtaacctacggtccgtaaagggtaactacggaacggtacgttaacgttgggtacgtccgttacgtacccacgttaaccttcgttcgttccttacccg

SEQ ID NO: 39280 - DNA, 766 bp, Homo sapiens
  misc_feature: GYAE6OF01CYFN4.10.20.B09.1.454.CMB.1.raw
  modified_base (193)..(193): a, c, t, g, unknown or other
  misc_feature (193)..(193): n is a, c, g, or t
tcagcatagtagtgcacgaccggtgctcgatttagtgtagtgtgaaggggaggaactgctcagttaggacccagacggaaccatggaagcccagcgcagcttctcttcctcctgctactctggctcccagacaacactgcaagaaatagttatgacgcagtctccagccaccctgtctgtgtctcgagggganagacgcccaccctctccgtggcgacggggtccggtacaaggtaattacttcgaccttaaccaacgtttacgccgttaggtaactacaaaacaaaacgtccgtacggaccacggcctacccgaagtacctcctacatccgttcgtaggtcactacgttccgttacgggacgggtcctacggttcggtcgtaccccgaggtccgtaggttcacggtcggcgtagggtcgggtacgtagggaacaggtacgttaccacgttctaccgaaccgtagtccggaacggtcccggtctacggaccgtagtaccgttaaggtaaacgtttaggttttacgacttttaaggttttacttacgtcgtacgtagtacgtaagttaacgttaagttcggttaacgttttacgggtttttaacttaccgttaccgggtttcccgggtaccggttacggggtaaacccgttaagggtttacggttaaccgtttaacggaacggtaaccggtaacggtttcggtaaccggttccgtacggtaacctaccggttaacgtttccgttacggtttaccttccgttaacccg

SEQ ID NO: 39281 - DNA, 758 bp, Homo sapiens
  misc_feature: GYAE6OF01AMC68.10.20.B09.1.454.CMB.1.raw
  modified_base (227)..(227): a, c, t, g, unknown or other
  misc_feature (227)..(227): n is a, c, g, or t
  modified_base (324)..(324): a, c, t, g, unknown or other
  misc_feature (324)..(324): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctcctgcgacgggccggtnagaatagttgacctacctaacgttacgcctggtactacaaaacgaaaacgccgtcggaccgacggcctacccgagtacctcctctactctcgtggtnctacttcgtcggacggtcctacgttcgggtcgtccccgacggtccctagggttccagggtcggacggtagggttcggggtacgtacgggaaaccgtaggtacgttcctacttcctaccacctactaccgacgggtccggtcccgtggaccgtacgttcgttagtaaacggtttacgttttacggactttaacgtttttaactttacgttcgtaccgtaacgtcgttaagttaagttaacgttaggtttaaccgttttacgggttttttaacttccgtttaaccggttttccggtaacccggttacgggtaaacccttaaagggttcgggtttaactttaacgggaacgttaaccggtaacgtttcgggttacggacgtttaccggaacccgttaccgtaacgtttccggtaacttttcccgttacgttaccccg

SEQ ID NO: 39282 - DNA, 510 bp, Homo sapiens
  misc_feature: GYAE6OF01EC6TA.10.20.B09.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (295)..(295): a, c, t, g, unknown or other
  misc_feature (295)..(295): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccgtnagaatattgctaccaacttagcctggtatcaaacaaaagcctggccaggctccagacctcctcatctctggtnctatcgttcggaggccacgtggtctcccagccaggttcagtggcaggtggtctaggaacagtagttcactctcaccatcagcggcctgcagtctagaagtatttgacttagtttactactgtcagtctagtataatgtagttggtttatcgtactttcggcctagggaacctaagtgtattgagtacgtatggtgctgctactatctgtctgtac

SEQ ID NO: 39283 - DNA, 527 bp, Homo sapiens
  misc_feature: GYAE6OF01B9899.10.20.B09.1.454.CMB.1.raw
  modified_base (519)..(519): a, c, t, g, unknown or other
  misc_feature (519)..(519): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatacaacaaaagcctggccaggcctcccagactcctcatctctggtgctatcgttcggagggccacgtggtcgcccagccaggttcagtggcaggtgggtctggaacagagttcacttctcaccatcgagccggcctgctagtctaggaagttatttcgacttagttttacttacgtgtcagctagtatagtgtacgtttggtttactctacgttcggcctaggaacctaaggtgtattacgagtacgtagtgtgctgactactattctntcttcgtc

SEQ ID NO: 39284 - DNA, 568 bp, Homo sapiens
  misc_feature: GYAE6OF01A6NS8.10.20.B09.1.454.CMB.1.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcagggccgtcagaatattgctaccaacttgcctggtatcaacaaaagcctggccaggctcccagactcctcatctctggtgctatcgttcggagggcctacgtggtcgtccccgagcccgtagggttcaggttggcgaggttcggggtctagggaaacagtaccttcactcctacaccatcagcacgcctagacgcctagaagtatttgactagtttattactgtacagcgagtccgtgccgtacgtttcggcgggtaggtcgtccgtacgtttccgggacgggtacgggaacctaaaagtaggaacggtaccaaacggtacgtggtggctcgacctacctatcttgttcctacg

SEQ ID NO: 39285 - DNA, 521 bp, Homo sapiens
  misc_feature: GYAE6OF01A36MY.10.20.B09.1.454.CMB.1.raw
  modified_base (195)..(195): a, c, t, g, unknown or other
  misc_feature (195)..(195): n is a, c, g, or t
  modified_base (385)..(385): a, c, t, g, unknown or other
  misc_feature (385)..(385): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccgtcagaatattgctaccaacttagcctggtatcaacaaaagcctggccaggctcccagactcctcatctctggtgcatcttcgagggccactggtctcccagccaggttcagtgcagtggtctggaacagagttcactctcaccatcagcgctgcagtctgaagtnttttgacttagtttattactgtcagctagtaataatgtacttgggttttactctacgtttcggccttagggaacctaaggtgtatttacgagtacgtaagtggtcggctgacctacctattcctcttcgttctacg

SEQ ID NO: 39286 - DNA, 538 bp, Homo sapiens
  misc_feature: GYAE6OF01BCZL8.10.20.B09.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
  modified_base (506)..(506): a, c, t, g, unknown or other
  misc_feature (506)..(506): n is a, c, g, or t
  modified_base (535)..(535): a, c, t, g, unknown or other
  misc_feature (535)..(535): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcaggggccgtnagaatattgctaccaacttagcctggtatcaacaaaagcctggccaggcctcccagacctcctcactctctggtgcatcgttcggaggccacgtggtcgtccccagccaggttcaggtcggcaggtgggtcgtggaacngtagttcactctcacntcagcgctgctagtctagaagtntttgacttagtttattacgtgtcagtctaagttatatgtacgttgggttttactccgttacgtttcggacctagggaacctaaggtgtattcgaagtacgtatgnggtactgactacctgttactcgttccttntac

SEQ ID NO: 39287 - DNA, 845 bp, Homo sapiens
  misc_feature: GYAE6OF01A5KJV.10.20.B09.1.454.CMB.1.raw
  modified_base (235)..(235): a, c, t, g, unknown or other
  misc_feature (235)..(235): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccaccctgtctgtgtctcgaggggagagacgcccaccctctcctgcgacgggccggtcaagtaatnttcgacctaacctaacgttacgccttaggtaactacaaaacgaaaacgtccgtacgggaccaacggtccctacccgaagtaccctcccttactacttccttacgtgggtcgtacctacgttccggttaccgggacgggtaccctacggttcgggttccgtaccccgacggtccgtagggtttcgagggttacgggccgtaggggtttcggggttaccgtagggaaacgtaggttaacgttccgtaccttaccgtaccaaccgtagtaccgaccgggcggtcccgtaggccgtaacggttcgttaaaggtaaagtttacgttttacggaaccgttttaagtttttaacgttaccgttcgtaaccgtaggttaacgtaagtttaaactaaggtttcggtttaacgtttttacgggtttttacgttacccgtttaccgggttttacccgggtaaccccggttaagggttaaacccgttaaaagggttccgttaaacgtttacccggaaacggttaacccgggttaaggttcgggtttaacgggaccgtttaccggaacccgttaacccggttactttaccgtttaccggtttccttttaacccggttaccccg

SEQ ID NO: 39288 - DNA, 738 bp, Homo sapiens
  misc_feature: GYAE6OF01BDVV6.10.20.B09.1.454.CMB.1.raw
  modified_base (196)..(196): a, c, t, g, unknown or other
  misc_feature (196)..(196): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccacctgtctgtcgtctccgagggganacgacgcccaccctctccgtaggccgacggggccgttacaaggtaatttagttcgaccttaaccctaacgtttacggcccgttaggtaaacttaccgaaaaccaaaacggtccgtacggacccgtaacgggtccctacccgaacgtacccttccctacctacgttccgttcgtggtccgtacctacgtttcccggttacggaccgggtccctacggttcgggtcccgtaccccgaacggtccggtacggtccgtaggtcggtccgtaggggtcggtaccgtagggaactcggtacgttaccacgttcctactaccgtacgtccgtacggccgtccgtagccgtaggttccgtagtaacgtttctttacgtacgtttaacgttttactacgttgtaaccgtagtacttaagttacgtagtagtttacggttttagtttactccgttaccgttggacccgtaggaactaggtgttacgttacgaacgggtacgtagtcggtcgtctacgtaccgtactacgttcgttacttccgttactccccg

SEQ ID NO: 39289 - DNA, 737 bp, Homo sapiens
  misc_feature: GYAE6OF01BK2ZQ.10.20.B09.1.454.CMB.1.raw
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagcccaccctgtctgtcgtcctaccgagggganagacgcccaccctctccgtggcgacgggccgtacaagtaatnttcgacctaaccaacgttcgcctaggtaactaccaaaacgaaacgtccgtacggaccacggccctacccgacgtacctccgtactactcctcgtcggtcgctacgttccgtacggacgggtaccctacggttcggtccgtccgacgtccgtaggttcgacggtcggacgtagggttcggtacgtaacggaactaggtacgttccaccgttcctaccgaacctacgtaccggacggtcccggtctacggacttacgtacgtaagttaaggtttactttacgtatttaacggttttacttacgtcgtacgtaaggtactaagttactaacgttggttaaccgttttggtttaactccgttaccggtttccggaccgttaacggtaacttaacgggttcgttaaccgtttaccggaacggttaaccgtagggttcggttaccggtaccgtacgttaaccgtaaccttcgtttaagttccgtttaccttcgttaccccg

SEQ ID NO: 39290 - DNA, 812 bp, Homo sapiens
  misc_feature: GYAE6OF01BKLZS.10.20.B09.1.454.CMB.1.raw
  modified_base (226)..(226): a, c, t, g, unknown or other
  misc_feature (226)..(226): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctcctgcgaggggccgtnagaatatgctaccaacttagcctggtatcaacaaagcctggccaggcctcccagacctcctcattctcgtggtcgctactcgttcggacgggtcccacgtggtcgtaccccgagtccgtaggttcgaggtggcgtagggtcgggtacgtagggaacgaggtacgttacactcgtccacctattccgacggcccggtacctcggactacggttaccgtaggtaaagtttagtttttacggaccgtttaagttttttaacgttaccgtttacgggttacctaacgggttaccgttaaaggtttaacgtttaaacggtttcgggtttaaaccgggttttttagggggtttttttttaaaccttttaccccggttttaaacccgggttttttccccgggggtaacccccggttttaacggggggtaaaaaccccgtttaaaggggtttaacggggtttaacctttttaacccggaaacggggttaaaccccggttaaacggtttcggggttaccgggtacccttaacgggaccccttaaacccgttacggtttacccctttcgggttttacccctttacgttaacccccg

SEQ ID NO: 39291 - DNA, 853 bp, Homo sapiens
  misc_feature: GYAE6OF01DDOZ8.10.20.B09.1.454.CMB.1.raw
  modified_base (199)..(199): a, c, t, g, unknown or other
  misc_feature (199)..(199): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggcctcccagacaacactgcaagaaatagttatgacgcagtctccacgccctaccctgtctgtgtcctcgagggganagacgccacctctcctgcgagggccggtacaagaattattgactaaccaacgttagccgtaggtatacaaaacaaacgcctaggaccacggtcctacccagtacctcctacattccgtcgttggtcactaacgttcgttaccggaacgggtccctaacggttcgggtacccgttaccccgaacggtaccggtaacgggttttaccgaacgggggttacgggaccgtaagggggttccggggttaaccgtaacgggtaaaacgtacgggtaaccgttttcccgaaaccgtttcccgtaaacctaacccgtaaacggttcccggaacggggtccccgggtccctttaacgggcccgttaaggtttccgttaaacgggttaaaaggttttaccgttttttacggaacccgtttttaaaggtttttaaccgtttaaccgttacgtaaccgttaaggtaacgttaaaggtttaacgttaaacggttttaacgttaaccggggtttttaaggtttttaaccttacccggtttaaccggttttccgggtaccccggttaaggggtaaacccttaaagggtcgttaacgtttaacgaacggtaacgtacgttgggtacgtcgtacgtaaccgtactattccgttacgttccttcccgtaccg

SEQ ID NO: 39292 - DNA, 642 bp, Homo sapiens
  misc_feature: GYAE6OF01DLQWV.10.20.B09.1.454.CMB.1.raw
  modified_base (238)..(238): a, c, t, g, unknown or other
  misc_feature (238)..(238): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgacaagaaatagttatgacgcagtctccagccaccctgtctgtgtctccgaggggagagacgcccaccctcctctgcgagggccggtacaagaatatcnctaaccaattagcctaggtaactacaaacaaaacgccgtaggaccaacggtcctacccagaacctcctacatctcgtggtcgctatcgttcggacgggtctacgtggtcgtaccgagccgtaggttcaggtggcgaggtcgggtcgtaggaactagtagttcactctaccaacctatcgacggtccggtcctgacgagttacgtaggtaagttaattttgactttaggttttattaaccgtgtacgagtctaaggttacttaagtcgttacggtttaggtttttactcttacgtttccggaccgttagggaacctaaggttggtactttacgaacgtaaaccggtaattgggtacgtaccgtcggtaaccctactaagtttcccgtagttccctttctaacccg

SEQ ID NO: 39293 - DNA, 695 bp, Homo sapiens
  misc_feature: GYAE6OF01BE7SQ.10.20.B09.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (317)..(317): a, c, t, g, unknown or other
  misc_feature (317)..(317): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcagaaatagttatgacgcagtctccagcccaccctgtctgtgtctccgagggganagacgcccaccctctcctgcgaggggccgtanagaatattgacctaacaacttacgcctaggtactacaaacaaagcctaggaccaggcctccgagtacctcctcattctcgtagggtcnctacgtccgttacggacggtcctacgttcggtcgtccccgagtcccgtaggttcgaggttcggatagggtcgggtctagggaacgtaggtacgttctacgtcctaccaacctagttaccgacgggccggtaccctggaccgtaggttaccgttaaggtaaagtttacgtttttacgaccgtttaaggttttacttaacgttggtaaccagtaccgttaagttaataagttcgtaacggtttttgggttttaaccttcggtaaccgttttccgggacccgttagggaacccttaaagggttcgttaacgtttaccgaggtaaccggtagttggcggtccttacgaccttacgtacgttcttacgtttccttcgtacccg

SEQ ID NO: 39294 - DNA, 834 bp, Homo sapiens
  misc_feature: GYAE6OF01BPR2Z.10.20.B09.1.454.CMB.1.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcgacggggccggtcaagaacttattcgacctaacctaaactttacggcccttagggtaactaccaaaaacgaaaaacggtcccgtagggacccctaacgggtccctaccccgaaagtacccttcccctacctacgttccttccggttagggtacgtcctaacgttccggtttacgggaaccggggtccctacggttcgggtcccggttaccccgaacggtcccgttaagggttccgaagggtcggaccgtaggggttcggggtaccgtaagggaaacctaggttaacgttaccgtaccttacctaccgaaaccctacgttaccggaaccgggtcccggacccttacggaccgttacggttaccgttaaggtaaaagttttacgtttttcgggaaccttttaagttttttaacgttaccgttacggtttaccaagggttaaccttaaagggtttaacttaaaggtttcggttaacggtttttagggtttttactacccgtttaccggttttaccgggacccgttagggtaaacccgtaaggttcgtaacgtttcgaacggtacgttagtcgggtacgtaccgtacgtacccgtacttacgttccttcgttccttcgtacccg

SEQ ID NO: 39295 - DNA, 696 bp, Homo sapiens
  misc_feature: GYAE6OF01A85XM.10.20.B09.1.454.CMB.1.raw
  modified_base (197)..(197): a, c, t, g, unknown or other
  misc_feature (197)..(197): n is a, c, g, or t
  modified_base (327)..(327): a, c, t, g, unknown or other
  misc_feature (327)..(327): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtcctccgagggganagacgcccaccctcgtcctgcgacgggccggtcaagaattattcgacctaaccaactttacgccttaggtaactacaaacaaaacgcctcggaccaggcctacccgagtacctcctcactctcgtggtcnctacttcgttcggacggtccacgttcggtctcccgagtccgtaggttccgaggttcggacgtagggttcgggtacgtagggaaacctaggtacgttaccaaccgttcttaccaaccgtataccggaacggcccggtacctggaccgtacggttcgtaacggtaagtttacgttttcgaccgtttaagtttttaactaccgttgttacgaagtcttaagttaagttaagttcgtttaacgttttgggttttacttccggttaccggttttcccggacgtacgggtaaactaagggttagtactttacgacgtaacgttacgttgggtacgtccgttagaccgtactactttacgtctttcctcgttaccg

SEQ ID NO: 39296 - DNA, 761 bp, Homo sapiens
  misc_feature: GYAE6OF01DGTSY.10.20.B09.1.454.CMB.1.raw
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtcctccagccaccctgtctgtgtctccgagggganagacgcccaccctctcctgccgaggggcccgtnaagaatatgactaccaacttgcctggtaatacaacaaaacgcctaggccgaggcctcccaacgtacctcctcactctcgtcggtgctaatccgttaccgggacgggtacccacgtcggttcgtaccccgagacccgtacggttcgtaaggtcggtacgtaggggtttccggtacgtacgggtaaacgtacggtacttaccgacttacctaccctaacgtacgtaccgtacgggtaccgtcccgttggaccgttagtacgtacggttaaacgttttagttttacggactttaagttttcgttaaccgttcggacctaggtaccgttaagtaacgttaagttaccggtttacgggtttacgggtttttacttccggttaaccggtttcccgggttaacccgttacgggtaaaccgttaaaggttcggttaaaccgttaccaacgggtaaaccgttaacgggtttacggtagggtaccttaccggaaccttaccttaacgtttcccggttacgtttccgtttacccgttaacccg

SEQ ID NO: 39297 - DNA, 696 bp, Homo sapiens
  misc_feature: GYAE6OF01EH4CZ.10.20.B09.1.454.CMB.1.raw
  modified_base (197)..(197): a, c, t, g, unknown or other
  misc_feature (197)..(197): n is a, c, g, or t
  modified_base (500)..(500): a, c, t, g, unknown or other
  misc_feature (500)..(500): n is a, c, g, or t
  modified_base (688)..(688): a, c, t, g, unknown or other
  misc_feature (688)..(688): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtcgtctccgaggggganagacgcccacccctctccgtgccgacggggccggttacaagtaaattatttcggcctaacctaacgtttagtcccgttaggtaactaccaaaaccaaaacgccgtacggacccacgggccctacccgaacgtaccttcccgtcacttcctcgttgggtcgcctagttcccgttcgggaacgggccctacgttgggtccttcccgagtccgtaggttcgaggtcggctagggtcgggtctaacggaactaggtacgtcacgtctaccactatccgaggccgtctgcagttacgtagtaaagttnttttgaccgttagtttttactactgtacagctaagttagtaactggtttaacgtttaggttttacttccgttaaccggtttccggtacccgttagggtaacctaagggtttcgtagtttaaccacgggttaaccgtagttcgggtacgtccgttacgaccttaaccgtgttcccttagttcccgtttntaaccccg

SEQ ID NO: 39298 - DNA, 828 bp, Homo sapiens
  misc_feature: GYAE6OF01A7NFE.10.20.B09.1.454.CMB.1.raw
  modified_base (193)..(193): a, c, t, g, unknown or other
  misc_feature (193)..(193): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccacctgtctgtgtctccgagggganagacgcccacccgttctccgtgccgaggggtcccggtacaaggaaacttagttcgaccttaacccaaacgtttacgccgtttagggtaactacaaaccgaaaacgtccgtaggaccctagggaccctacccgacgtacctccgttaccattccgttcgttacggttacgttacttccgttacggacgggtacctacgtcggttccgtacccgtaggcccgttagggttcgaacggttcggtacgtagggttgggtaccgtaggaaccgtagtacgttcgtacctcgtacctaccgtacgtacgacggtccggtccttcggacgtacgttacgttacggtaaacggtttacgttttacggaacgtttaagttttaaccgtttaacgttcggttaacgtacggttaaccgtaaggtttaactttaacgttacggtttaccggtttttaacgggttttacgtttaccgttaccggttttacccgggtaccgttaacgggggtaaaccgtaaagggtttcggttaacgtttaccggtaaccggtaacggttaacgtttcgggtaacggttccgttaccgggaaccttaccggttacgttaccgtttacggttaccctttaccggtacgtttacccccgg

SEQ ID NO: 39299 - DNA, 640 bp, Homo sapiens
  misc_feature: GYAE6OF01AKGC4.10.20.B09.1.454.CMB.1.raw
  modified_base (337)..(337): a, c, t, g, unknown or other
  misc_feature (337)..(337): n is a, c, g, or t
  modified_base (626)..(626): a, c, t, g, unknown or other
  misc_feature (626)..(626): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccaccctgtctgtgtctccgaggggagagacgcccaccctctcccgtgccgacggggccggtacagtaatattcgacctaacctaacttacggccttaggtactacaaaaccaaaacgtccgtagggaccaggccctacccgagacctcctactacttctcgtggtcnctacttccgtcggacggtcctacgttggtccgtcccagccgtaggttcgaggtcggcgtaggtcgggtctaggaactaggtacgttcctactctaccactacgtcgacggccggcctagcgtacgtcttaggtaactttgtttacgactttaagttttactacgtcgtactagtacgtaagtagtaacgttgtacggttttaggtttactcgttaccggttcgaccgttagaccgtaaggtgttactacgaggtaccgtagttggcgtactgtaccctactcttacgtnttccgtcgtacccg

SEQ ID NO: 39300 - DNA, 729 bp, Homo sapiens
  misc_feature: GYAE6OF01C3L8F.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctctgctactctggctcccagacaacactgcagaaatagttatgacgcagtctccagcccacctgtctgtgtctccgagggganagacgcccaccctctccgtggacgacggggtccggtacagtaaatagttcgactaacctaaacttcgccgtaggtaactacgaaaacaaaacgccgtaggccgaacggtcctaccgacgtacctccctactattccgtcgtggtcgctacgttccttacgggacggcctacgttcggtacgtcccagccgtaggtcgaggtcggacgtaggggttcggtcgtaggaacgtacggtacgttcgtaactccctaccgacctactacggacggtcggacccttggcctagtacgtagtaaagtttctttggactttatttaacttcgtgtacagtaacgtagttaaacttaggttcggtttaacggttttacggttttaacttacgtacccggttttcgggtaacccgttacggggtaaaccttaaacggggtttgttaaaccgtttaccggtaacgggtaaaccgttaggttcgggttacggtaaccgtttcgaacccttaaccgttgttttaccgtcgtttccgttaccgttaccg

SEQ ID NO: 39301 - DNA, 669 bp, Homo sapiens
  misc_feature: GYAE6OF01BU6TV.10.20.B09.1.454.CMB.1.raw
  modified_base (193)..(193): a, c, t, g, unknown or other
  misc_feature (193)..(193): n is a, c, g, or t
  modified_base (654)..(654): a, c, t, g, unknown or other
  misc_feature (654)..(654): n is a, c, g, or t
  modified_base (660)..(660): a, c, t, g, unknown or other
  misc_feature (660)..(660): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctcgagggganagacgccaccctctcctgcgacggggccgtcagaatattcgcctaaccaacttagcctaggtaactaccaaaacgaaaaacggtccgtaggacccgaacgggccctacccgaacggtaacccttccctactaacttccctcgtttcgggtcgtacctaacgtttccgttaccgggacggggtccctaacggttcgggttccgtaccccaggtccgtagggttcgaggtcggcgtagggtcggggtctacggaacgaggtacgttacgaccttcgtactaccgacgtcgacgggccggccttagacgtacgttacgtaaggtaagttagttttcgactttaagttttacttacgtgtacaggtactagttaattaatggtaactttggtttactacgttacgtttccggaccgtaggaacctaaggtcgttacttacgagacgtagttggtgcctgctactntcgttnttctctacg

SEQ ID NO: 39302 - DNA, 530 bp, Homo sapiens
  misc_feature: GYAE6OF01A0IW9.10.20.B09.1.454.CMB.1.raw
  modified_base (221)..(221): a, c, t, g, unknown or other
  misc_feature (221)..(221): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggcccgtnagaatattgctaccaacttagcctggtatcaacaaagcctggccaggctccagactcctcatctctggtgcatcttcgagggccactggtcgtcccagccaggttcagtggcagtgggtctggaacagagttcactctcaccatcagcgcngcagtctagaactatttgctagtttattctgtcagntagtattagacttaccgtggcccttacgtaccgtacgttttcggggacccggggactaaggtcgtaggtaaatcgaagcgtaagtcggtggcctcggtaccaccgtatcgtcgttccttacg

SEQ ID NO: 39303 - DNA, 740 bp, Homo sapiens
  misc_feature: GYAE6OF01CE2MX.10.20.B09.1.454.CMB.1.raw
  modified_base (197)..(197): a, c, t, g, unknown or other
  misc_feature (197)..(197): n is a, c, g, or t
  modified_base (320)..(320): a, c, t, g, unknown or other
  misc_feature (320)..(320): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagcccaccctgtctgtcgtctcgagggganagacgccaccctctcctgcgaggggccgtcagtaatacttcgacctaaccaacgttagccttaggtataccaaaacaaaacgcctggaccaggcctacccagacctcctcacttctcgtggtncagttccgttcggacgggtcctacgtgggtcgtaccccgacgtcgtacggtcgaggtcgacgtaggtcgggtacgtaaggaacgtacggtacgttaccgtacttaccgtacctaacgtacgtaccgtacgggacccggtcgttacgaccgttacgttacgtaacggttaaacgttttcgtttagacgttttaagttttaacttacgtacggttacgacgttacgtaaagttaacgttaacgttcgtttaacggggttttttaacgttttaccgtttaccggtttaccggttttcccgggacccggttaacggggtaaaaccgttaagggtttcgtaaacgttacgtaacggtaaccgtaacggtttgggcgttaaccgtagtaccctagttacgttcgttaccttcgttaccgttacccg

SEQ ID NO: 39304 - DNA, 818 bp, Homo sapiens
  misc_feature: GYAE6OF01EDS2R.10.20.B09.1.454.CMB.1.raw
  modified_base (233)..(233): a, c, t, g, unknown or other
  misc_feature (233)..(233): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcaagaaatagttatgacgcagtctccacgcctaccctgtctgtgtctccgaggggagagacgcccaccctctccgtggcgacgggccgtanaagtaattgttcgacctaactaacgttacgcctaggttaacaacaaacgaaacgccgtacggaccacggcctaccgacgtaccttccgtactacttccgttacggtcggtcgacctacgttccgtaccgggacggtccctacgttcggtaccgtacccgacgtaccggtaggttccgacgggtcggtacgtagggtcgggtacgtacgggaaactaggtacgttacctaccgttaccctaccgtaaccctggtacccggacgggtcccggtaccgttacggtaccgtaaggttaccgttaagttaaaacggtttcttttacggaaccgtttttaagttttaacgttcgtacgttacgtaacggttaacgttaaagtttaacttaacggttttaccgggtttaagttttcggggtttttaacctttaccggtttacccgggtttacccggtacccggttaagggtaaaaccgttggtttaccgggtttaaactaccggtaggtaaaccggttagttacgggttccggtacgttaacccggtacttacccggttacttttccgttattaccccgtttcttaccccgg

SEQ ID NO: 39305 - DNA, 779 bp, Homo sapiens
  misc_feature: GYAE6OF01DMV4I.10.20.B09.1.454.CMB.1.raw
  modified_base (196)..(196): a, c, t, g, unknown or other
  misc_feature (196)..(196): n is a, c, g, or t
tcagcatagtagtgcacgaccggtgctcgatttagtgtagtgtgaagggggaggaactgctcagttaggacccagacggaaccatggaacgccccagcgcagcttctcttcctcctgctactctggctcccagacaacactgacagaaatagttatgacgcagtctccagccaccctgtctgtgtctccgaggganagacgcccaccctctcctgcgacggggccgtacaagtaattattcgacctaacctaagttacgccgtaggtactaaccgaaaacgaaaacgtccgtacggtacccgaacggtaccctacccgtagtaccctaccttaccactttccgttacgtacggtcgaccgtacgtttccggttaccggaccgggtccctaacggtttccggtaccggtaccccgtacggtaccccggtaggttttaccgagggttcggtacggttaacgggttcgggttaccgtacgggaaacgtacggtaaccgtttaccaccgtttacctaccgaaacctaacgtaccgaacggtcccgggtacctcggtaaccgttagttaccgtaaggtaagtttacgttttcgaccgtttaagttttactaccttgactagtctaagttactaagttcgttacgtttagtttactccgttacgttcccgggaccgttagggtaaacctaaggttcgtacgtttacgaaccgtaacggttaacgtcggttacgtccgttacgaaccgtaccgttacgttccgttaacgttccgttccttaacccg

SEQ ID NO: 39306 - DNA, 702 bp, Homo sapiens
  misc_feature: GYAE6OF01B1D1B.10.20.B09.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtcctccgagggganagacgcccacccttctccgtgccgacggggcccggtanaagaattagttcgaccttaaccgaactttagccttaggtaactacaaacaaaagcctggaccaggcctccagacctcctcatctcgtggtgctatcgttggacgggtccacgttcgggtctcccgagtccgtaaggtttcaggtcggcgtagggtgggtcgtagggaacctagtacgttcactcgtacaccgactccgaccgtctacgaccctgaacgttatttcgacttagtttacttacgtcgtacgagtcgacgtacgtacgcgtaacggtccgtccggtcccccttaccgttaccccgtttaccgttaccggttttacccggggaccgggaacggggtaaccccgtaaagggggttacggtaaacgtaaaccgttaaccgtaaaaccggtaacggtttcgggtacggccgttaacgaccccgtaaccttaccgttccgttacgttaaccctttcgtacccccg

SEQ ID NO: 39307 - DNA, 715 bp, Homo sapiens
  misc_feature: GYAE6OF01A4INC.10.20.B09.1.454.CMB.1.raw
  modified_base (140)..(140): a, c, t, g, unknown or other
  misc_feature (140)..(140): n is a, c, g, or t
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
  modified_base (691)..(691): a, c, t, g, unknown or other
  misc_feature (691)..(691): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacacngcagaaatagttatgacgcagtcctccagcccaccgtgtctgtgtctcgagggganagacgcccaccctcctccgtgacgacggggccgtanaagtaattattcgacctaacctaacgttacgaccttaggtaactacaaaacgaaacggtccgtacggaccgacggccctaccgacgaccttcctacattccgtcgtcggtcgtcctacgttccgttcggacgggtacctaggttccgggtctacccgacggtccgtaggttcagggtcggacgtagggttcggggtactaggaacgtaggttcgttacctactcctaccgaaccgtctaccgacggtccggtcttcgacgtacggttacgtaagtaagtttagtttacggtactttaacgttttactacgtacgtacgaacttcgtaaagtttaaacttagtttacggtttaaggttttacggtttacttcgtaccggtttccggaccggttaacggtaacgttacgttaggttccttaaggacggtacgtaggttggtcgtacgtacgacgtaacctntttccgtgtttccctaagttcccg

SEQ ID NO: 39308 - DNA, 775 bp, Homo sapiens
  misc_feature: GYAE6OF01DZOKA.10.20.B09.1.454.CMB.1.raw
  modified_base (743)..(743): a, c, t, g, unknown or other
  misc_feature (743)..(743): n is a, c, g, or t
  modified_base (755)..(755): a, c, t, g, unknown or other
  misc_feature (755)..(755): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtcctccagcccaccctgtctgtcgtctccgaggggagagacgcccaccctctcctggccgacggggcccgtacaagtaattagttcgacctaacctaacgttcgccttaggtaactacaaaacaaagccgtaggcccaggcctaccgacgaccttcctctacttcctcgtggtcgctacgtccgttacggacggcccagttgtaccgccagccgtaggttcaggtcggacgtacggttcggggtacgtagggaaactggttacgttaccaccgttcctaacaacccgtaacttccggtaacggcccggttccttacggaccttagttacggttagtaaacgtttcgtttttgaccgttttaagtttttaccgttacgttcggttaccgaggttaacgtaagttttaaagtaacggttacggtttaacgggttttttcggtttttaactacccggttttaaccgttttccccggggtaaccgttaccggggttaaaaccgtaagggtttacggttaaccgttttaccggaaaaccgtacgttaaggttcgggtacggttccctaacggtacccttaaaccgttnttttacccggtntttccccttcgtttaccccg

SEQ ID NO: 39309 - DNA, 815 bp, Homo sapiens
  misc_feature: GYAE6OF01BZ09L.10.20.B09.1.454.CMB.1.raw
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
  modified_base (799)..(799): a, c, t, g, unknown or other
  misc_feature (799)..(799): n is a, c, g, or t
tcagcatagtagtgcacgaccggtgctcgatttagtgtagtgtgaagggggaggaactgctcagttaggacccagacggaaccatggaagtcccagcgcagcttctcttcctcctgctactctggctcccagacaacactgcagaaatgttatgacgcagtctccagcccaccctgtctgtgtctccgagggganagacgcccaccctctcctgcgacgggccgtanaagtaatattcgacctaacctaacgttcgccgttaggtaactaccaaaacgtaaaacggcccgttacgggaccctacggtacccttaccccaaggtacccttaccctacctaacgttccgttcgttacgggtcgccttaacgtttccgttaccgggaaccggggcccttaaccggttcgggttcccgtaccccgtacggtaccccggttagggttcccgaaggggttccggacgttagggggttcggggttaaccgtacggggaaaacgtacgggttaccggtttaccggaccctttccgtaacccgtaacctacgtacgtacggtacgtaacggttcctgggaccgttagttccggtaagtaacgttttacgtttgtaacgttttaagtttattaccgttgtaacgtaagttaacgttggttagtacggttacggtccgttacgggttacccttacggttaaccgtttggttaaccgggaacccgttaaacggggtaccttaaagggttaaccggaacctaacggttaaccaaacggttcggtaggtccgtacctacggacctaaccgttnttaccgtcgtttaccg

SEQ ID NO: 39310 - DNA, 915 bp, Homo sapiens
  misc_feature: GYAE6OF01AU5W7.10.20.B09.1.454.CMB.1.raw
tcagcatagtagtgcacgaccggtgctcgatttagtgtagtgtgaaggggaggaactgctcagttaggacccagacggaaccatggaagcccagcgcagcttctcttcctcctgctactctggctcccagacaacactgcagaaatagttatgacgcagtctccagccaccctgtctgtgtcctccgaggggagagacgcccaccctctcctgcgacggggccggtacagtaatacttcgactaacctaacttacgccgttaggttaactacaaaaccgtaaaacgccgtacggaccgaacggccctacccgaacgtaccttaccctctacttcccttaccgttcgggtactaccgtaacgttccgtttacccgggaccgggtaccctacggtttacgggtccggttaacccccgtaacgggtaccccggttaacgggtttaccgtaacggggttaccggacggtttaacggggttacgggggtttacccgtaaggggtaaaccgtaacgggttaacgtttacccaacccgtttccgttaaccccgtaaacctaacgtaccgtaaccggggtcccggtaccccgttcgggtaccggtaacggtttcccggttaaggtaaaacggttttacggtttttagaccttttaacgggtttttacttaaccggttgtaccgtacggtaacgttaacgtttaataacggtttaacgttacgggtttttaacggttttacgttaccgtttacccggtttcggggaaccccggtttacgggtaaaaccggttaaaggggtttccgttaaacggttttaccggaacggttaaacccggtttaaggtccggggtttccgggtaacttacccgggaccttaaaccggttcgtttacccggttttccgtttacgtttcccgtaacccg

SEQ ID NO: 39311 - DNA, 763 bp, Homo sapiens
  misc_feature: GYAE6OF01A4MOO.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccgaggggagagacgcccacctctcctgcgacgggccgtacagtaattacgttcgactaccaactttcgccgtaggtactacaaacgaaacgtccgtacggccacggcctacccgaagtaccttcctactacttccgttcgtacggtcgaccttacgttaccgttccgggacgggtccctaacggttcgggtccgtaccccgacgtaccggtagggttacagggtcggtcgtagggttcggggtactagggaactacggtacgttaccaccgttacctaccaaccgtactaccggacgggtccggtaccgttgtaccgtacgttcgttaaggtaacgtttacgttttacggacgttttaacgttttacgtttaacgtcgtaaccgagtacttaaggttaacttagtaccggtttagttttacgggtttttaactcccgtttaccggtttaccggtacccggtttaagggaaacccgttaagggttacgtttacgttaaccggtaacgtaccggtagttacgggtcggtccttaacgccgttaacccgttagtttacccgtcgtttcctttaactccccg

SEQ ID NO: 39312 - DNA, 787 bp, Homo sapiens
  misc_feature: GYAE6OF01D2NW2.10.20.B09.1.454.CMB.1.raw
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccacctctcctgcgagggccgtcagaatntgctaccaacttgcctaggtatacaacaaaacgcctaggccaggcctcccagactcctcacttctcgtggtacgtcctacgttccgttcggacgggccctacgttgggtccgtaccccgagtcccgtagggttaccgaggtcggaccgtagggttcgggtacgtagggaaactaggtacgttaccaccgttcctaccgtaccctagtaccgacgggcccggtcccttggaccgttacgttcgttaacggtaagtttacgttttacgaccgtttaagtttttaaccttacgttacggttaccaggttaccttaaggtttaaacgttaagttacggtttaaccggtttttagggttttttaaccttccgttttaaccggtttcccggggtacccgttaagggggtaaacccttaaaaggggtttcgggtttaaaccttttacggaaaaccggttaaccggttaaaggtttcgggttaccgggacccgtttacgggtaaccccctaaaccggtttaccgtttaccggtttccgtttaacccgtttcccgtttaaaccccgg

SEQ ID NO: 39313 - DNA, 893 bp, Homo sapiens
  misc_feature: GYAE6OF01DO5KG.10.20.B09.1.454.CMB.1.raw
  modified_base (199)..(199): a, c, t, g, unknown or other
  misc_feature (199)..(199): n is a, c, g, or t
tcagcatagtagtgcacgaccggtgctcgatttagtgtagtgtgaagggggaggaactgctcagttaggacccagacggaaccatggaagccccagcgcagcttctcttcctcctgcctactctggctcccagacaacactgacagaaattagttatgacgcagtctccagcccacctgtctgtcgtctccgagggganagacgccctacccgtctccgtggcgacggggccgtacaagtaattagttcgacctacctaacttacgccttaggtaactacaaaccgaaaacgtcccgtcggacccacgggtacctacccgacgtaccttcctactacttccgtccgttcgggtcgtccgtacgttccggttccggaaccgggtcccgtacggttcgggtccgtaccctacggaccggtaggttaccgagggttcggacgtacgggttacgggtacgtaacgggaacgtaacggtacggtttacaccttaccgttaccaaccctacgtccggaacggcccgggttcctccgggtaacccgtaggttaaccgttaaggttaaacggtttacgtttttaccgggaacgtttttaccggtttttaaacgttttaccggttaccggtttaaccgaacggttaaccgttaaaggttttaagtttaacgttacgggttttaacggtttttaacgggtttttaaccttttccccggggttaacccgttttttaccccggggaaccccgggtttaggggttaaaacccggtttaacgggtttacgggttaaaccgttttaaccgtaaccgggttaaacggttaaacccggttggtaccgggttaccgtcgtaaacccttacccgttacgtttccgttaccgtttcgttaccctttaacccgg

SEQ ID NO: 39314 - DNA, 618 bp, Homo sapiens
  misc_feature: GYAE6OF01D2OAN.10.20.B09.1.454.CMB.1.raw
  modified_base (389)..(389): a, c, t, g, unknown or other
  misc_feature (389)..(389): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcaatctccagccaccctgtctgtgactccaggtgagagacgcccaccctctcttgcgacgggccagtcgaggggactcagcagctaatttagcctacggtaaccaacagaagcctggacctacggttccagacctcctcatatagtagaacgccttcttccgacgggcccaacgtggacgtcccagccaggtcaggcgggcggtgggtctgggacaggcttcactctcacntcagcagcctgcagtctgacggtacgttggtacgtttattactgtcagtctaagttctacgtaagttaacgtcggtcccgttaccgggttacggaccgggtttaccgggaccgtaaacgggggtaacccgtaagggtccgggtaaccctaaccggaaaacggttacgttcgggtacgggtacctacggaccctaacccgtacgtttccttacggttcccttcgtacccg

SEQ ID NO: 39315 - DNA, 711 bp, Homo sapiens
  misc_feature: GYAE6OF01BDNO7.10.20.B09.1.454.CMB.1.raw
  modified_base (138)..(138): a, c, t, g, unknown or other
  misc_feature (138)..(138): n is a, c, g, or t
  modified_base (198)..(198): a, c, t, g, unknown or other
  misc_feature (198)..(198): n is a, c, g, or t
  modified_base (492)..(492): a, c, t, g, unknown or other
  misc_feature (492)..(492): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacnctgcaagtaaattgttatgacgcagtcctccagcccacctgtctgtgtcctcgagggganagcgccctacccgtctccgtggccgacggggccgttacaagtaacttcgttcgaccttaaccgtaacgtttacgccttaggtaactaaccaaaacgtaaaaccggcccgttacgggacccgtacgggtacccttacccgaacgtaccttcccttactacttccgtcgtcggtcgtacctacgttccggttacgggaccgggtcctacggttcgggtccgtacccgacggtccgtacggtcgaggtcggtacgtagggtcggtacagggaacaggtactctactacctacacgtnaccgacggtccgtctacgcgtacgttacgtagtaagtttcgttcgtatttaacgtttctacgtgtactaggtacttaagttattagtcgtttacggtttcgttacttccgttacgtttaccggacgtaacgggtaacttagggttacttacgttacggaacgtacgtagttacgggtcgtctacgaaccgtacttacctggttcttaccgtccttaccg

SEQ ID NO: 39316 - DNA, 732 bp, Homo sapiens
  misc_feature: GYAE6OF01ASO8L.10.20.B09.1.454.CMB.1.raw
  modified_base (320)..(320): a, c, t, g, unknown or other
  misc_feature (320)..(320): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgacagaaatagttatgacgcagtctccagccaccctgtctgtgtctcgaggggagagacgccaccctctcctggcgagggccgtacagaatgttcgactaccaattcgcctggtaactacaaacgaaaacgccgtaggaccgaggccctcccgaagtacctcctctactcctcgtcggtcnctacttccgttacgggacggtaccacggttcggtcgtaccccgagtcccgtaggttcgaggtcggtacgtagggtcgggtacgtacgggtaacgtagttacgttaccaccttaccgtacctaacgtacgtcgacggtccgtccgtagtccgtagtacgtaagtaacgttacgtttacggtcttaacgttttacgttacgttcgtacgtacgtacgtaagttaattaacgttacgttaacggttttacgggtttttacttaccggtttaaccggttttcccgggaaccccggttagggtaaacccgttaagggtttaccggttaacgtttacccgagggttaaccgttacgggtggttacggttaccgtacgtacccgtaacgttacgttaccgttctttccgttcgtacccg

SEQ ID NO: 39317 - DNA, 736 bp, Homo sapiens
  misc_feature: GYAE6OF01AXHG9.10.20.B09.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgacaagaaatagttatgacgcagtctcccaagccctaccctgtcttgtcgtcctccgagggganacgaccgccctaccctcctcctcggcgacggggtccgtacaggtaattacgttcgacctaacctaattcgccgttaggtaacacaaacgaaacggcctacggaccacggccttaccgacgtacccttccgtactacttccgttcgtacgggtacctacttaccgttccggttaccggaccgggtacccctacggtttacggtaccgttacccggtaccgtaccggttacggttaccggagggtaccggacgtacggggttgggtacgtaacgggaacgttacgtacgtacctaccgtcctaccaacgtacgtcgaccgtcgcctaggcgtagtacgtaagtagttacgtttgaccgtttagtttacttacaggttacgacgttactattaagtacttggttaacggttttaggtacctttaccggttcggttaccggtacggtacgttaaacgtaggttacttacgtacggtacgtaggttcgtacggtgtaccgtcgaccttaggtcttagttccgttattcgtaccccg

SEQ ID NO: 39318 - DNA, 765 bp, Homo sapiens
  misc_feature: GYAE6OF01CN683.10.20.B09.1.454.CMB.1.raw
  modified_base (196)..(196): a, c, t, g, unknown or other
  misc_feature (196)..(196): n is a, c, g, or t
  modified_base (215)..(215): a, c, t, g, unknown or other
  misc_feature (215)..(215): n is a, c, g, or t
  modified_base (352)..(352): a, c, t, g, unknown or other
  misc_feature (352)..(352): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtcctcagccaccctgtctgtgtcctccgagggganagcgccctaccctctccgnggaccgaggggtccggtacaagaatattcgacctaaccgaacttcgaccgttagggtaactacaaaaccgaaaacgtcccgtaggacccaagggtcctacccgagaaccttccactaacttccgtcgtcgggttacnctaacgttccggttaccggacggggtccctaacgttcgggtacccgttccccgaggtcccgtagggttcgacggttcgggacgtacggggtttcgggaccgttaaggggaaactacggtacgttaccgtacccgtacttccgaacccgtagtacccgaacggggtcccgtaccgttaccggtacgaacggttcgtaaggttaacgttaagttttcgtaactttagtttaaccgtttacttagtacgtacgtacttaagttaacttaagttacggtaacggttttaggttttaactttcgttaaccgtttccggtaccgttacggtaaccgtaaggttcgttaacgttcgaacggtacgtaacgtaggttacgcgtacgacccgtactcgttacgtacgtttcgtacttacccg

SEQ ID NO: 39319 - DNA, 847 bp, Homo sapiens
  misc_feature: GYAE6OF01EOL3R.10.20.B09.1.454.CMB.1.raw
  modified_base (208)..(208): a, c, t, g, unknown or other
  misc_feature (208)..(208): n is a, c, g, or t
  modified_base (755)..(755): a, c, t, g, unknown or other
  misc_feature (755)..(755): n is a, c, g, or t
tcagcatagtagtgcacgaccggtgctcgatttagtgtagtgtgaagggggagaactgctcagttaggacccagacggaaccatggaacgccccagcgcagcttctcttcctctgctactctggctcccagacaacactgcaagaaattagttatgacgtcagtcctaccacgccctacccttgtcttgtcgtccgtacggagggganacggacgcccctacccgtcctccgtcggccggtacggggccgtacgaagtaattacgttaccgtacctaacctaacgttacggtccttaggtaactaaccaaaacgaacgtccgtacggaccgacggtaccctaccgacgtaccttcctactacttccgtcgtggtctacttacgttcggtaccgggacggtcctacggttcggtacccgacccgtaggacccgtttacggttaccgaagggttcggacggttacggggttgggttaaccgtaacggtaaacggtacgttaccggttacctacccttaccgaccgtaacctaaccgtccgggtaccggtcccggtcgtaccgtacgtacggttacttaaggtaacgttttcgttacgtacgttttaacgttttacgtaaccgtagtacctaaggtactttaaagtttaagttaacggtttggttttaacgggttttaccgttttaccgttccggtttacccgggtttacccgggtaaacggttaacgggttaaacgttcgtttacgggtttaaaccncgggtaaacggtttaaacgttcggttgggtaccgaccgtacggaaccctttacggttccttccggtttaaccttccgttacgttaacccccg

SEQ ID NO: 39320 - DNA, 560 bp, Homo sapiens
  misc_feature: GYAE6OF01EP7PC.10.20.B09.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (296)..(296): a, c, t, g, unknown or other
  misc_feature (296)..(296): n is a, c, g, or t
  modified_base (420)..(420): a, c, t, g, unknown or other
  misc_feature (420)..(420): n is a, c, g, or t
  modified_base (546)..(546): a, c, t, g, unknown or other
  misc_feature (546)..(546): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcgagggccgtnagaatnttgctaccaacttgcctggtatcaaacaaagcctggccaggcctccagacctcctcatctctggtnctatcgttcggaggccacgttggtcgtccccaggcctaggttccaggtcggcgtaggtgggtctaggaactaggtcgttcacgtcctacacctagtccaggccggtcctgcagtcgtagaagtntttgacttagtttatacgtgtgagtctagtatagtgttacgttgggttttattacgtaccgtttcggaccgtaggtaactaggttgtacgttacgaggtaccgtagtggtcgacgtcgccgtactntctcttcctcgtac

SEQ ID NO: 39321 - DNA, 908 bp, Homo sapiens
  misc_feature: GYAE6OF01CL50E.10.20.B09.1.454.CMB.1.raw
tcagcatagtagtgcacgaccggtgctcgatttagtgtagtgtgaagggggaggaactgctcagttaggacccagacggaaccatggaacgccccagcgcagcttctcttcctcctgctactctggcctccagactaccacgtggagtaagtagtgagtgaccgctacgtccgtcccggccctaccctgttctggtcgtcgtaccggaaggggaaacgtacgtcctaccccttccgtcccgtacggaccgacgggaccctacgtacaagttaaccgttaagtttaaacgtaaccgtaaaaccgttcggaccgttacggtaaccaacggtaacctaaaccgttaaaacccgttcggacccgtaaccggtaccccgttaccccgtaaccggtcccttaccctccgtaaaccgttccccgtaaggttcggtaccgacctacccgtcccgtaccggaccggtaccctaacgttaaacctaccgtacccacggtcccgttaacggttacgacgggtcggaccggttagggtcgggggttaccggggtacgtacggttaccgttaccctaccgtacccgttaacctaaccgtacgtaccgacggtcgaccgtccgttacgacgtacggttacgttaagttaacgtttcgttttacggtaacttttaacgttttacgtttacgtcggttaaccaacgggttacttaacggtttacgttaccggttaacccgtttaccgggtttacccggtttccccgtttaaaccccgggtttaaccgggtttcccgggtttaccggggaacccgggttaaccgtacgtaacggtaacggtaactaccgggagtacccggtaaggtcggtacggtcgtacgaccttaccttcggtactttcgtacccttcgttacccgttccccg

SEQ ID NO: 39322 - DNA, 855 bp, Homo sapiens
  misc_feature: GYAE6OF01EK287.10.20.B09.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgacagaaattagttaatgacgcacgttctccacgcccacctgtctgtctctcgaggganacgacgtcccaccctctccgtgccgacggggtccgtanaagtaatcttcgacctaacctaacttacggccttaggtaactaaccaaaacgaaaacggtccgtacgggacctaaccggccttacccgacgtacccttcctactacttccgttccggttgggtacgtacctacgttccggtttaccgggaaccggtcccgtacggttcgggtcccgtacccggaccggtacccggttaaggtttccgagggttccggacggttacggggttcggggttactacgggtaaacgtagggtttacgtacctaaccgttcgtaacccaacgtacgtccgaacggtcccggtacctcggtaccgtaacgttacgttaggtaacgtttacgttttacgtaacgttttagttttttaactacggttacgtataacggttaacctttaagttaaacgttaacgtttcggtttaacggtttttacggtttttacctttacccgttaccggttttaccccgggtacccggttaagggtaacccgttaaagggttcggtttaaacttaaccgggtaacggtaaaccggttaccggtttcgggttacgaccggttcgtaacccgttacgttaccgttttaccgtttccggttacctttacgttacccccgg

SEQ ID NO: 39323 - DNA, 984 bp, Homo sapiens
  misc_feature: GYAE6OF01EAM7D.10.20.B09.1.454.CMB.1.raw
  modified_base (139)..(139): a, c, t, g, unknown or other
  misc_feature (139)..(139): n is a, c, g, or t
  modified_base (157)..(157): a, c, t, g, unknown or other
  misc_feature (157)..(157): n is a, c, g, or t
  modified_base (161)..(161): a, c, t, g, unknown or other
  misc_feature (161)..(161): n is a, c, g, or t
  modified_base (168)..(168): a, c, t, g, unknown or other
  misc_feature (168)..(168): n is a, c, g, or t
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
tcagcatagtagtgcacgaccggtgctcgatttagtgtagtgtgaagggggaggaactgctcagttaggacccagacggaaccatggaagccccagcgcagtcttctcttcctcctgctactctggctcccagacaacnctgacagtaaattgttangacncagtccnccagccctaccttgtctgtcgtccgtacggaggggacagccgccctacccttctccgnggacggtacggggtcccgtanaagtaactttcgttacgacccttaaccttaacgttacggtaccgttaaggtaacctaacgaaaaccgaaaccggtccgtacgggacccgacggtaccctacccgaacgttaccctaccgtacctaacgtttccgttaccggttcggggtacctaaccgttaccgttccggttacgggaccggttcccgttaacggttcgggttcccgtaacccggtacggttaaccggttacgggtttaccggaggggttaccggacgggtttacggggttaccggtaaccggtaagggtaaacccgttacggttaccgtttaaccctaccgttaccgtaacccgaaccgttcggttacccggaccggggtaccgtcccttacgggtaacccgtttacgggtttaaccttaagggtttaaaccgttttggtttttaccgaaaccgtttttttacggttttaaaccggttccgttaacggtacgtaacgggttaactttaaaggtttaacgtttaaacggtttcgggttttaaccggtttttttaggtttaaccccgtttaccgttacccggggtttaaccccgggttaccgggttaacgggttaaaacccggttaaaggtttcggtttaaacccgtttaaggaaacccggggttaccggttttaggttaccgggtccgttaccggtaaaaccgttcccgttaacgttttccgttacggttttccctttaagtcccccggtttacccc

SEQ ID NO: 39324 - DNA, 726 bp, Homo sapiens
  misc_feature: GYAE6OF01B4LXR.10.20.B09.1.454.CMB.1.raw
  modified_base (512)..(512): a, c, t, g, unknown or other
  misc_feature (512)..(512): n is a, c, g, or t
  modified_base (712)..(712): a, c, t, g, unknown or other
  misc_feature (712)..(712): n is a, c, g, or t
tcagcatagtagtgcacgaccggtgctcgatttagtgtagtgtgaaggggaggaactgctcagttaggacccagacggaaccatggaacgccccagcgcagcttctcttcctcctgctactctggctcccagaacaacactgacaagaaatagttatgacgcagtctccacgccacctgtctgtcgctcgaggggacagacgccctacctctccgtcgcgacgggccggtactaagaaacttagttcgaccttaacctaaacgtttacgccgttaggttaactaaccgaaaaacgaaaaccggtccggtacggaccctaacgggtaccctacccgaagtaccctttccactaactttcctcggtaggtcgtacctacgttccggtacgggacgggtaccctaacggttcggtcccgtacccggagtacccgtagggttacaagggtcggacgttacggggttcgggtacgaacggaaacgtggtaacgttcctactccgtaacaaccgtacnggtacgccgtactagcgtagtacttaggaatttcggttacgacgtttaatttactagttcgtacatacgtaattatagttcggtacggttttacgttacttccgttacgttcccgaaggtacgtaaacgtaggttcgttactacggaagtaccgttaaggtggactcgtaaccgtacctaagtttccgagtttcccgttntaccggttaccccg

SEQ ID NO: 39325 - DNA, 754 bp, Homo sapiens
  misc_feature: GYAE6OF01DJGT3.10.20.B09.1.454.CMB.1.raw
  modified_base (131)..(131): a, c, t, g, unknown or other
  misc_feature (131)..(131): n is a, c, g, or t
  modified_base (196)..(196): a, c, t, g, unknown or other
  misc_feature (196)..(196): n is a, c, g, or t
  modified_base (731)..(731): a, c, t, g, unknown or other
  misc_feature (731)..(731): n is a, c, g, or t
tcagcatagtagtgcacgaccggtgctcgatttagtgtagtgtgaagggggaggaactgctcagttaggaccagacggaaccatggaagcccagcgcagcttctcttcctcctgctactctcggcctccanacaacactgacagaaatagttatgacgcagtctccacgccacctgtctgtcgtctccgagggganagcgcccaccctctccgtgcgacggggccggtacaagtaattattcgacctaaccgtaacgttacgccgttaggtaactaaccgaaaacgtaaaacgcccgtacggaccgacggtccctacccgaacgtaccctcctaccgtacttccgtacggttcggtacgtaccgttacttccggttaaccgggaccggtccgtaaccggttcgggttcccgacccgtaccggtaccggttaggtacgtaggtcggacgtacgggttcggtacgtacggaactaggtacttacacgttctaccgactacgtcgacggtcgtcctagactacggtcgtagtaagtttcttacgactttagttttactacgtacgtactacgttactaagttaacgttaacgttcggtttacggtttttaggttttacctaccgttaccggttccgggtaaccgttagggtaaccgttaaagggttcgtaaacgtttccggaacgtaaccggttaggttcggttcgccgttacgtacccttaacttaccggttntttccgttacccgtttcgacccg

SEQ ID NO: 39326 - DNA, 773 bp, Homo sapiens
  misc_feature: GYAE6OF01C01S9.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactcgtcggcctccagacaacactgacaagaaagttagttatggacgcagtcctcacgcccaccctgtctgttcgttaccggagggtacgacgccgtccctacccgtcgtaccgtggcgtaacgggccgtacaagtactacgttcgacctaaccgtacgttcgtccttaggtacaacgaaacgaacgccgtacggaccgacgtcctaccgactacctccgtactacttcgttacggtggtccgtacgtacgttcccggtacggtaccggtacccgtacggttacggtacccgtaacccgtaacggttacggtcggtacggtcggtacggtacggttacggtacgtaacggtaacgtacgttaccgtacctacgtacctacgaccgtacgtcggaccgtcgtacgtacgtacgtacgttacgtacgttacgttacgttacgtacgtttagttacgtacgtacgtacgtacgtagttaacgttagttaacgttacggtttacggtttacgtttaccgttaccggtttacccggttaccggtaccggttaacggttaacgtacgttacggttacgtacgtacggtacgtacggttacgtcggtacgtccgtcgtacgttaccgttccgttccgttaccgttcctaccgttccgtaccg

SEQ ID NO: 39327 - DNA, 901 bp, Homo sapiens
  misc_feature: GYAE6OF01D4YJZ.10.20.B09.1.454.CMB.1.raw
  modified_base (196)..(196): a, c, t, g, unknown or other
  misc_feature (196)..(196): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgacagaaatagttatgacgcagtctccagccacctgtctgtcgtctccgagggganagacgcctaccctctccgtgcgacgggccgtacagtaatagttcgactaacctaacgttacggccttaggtaactaccaaaacgtaaaaacggtccgtacggacccgtaacggcctacccgtaacgtacccttcccttacgtaacttccgttccgttacgggttcgtaccgttacgtttccggtttaccgggaaccggggtacccttaaccggtttcggggttaccgtaccccggaacggtaccccggttaagggtttaccgaacggggttcggacgtaagggttcggggttaccggtaagggaaaccgtagggttaacgtttccgtaccgttaccttaacccgtaacctaacggttaccggtaaccggggtcccgttccgttaaccggacgttaacggtttaccgttaaagggttaaacggtttaacgttttttcggaacgtttttaacggttttttaacgtttaaccggtttacggtaccgttaacgtaacggtttaaagtttaaaccgttaacgtttacggtttaccggtttttacgggttttttaacctttaccggtttacccggttttacccgggtacccggttaacgggtaaaccgttaaagggttcggttaacgtttaacggacggttaaaccgtaggttacggtcggtacgtacgtacccgtacttacgttacccgtttcgttccttacgttacccg

SEQ ID NO: 39328 - DNA, 808 bp, Homo sapiens
  misc_feature: GYAE6OF01C9WUI.10.20.B09.1.454.CMB.1.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
tcagcatagtagtgcacgaccggtgctcgatttagtgtagtgtgaagggggaggaactgctcagttaggacccagacggaaccatggaacgccccagcgcagcttctcttcctcctgctactctgctcccagacaacactgacaagaaatagttatgacgcagtcctccacgccctaccgtgtctgtcgtactccggagggganacgacgcccaccctctcgngcgacgggccgtanagtaatntcgactactactcgctagacaacaaacgaaacgccgtacgccgacgtacctaccgacgtacctcctactacttctacggtcggcgtacttacgttccgttacggacggtccgtacgttcggtaccgtcccgacgttaccgtaggtcggtaggtcggtacgtacggtcgggttacggtacggtaacgtacggtacgtttacctaccgttaccgtaccctaaccgtacggtacgaccggggtacccggtactaccggtacggttacgttacgttaaggttaacggtttaagttttaccggtaactttaacggtttttacgttaccggttaggttaccgtaaggttaacgttaaagtttaacgtttaacgtttacgggtttaacggttttttacggttttacccgtttaccggtttacccggttttaccgggaacccgggtttacgggttaaacgtaagggtttacgtacgtttaacccgtaaggttaaccggtagggtttggtcccgtcggttaaacctaccgtaacgtttccgtttaccggtttcttaccgttccgtaaccccgg

SEQ ID NO: 39329 - DNA, 859 bp, Homo sapiens
  misc_feature: GYAE6OF01BLXGZ.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctcctagacaacactgcagaaattagttatgacgctagtcctccagcctaccctgtctgtcgtctacggaggggagagacgccaccctctccgtgccgagggccgtacagtaattatcgacctaacctaacgttacgccgttaggtaactaccgaaaacgaaaacgtcccgtacggacccgaacggtccctacccgaacgtacccttacccgtactacgttacctcggttggttcgactacgtttccggttacggacgggtccctacggtttacggtccgtacccgacgtcccggttacggttacgacggttggacgttacggggtcggttacgtaggaaacgtggttaacgttccaacgttacgtaccgtaaccgtacgttacggaaccgggtcccgttaccgtcggtaaccgtagtttaaccggtaaggtttaaacgtttacgtttttacggaacttttaaggtttttaacctttcggtacgtttacgaagtttaacgtaaacgtttaacgtttaattacgggttttaaccgggtttttcgtttttaacccgtttaccggttacccggtttttacccggggtaacccggttaacgggttaaaacccgttaagggggtttacttaaccggtttaaacgggaacggttaaacgttacgggttacgggttccgggtaacctaccggtacccttacggttaccgtttcgtttaactttaccgtttcccttaccccg

SEQ ID NO: 39330 - DNA, 749 bp, Homo sapiens
  misc_feature: GYAE6OF01BY58D.10.20.B09.1.454.CMB.1.raw
  modified_base (90)..(90): a, c, t, g, unknown or other
  misc_feature (90)..(90): n is a, c, g, or t
  modified_base (151)..(151): a, c, t, g, unknown or other
  misc_feature (151)..(151): n is a, c, g, or t
  modified_base (155)..(155): a, c, t, g, unknown or other
  misc_feature (155)..(155): n is a, c, g, or t
  modified_base (198)..(198): a, c, t, g, unknown or other
  misc_feature (198)..(198): n is a, c, g, or t
  modified_base (519)..(519): a, c, t, g, unknown or other
  misc_feature (519)..(519): n is a, c, g, or t
  modified_base (698)..(698): a, c, t, g, unknown or other
  misc_feature (698)..(698): n is a, c, g, or t
  modified_base (721)..(721): a, c, t, g, unknown or other
  misc_feature (721)..(721): n is a, c, g, or t
  modified_base (738)..(738): a, c, t, g, unknown or other
  misc_feature (738)..(738): n is a, c, g, or t
tcagcatagtagtgcacgaccggtgctcgatttagtgtagtgtgaaggggaggaactgctcagttaggacccagacggaaccatggaacncccagcgcagcttctcttcctcctgctactctgctccagacaacactgcagtaaatgttangacncagtcctcagccctacctgtctggtctccgtccgaaggggtanacggacgccctacccttcgtccgtggccgacggggtccgtacaagtaacttgttcgaccttaaaccaacgttacgccgtaaggttaacaacgtaaaaaccgaaacggttcctacgggacccgtaacggtccctaaccgtaacgtacctcccgttaacgacgtttccgtacgtggtactccgttaaccttcggtacgggaccggtccctaggtccggttaccaccccgacggttactacgggtttaccaggggttcgacgtaggggtcggtaactaacgggaaacgttcgtactaccctactccggtacaaactacgtccgngccggtacctgtacgcgttacgtaggtaacttttcttagggtacctttaatttacccgttagtacgtacgacgtacgtttaaacgtaggtacttcgggtttaccgttttaagtttctacccggtaccgggtttcaccgggaagttaacgtgtagttaccgtagggaacctaagggtttnggttaacgcctaacgttaccctnttaacttccgtttcgtntacccgtaccc

SEQ ID NO: 39331 - DNA, 872 bp, Homo sapiens
  misc_feature: GYAE6OF01AKJBD.10.20.B09.1.454.CMB.1.raw
  modified_base (170)..(170): a, c, t, g, unknown or other
  misc_feature (170)..(170): n is a, c, g, or t
  modified_base (177)..(177): a, c, t, g, unknown or other
  misc_feature (177)..(177): n is a, c, g, or t
  modified_base (232)..(232): a, c, t, g, unknown or other
  misc_feature (232)..(232): n is a, c, g, or t
  modified_base (783)..(783): a, c, t, g, unknown or other
  misc_feature (783)..(783): n is a, c, g, or t
tcagcatagtagtgcacgaccggtgctcgatttagtgtagtgtgaagggggaggactgctcagttacggacccagacggaaccatcggaacgccccagcgcagcttacctcttcctcctgcctactcgtggcctcccagacaactctgacaagtaaattagttatcgacncagtccnccacgccaccgtgtctgtcgtcctacggaggggacacggacgccctacccgttcnccgtcggaccgtagggggtccctacaagttaacgttcgttccgaaccttaacccgtaaacgtttccggtaccgttaggtaaactaaccgaaaaacgaacggtcccgtacggacctacggtcctaacccgaacgtaccttacccgactaaccgttcgtcggttacggtcaacctcgttccgggttacggaaccgggacctacggttccgggttaccacccgtacgtacccgggtaggtttacgacgtttacgggacgtacggggttacgggtaccgtaagggaaacttcgggttacctttaccccggtaccctacgttaaccccgaaccgtttaacgccggttaaccgggccgttaccgtacgggttaaccgtaaggttccgttaaaaaggtttaccggttttacgttttaccgtaagggttttaaacctttacgtttccgacgtacggtaactaacgtaagtttaattacgggttcgttttacgggtttaacgttttacccacgtttaccgggtttaccgtaaccgtaaggggttaactaaacggggtttnttacccggttaaacggaaacgttacccggtaagttacgccgggtactaacggacccgttaattcttaccggttctaccttcggtacccc

SEQ ID NO: 39332 - DNA, 918 bp, Homo sapiens
  misc_feature: GYAE6OF01CEZR4.10.20.B09.1.454.CMB.1.raw
  modified_base (90)..(90): a, c, t, g, unknown or other
  misc_feature (90)..(90): n is a, c, g, or t
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
tcagcatagtagtgcacgaccggtgctcgatttagtgtagtgtgaagggggaggaactgctcagttaggacccagacggaaccatggaanccccagcgcagcttctcttcctcctgctactctggcctcccagacaacactgcaagaaatagttatcgacgctagtcctccacgcccacccgtgtctgtcgtcctccggaggggganagacgccctacccgtctaccgnggccgacggggtccggtaccaagtaattacgttacgtacctaaccctaacgtttacggccgttaggttaactaaccgaaaaccgtaaaacggtccgttaccgggaccgacgggtacccctacccgtaaccggtaaccctcccctttaacgaccgtttccgtaccggtttagggtccgtactttaccggtttcggttaccgggaccggtacccggttacggtcgggtttaccccgaccccgtaaccggtaccggttacggttttaccgaaggggtccggtacgggtaggggtttacgggtacggtaacgggtaaagtacggttaccgtttaaccacccgtttcgtaccgaaacctaggttcccggacggtacccggtacccgttgtaccggttaacgttcggtaacggttacgtttaaagtttcgtacgttttaacgttttattacggttctacgtaacggttacgttaaaggtttactttaagggtaccggttttaaacgggtttttcggttttaaccgttaccgttttaaccggggttcccggttaacccgggttaaagggttaaaccccgttaaagggttccgggttaaaccttttacggaaacgttcggtttaaccgtcgggttcggaacttacgggtaccctaacgttacgttccggttacctttcgttaaaaccgtttcccccg

SEQ ID NO: 39333 - DNA, 801 bp, Homo sapiens
  misc_feature: GYAE6OF01DHSO7.10.20.B09.1.454.CMB.1.raw
  modified_base (194)..(194): a, c, t, g, unknown or other
  misc_feature (194)..(194): n is a, c, g, or t
  modified_base (238)..(238): a, c, t, g, unknown or other
  misc_feature (238)..(238): n is a, c, g, or t
  modified_base (789)..(789): a, c, t, g, unknown or other
  misc_feature (789)..(789): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctccagacacactgacagaaatagttatgacgcagtctccagccacctgtctgtcgtctccgagggganacgacgcccaccctctccgtgcgacgggtccgtacaagtaactntcgactaccaacttacgccttaggtaactacctaaacgaaaacgccgtacggacccgaacggtcctacccgaagtacccttccctactacgttccgtacgtcggtcacctaacgttccgtcggacgggtcctacgtcggttccgacccgacgtccgttaggttcgacggtcggtacgtagggttcgggttaccgtaagggtaaacgtacggtacgtttacccaacgtttacctaaccgtaaccgacgtttacccggaaccgggtccggtaccccgttaggtaaccgttaacggttcgttaaagttaaggtttaaactttttcggaaacgttttacgtttttaacgttaccgttacggtacctaagggttaacctaaggttttaaattacgggtttaacggttaacggtttttacggttttttactaccgtttaaccggtttccgggttaccgttaacgggtaaacccgttaaggtttccggtactttacggaacgtaacggtaacgttggtaccgtacgtacggtaacctaaccgttacttcggtttcctnttccgttaaccg

SEQ ID NO: 39334 - DNA, 491 bp, Homo sapiens
  misc_feature: GYAE6OF02I7DSH.10.20.B09.1.454.CMB.1.raw
  modified_base (488)..(488): a, c, t, g, unknown or other
  misc_feature (488)..(488): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttctagggccactggtgtcccagccaggttcagtggcagtgggtctggaacagagttcactctcaccatcagcgcctgcagtctgaagatttgctagtttattactgtcagcagtataatgacttggttttatctactttcgcctggaccaagtggatttcagtacgactgtggctgcaccatctgtcttntac

SEQ ID NO: 39335 - DNA, 499 bp, Homo sapiens
  misc_feature: GYAE6OF02HGSY6.10.20.B09.1.454.CMB.1.raw
  modified_base (350)..(350): a, c, t, g, unknown or other
  misc_feature (350)..(350): n is a, c, g, or t
  modified_base (496)..(496): a, c, t, g, unknown or other
  misc_feature (496)..(496): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaaacaaaagcctggccaggctcccagactcctcatctctggtgcatcttcgaggccactggtgtcccagccaggttcagtggcagtgggtctggaacngagttcactctcaccatcagcggcctgcagtctgaagtatttgctagtttattactgtcagctagtataatgtacttgggtttatctactttcgcctggacctaagtgtatttcgagtacgactggtgctgcaccattctgttctntac

SEQ ID NO: 39336 - DNA, 499 bp, Homo sapiens
  misc_feature: GYAE6OF02FQOVT.10.20.B09.1.454.CMB.1.raw
  modified_base (496)..(496): a, c, t, g, unknown or other
  misc_feature (496)..(496): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccatccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggctgcagtctgaagtatttgctagtttattactgtcagcagtataatgtacttgggttttattctactttcggcctgggaaccaagtggtattcagtacgaatggtggctgccacatctgtctntac

SEQ ID NO: 39337 - DNA, 536 bp, Homo sapiens
  misc_feature: GYAE6OF02IQGVF.10.20.B09.1.454.CMB.1.raw
  modified_base (194)..(194): a, c, t, g, unknown or other
  misc_feature (194)..(194): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcagggccggtcagaatattgctaccaacttagcctggtatcaacaaaagcctggccaggctccccagactcctcatctctggtgcatcttcgagggccatggtcgtcccagccaggttcagtggcagtggtctggacagagttcactctcacntcagcgcctgcagtctgaagtntttgctagtttattactgtacagctagtaataatgtacgttgggttttattccgttacgtttccggtcccttagggtaaccctaaggtcggtatttcgaaggtaacggtaacttggtacggctggaccacctagtctgttccttctacc

SEQ ID NO: 39338 - DNA, 500 bp, Homo sapiens
  misc_feature: GYAE6OF02GA392.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctcccagactcctcatctctggtgcatcttcgagggccactggtgtcccagccaggttcagtggcaggtggtctggaacagagttcactctcaccatcagcgctgcagtctagaagtatttgctagtttattactgtcagctagtataatgtacttggttttattctacgtttcgcctgggacctaagtgtattcgagtacgtatggtgtctgcactatctgttctctac

SEQ ID NO: 39339 - DNA, 508 bp, Homo sapiens
  misc_feature: GYAE6OF02GO9WZ.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggcctcccagacctcctcatctctggtgcatcttcgagggccactggtgtccccagccaggttcagtggcagtgggtctgggaacaggagttcactctcaccatcgagcggcctgcagtctgaagtatttgctagtttattactgtcagctagtataatgtacttgggttttattctactttcgccttggaacctaagtgtatttcagtacgaatgtggctgcaccatctgttcttctac

SEQ ID NO: 39340 - DNA, 528 bp, Homo sapiens
  misc_feature: GYAE6OF02GXJYD.10.20.B09.1.454.CMB.1.raw
  modified_base (350)..(350): a, c, t, g, unknown or other
  misc_feature (350)..(350): n is a, c, g, or t
  modified_base (377)..(377): a, c, t, g, unknown or other
  misc_feature (377)..(377): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacngagttcactctcaccatcagcgctgcngtctgaagatttgctagtttattactgtacagctagtatatgtacttggttttattctacgtttcgcccttagggtaacctaaggttggtatttcgaacggtacgtaacgtcggtggtctcgaccgtacctagttcctgttccttcgtacg

SEQ ID NO: 39341 - DNA, 526 bp, Homo sapiens
  misc_feature: GYAE6OF02I4RVD.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctccagactcctcatctctggtgcatcttcgagggccacgtggtcgtcccagccaggttcagtggcagtgggtctggaacagagttcactctcaccatcagcggcctgcagtctgagtatttgctagtttattactgtctagctagtataatgtactttgggttttattcgtactttcggcctgggaacctaaggttgattttcgaggtaccgtaacgttgtacggtctgacctacctagttctggttccttctac

SEQ ID NO: 39342 - DNA, 501 bp, Homo sapiens
  misc_feature: GYAE6OF02IZN4S.10.20.B09.1.454.CMB.1.raw
  modified_base (393)..(393): a, c, t, g, unknown or other
  misc_feature (393)..(393): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccacgtggtcgtcccagccaggttcaggtgcaggtgggtctggaacagagttcactctcaccatcagcggcctgcagtctagaagtntttgctagtttattactgtcagtcagtataagtgtacgttggtttatctacgttcgcctggaactaagtgtattcgagtacgtaatgtgctgcactntctgtctntac

SEQ ID NO: 39343 - DNA, 532 bp, Homo sapiens
  misc_feature: GYAE6OF02ISRXC.10.20.B09.1.454.CMB.1.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (346)..(346): a, c, t, g, unknown or other
  misc_feature (346)..(346): n is a, c, g, or t
  modified_base (526)..(526): a, c, t, g, unknown or other
  misc_feature (526)..(526): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccacctctcctgcagggccggtcagaatattgctaccaacttagcctggtatcaacaaaagcctggccaggctccagactcctcatctctggtncatcttcgaggccactggtctcccagccaggttcagtggcagtgggtctggaacngagttcactctcaccatcagcggctgcagtctgaagtatttgctagtttattactgtacagctagtataatgtacttagggttttattactacgtttcgcccgtggtaacctaaagttcggtatttcgaggtaacgtaacgttggtcgtacgtgtacctaccaattcgtcggttaccttntaaccg

SEQ ID NO: 39344 - DNA, 504 bp, Homo sapiens
  misc_feature: GYAE6OF02H6WGM.10.20.B09.1.454.CMB.1.raw
  modified_base (194)..(194): a, c, t, g, unknown or other
  misc_feature (194)..(194): n is a, c, g, or t
  modified_base (501)..(501): a, c, t, g, unknown or other
  misc_feature (501)..(501): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagtatttgctagtttattactgtcagcagtataatgtactggttttattcactttcggcctggaccaagtgtatttcagtacgtaactggtcggcttgcaccattcctgttccttntac

SEQ ID NO: 39345 - DNA, 503 bp, Homo sapiens
  misc_feature: GYAE6OF02IZ7QB.10.20.B09.1.454.CMB.1.raw
  modified_base (194)..(194): a, c, t, g, unknown or other
  misc_feature (194)..(194): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccacctctcctgcagggccgtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccntcagcggcctgcagtctgaagtntttgctagtttattactgtcagcagtataatgacttggttttatctactttcggcctggaacctaagtgtatttcgagtacgaacttggtggctgctacattcgtgttcttctacg

SEQ ID NO: 39346 - DNA, 548 bp, Homo sapiens
  misc_feature: GYAE6OF02G4WKG.10.20.B09.1.454.CMB.1.raw
  modified_base (194)..(194): a, c, t, g, unknown or other
  misc_feature (194)..(194): n is a, c, g, or t
  modified_base (410)..(410): a, c, t, g, unknown or other
  misc_feature (410)..(410): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctccagactcctcatctctggtgcatcttcgaggccactggtgtcccagccaggttcagtggcagtgggtctggaacagagttcactctcacatcagcggacctgcagtctgaagtatttgctagtttattactgtcagnagcgtgcctacgtttcggacgggtagtcgcctacgtttcggacggtacgggaaccaaagtacggaaggttaaccgaaaacggtaactcggtacgggtacttacggcctaaccgtacttaccgttaggtacctttaccg

SEQ ID NO: 39347 - DNA, 554 bp, Homo sapiens
  misc_feature: GYAE6OF02JNRTR.10.20.B09.1.454.CMB.1.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
  modified_base (297)..(297): a, c, t, g, unknown or other
  misc_feature (297)..(297): n is a, c, g, or t
  modified_base (376)..(376): a, c, t, g, unknown or other
  misc_feature (376)..(376): n is a, c, g, or t
tcagcatagtagtgcacgaccggtgctcgatttagtgtagtgtgaagggggaggaacgtgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcagggccggtcagaatnttcgctaccaacttagcctggtatcaacaaaagcctggccaggcctccagactcctcatctctggtncatcttcgaggccatggtctcccacgccgtaggttccaggtcggctagggtgggtctgggaacaggagtttccacttcnccacctatccgagccggcctgcacgtctagaagtatttgactagtttattacgtgtcagctagtataagttgtacgtttggttttacttcgtacgttttccggccgttggaacctaagtcggtatttcgagtacgtaattggtcggtactgactaccgtattccgtagttccttctac

SEQ ID NO: 39348 - DNA, 550 bp, Homo sapiens
  misc_feature: GYAE6OF02HZIQ6.10.20.B09.1.454.CMB.1.raw
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagccaccctctcctgcagggccggtcagatattgctacaacttgcctggtatcaacaaagcctggccaggcctccagactcctcatctctggtgctatcttcggaggccacgtggtcncccagccgtaggttcaggtcggcgtaggtgggtctagggaacnggtacgttcacttctcaccatcaggcgtcctgcctagtctagaagtntttgacttagtttattacgtgtacagctaagtaattaatgtacgtttaggttttacttcgtacgtttccggaccgtaggtaacctaaggtcgttatttcgaagtacgtagtggtcggactgacctacgtattcgtcgttctctac

SEQ ID NO: 39349 - DNA, 561 bp, Homo sapiens
  misc_feature: GYAE6OF02G13H3.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttccccagacctcctcatatatgaagtcctcttccagggccacgtggactcccagccaggttcaggcggcggtggtcgtgggacagacttcactctcaccatcagcagcctgcagtctgagtaccttggatttatctgtcagtcagtatcattacgtcgtaccttccggtaggtaccggttccggaccgaaacgggaccaaggggtacgaccctacgaaacggaaccgtggtacggtaccgtacgaccgaaccgtacttccgttgttacctactacgttcccttacccccg

SEQ ID NO: 39350 - DNA, 507 bp, Homo sapiens
  misc_feature: GYAE6OF02GSJ36.10.20.B09.1.454.CMB.1.raw
  modified_base (504)..(504): a, c, t, g, unknown or other
  misc_feature (504)..(504): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggaaacagccaccctctcctgcagggccagtcagagtgttggcagcaggttagcctggtaccagcagaaacgtggccaggctcccaggctcctgtatatggtgcatccacgagggccactggtatctcaggcaggttccgtggcagtgggtctgggacaggagttcatgtcaccatcagcagcctgcagtctgaagtatttgctagtttatactgtcaactatacgtacgtagtcggtccgtccggggcctacgtttccggcccgtggacctaagtggagagtacgaaacgactggtgctgcacgatctgtctntac

SEQ ID NO: 39351 - DNA, 550 bp, Homo sapiens
  misc_feature: GYAE6OF02G9D66.10.20.B09.1.454.CMB.1.raw
  modified_base (401)..(401): a, c, t, g, unknown or other
  misc_feature (401)..(401): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagcccaccctctcctgcagggccggtcagaatattgctaccaacttagcctggtatcaaacaaaagcctggccaggctcccagacctcctcatctctggtgcatcttcggagggccacgtggtcgtcccagcctaggttcaggtggctaggtgggtctaggaacagtagttcactctacacatcagcgcctgcagtctgaagtntttgctagtttattactgtcagctagtataatgtacgtttggttttattcgtacgtttcggccgtagggaacctaaggttggtatttcgaacggtacgtaacgttggtacggtctaggacctaccgtattccgttcgttccttacgtac

SEQ ID NO: 39352 - DNA, 549 bp, Homo sapiens
  misc_feature: GYAE6OF02I3D8A.10.20.B09.1.454.CMB.1.raw
  modified_base (194)..(194): a, c, t, g, unknown or other
  misc_feature (194)..(194): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccacctctcctgcagggccggtcagaatattgctaccaacttagcctggtatcaaacaaaagcctaggccaggcctcccagactcctcactctctggtgcatcttcgacggccacgtggtacgtccagcctaggttcagtgcgaggtgggtctaggaacgagacgttcactcncaaccntcgagcgctgcagtctgaagtntttgactagttattactgtacagctagttaatagtagtacgtttaggttttatcgtacgttttcggacccgttaggaacctaaggttgtactttcgaacgtcgtaagttggtacggcttggaccttacgatttcgtacgttcttataccg

SEQ ID NO: 39353 - DNA, 509 bp, Homo sapiens
  misc_feature: GYAE6OF02GMJHH.10.20.B09.1.454.CMB.1.raw
  modified_base (506)..(506): a, c, t, g, unknown or other
  misc_feature (506)..(506): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctgggacagacttcactctcaccatcaccggcctagaccctgaagtattttgctagtttattactgtcagcagcgtagcagctcggcccctctccctctacgtttcggcggacggaccaagggtgagactacgaaacgtactggtgctgcacctatcgtgtctntac

SEQ ID NO: 39354 - DNA, 540 bp, Homo sapiens
  misc_feature: GYAE6OF02HNBIJ.10.20.B09.1.454.CMB.1.raw
  modified_base (294)..(294): a, c, t, g, unknown or other
  misc_feature (294)..(294): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggcctccagactcctcatctctggtncatccaacagggccacgtggcatcccagccaggttcgatggcaggtggtctgggacagacttcactctcacatcagcagcctggacgcctagaagtattattgacttagttttattattgtcagcagcgtagcgaggtcgtccttttcgaccgtttccgggacccgggtaacctaaaggtcggtaaacttaccgaaacgtaacgttggtacgcgtagaccaacctattccgtgttccttactaccg

SEQ ID NO: 39355 - DNA, 523 bp, Homo sapiens
  misc_feature: GYAE6OF02HJS5Y.10.20.B09.1.454.CMB.1.raw
  modified_base (193)..(193): a, c, t, g, unknown or other
  misc_feature (193)..(193): n is a, c, g, or t
  modified_base (294)..(294): a, c, t, g, unknown or other
  misc_feature (294)..(294): n is a, c, g, or t
  modified_base (397)..(397): a, c, t, g, unknown or other
  misc_feature (397)..(397): n is a, c, g, or t
  modified_base (511)..(511): a, c, t, g, unknown or other
  misc_feature (511)..(511): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctcccagacctcctcatctctggtncatcttcggagggccacgtggtcgtcccagcctaggttcaggtcggctaggtgggtctggaacagtagttcactctcacatcgagcgctgcagtctagaagtntttgcttagtttattacgtgtacagtctagtactaatgtacgtttgggttttactcgttacgtttccggcctaggacctaagtgtacttcgagtacgtactggtgtctgcactntctgttctctac

SEQ ID NO: 39356 - DNA, 577 bp, Homo sapiens
  misc_feature: GYAE6OF02IEFYB.10.20.B09.1.454.CMB.1.raw
  modified_base (194)..(194): a, c, t, g, unknown or other
  misc_feature (194)..(194): n is a, c, g, or t
  modified_base (411)..(411): a, c, t, g, unknown or other
  misc_feature (411)..(411): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcacgggccgtcagaatattgctaccaacttagcctggtatccaaacaaaagcctggccaggcctcccagactcctcatctcgtggtgcattcttcggacggccacgtggtcgtcccagccaggttcaggtggctaggtcgggtctaggaactaggagttacacgttcctcaccatccaggcgcctgcagtctaggaagtntttcgacttagttttacttactcgtacagtctagtaacttaagtagtacgttttagggttttacttcgttaccgtttaccggccgtagggtaacctaaggttcgtatttacgaacggtaacgtaacgtggtacgtctagtccacctattcgtcgttccttataccg

SEQ ID NO: 39357 - DNA, 531 bp, Homo sapiens
  misc_feature: GYAE6OF02IISM0.10.20.B09.1.454.CMB.1.raw
  modified_base (195)..(195): a, c, t, g, unknown or other
  misc_feature (195)..(195): n is a, c, g, or t
  modified_base (377)..(377): a, c, t, g, unknown or other
  misc_feature (377)..(377): n is a, c, g, or t
  modified_base (405)..(405): a, c, t, g, unknown or other
  misc_feature (405)..(405): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccggtcagaatattgactaccaacttagcctggtatacaaacaaaagcctggccaggcctcccagcctcctcatctctgtgctatcttcgacggcctacgtggtcgtcccagccgtaggttcagtggcgaggtcgggtctgggaacagtacgttcactcncacatcgagcgctgctagtctagaagtntttgattagtttatcgtgtcagtcatatatgtactttggtttatcgtactttcgcctaggaacctaaggtgtatttcgagtacgtaacgtggtacggtctcgactacgtattcgtctcttctaccg

SEQ ID NO: 39358 - DNA, 560 bp, Homo sapiens
  misc_feature: GYAE6OF02GSNWL.10.20.B09.1.454.CMB.1.raw
  modified_base (403)..(403): a, c, t, g, unknown or other
  misc_feature (403)..(403): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagccaccctctcctgcagggccggtcagaatattgctaccaacttagcctggtatcaacaaaagcctggccaggcctcccagacctcctcatctctggtgcatcgttcgagggccacgtggtcgtcccagccaggttcagtcgcaggtgggtctaggaacaggtagttcactctacaccatcagccggcctgcgagtctagaagtntttgctagtttattactgtcagtcagttataatgtagtttggttttattcgtacgtttccggcccttagggaacctaaggtcgttactttacgacggtaacgtacgttggtacggtaccttgaccctaccgtattccgttacgttccttacgtaccg

SEQ ID NO: 39359 - DNA, 505 bp, Homo sapiens
  misc_feature: GYAE6OF02I7MKV.10.20.B09.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtagtgtgaagggggaggaactgctcagttaggacccagacggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaacagaaacctggccaggctcccaggcccctcatctatggtgcatccaacagggccactggcatcccagccaggttcagtggcagtggtctgggacagactcactctcaccatcatcagcctggagcctgaagatgttgctagtttattactgtcaacatcgtaccgagtcggcctccggggcctcgtttcgccgtgggaccaaagtggatatacaacgtactgtgctgcacatctgtctcatcccg

SEQ ID NO: 39360 - DNA, 1005 bp, Homo sapiens
  misc_feature: GYAE6OF02I44LY.10.20.B09.1.454.CMB.1.raw
tcagcatagtagtgcacgaccggtgctcgatttagtgtagtgtgaaggggaggaactgctcagttaggacccagacggaaccatggaagccccagcgcagcttctcttcctcctgctactctggccctccagaacaactacgtgacaaagtaaattagttagtaggaccgacgtacgttccctaccgaccgacccctaccgttgttcgttggttcgttccgtaccggggaagggggagacggaccgaccccctacccttccgttccgcgacgggaccggggtcccgtacgaaagttaattacgttccgtaacccttaaacccgttaaagttaccgtccggttaggttaactaaaccaaaaacgaaaccgtccgtacggaccgacgtccctaccgacgtaccctccgactacttcgtcggtgggtcacttacgtttccggtacggggaccggtacccttacgggttcgggttacccctacccggacgtacccggtttacgggtttacggaacgggttccggtacggtagggggtttccgggttacggtaaacggtaaacgtagggtttaccgttacccctacgtttacccgaaaccctaaccgttaccgggtaacggtacccggggtccccggttaccgttacgaaccgggtttaacgtttccgggttaaaaggttaaacgttttttcggtttacggaaaccggttttttaaacgttttttaaccgttacggtttacccggttacgaacggttaaccggtttaaaagttttaacgttaaacgggtttacgggtttttaccgggttttttttaagggttttttaacccttaccggttttaaccccgggttttccccggggtaaacccgggtttaaaccggttaaaaaccgtttaagggggtttccttttaacgttaccggaaacgggttaaccctttaacgggttcgggtcgtaaccgttccgtaaccgttacttagttcccgtttacgtttcctccgttaaccccg

SEQ ID NO: 39361 - DNA, 605 bp, Homo sapiens
  misc_feature: GYAE6OF02I4QOV.10.20.B09.1.454.CMB.1.raw
  modified_base (420)..(420): a, c, t, g, unknown or other
  misc_feature (420)..(420): n is a, c, g, or t
tcagcatagtagtgcacgaccggtgctcgatttagtgtagtgtgaagggggaggaactgctcagttacggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaagcctggccaggctccccagactcctcatcctctggtgctatcgttcggacgggccacgtcggtcgtcccgacgccgtagggttcaggtggacgtagggtcgggtcgtagggaacaggtacgttaccactctccaccatcacggcgcctgcagtcagaagtntttgcttagtttattcttgtcagtctagttaattagttgtacgttttgggttttaacttcgtttaccgtttccggtacccgttagggaacctaagggttcggttactttacgaacggtaaccgtacgttcgggtaggtccgttacgcccgtaaccgtacgttccgttagttaccgtttactaccg

SEQ ID NO: 39362 - DNA, 598 bp, Homo sapiens
  misc_feature: GYAE6OF02FU071.10.20.B09.1.454.CMB.1.raw
  modified_base (193)..(193): a, c, t, g, unknown or other
  misc_feature (193)..(193): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaacaaaagcctggccaggctcccagacctcctcatctctggtgctatcttcgagggccacgtggtcgtcccagcctaggttcagtggctaggtgggtctagggaacaggtagttcactctcaccatcacgccggcctgcacgtctaggaagttatttcggactagttttatacttgtacagtctagttataagttcgtaacgtttgggttttttacttaccgttaccgttttccgggtccgttacggtaaccgtaaagttcgggtacttttcgaaggttaaccgtaacggttggttacggtacgttacgaccgtacccttagttccttacgttcccgttcttaacccg

SEQ ID NO: 39363 - DNA, 520 bp, Homo sapiens
  misc_feature: GYAE6OF02FHAWB.10.20.B09.1.454.CMB.1.raw
  modified_base (490)..(490): a, c, t, g, unknown or other
  misc_feature (490)..(490): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggcctcccagactcctcatctctggtgcatcttcgagggccacgtggtcgtccccagcccaggttcagtggcaggtgggtctgggaacaggagttcactctcaccatcagcgcctgcagtctgaagtatttgctagtttattactgtcagctaagtataatgtacgttggttttaatctacgtttcgcctagggacctaagtgattcgagtacgtaactggnggtctagcctactagttctcgtccttatac

SEQ ID NO: 39364 - DNA, 524 bp, Homo sapiens
  misc_feature: GYAE6OF02JBQ23.10.20.B09.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaacaaaagcctggccaggcctcccagactcctcatctctggncatcttcgagggccacgtggtcgtcccagccaggttcagtggcaggtgggtctggaacagagttcactctcaccatcagcggcctgcagtctgaagtntttgctagtttnttactgtcagctagtatatgtacgttggttttattctacgtttccggcctagggaacctaagtcgtatttcgagtacgtaactggtacggcttgacctaccgattccgtgttccttactac

SEQ ID NO: 39365 - DNA, 561 bp, Homo sapiens
  misc_feature: GYAE6OF02GSC3S.10.20.B09.1.454.CMB.1.raw
  modified_base (304)..(304): a, c, t, g, unknown or other
  misc_feature (304)..(304): n is a, c, g, or t
  modified_base (545)..(545): a, c, t, g, unknown or other
  misc_feature (545)..(545): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctcctgcgagggccggtcagaatattgctaccaacttagcctggtatacaaacaaagcctggccaggcctcccagacctcctcactctcgtggtcnctatcgttcggagggccacgtggtcgtcccagccgtaggttcaggtggctaggtcgggtcgtaggaacaggtacgttcacgttcctacacctatcgacggccgtcctgctagtctaggtaagtatttgacttagtttattacgttgtacagtctagttaatagtgtacgtttggttttactttacgttcgccgttaggacctaaggtgtacttcgagtacgtagtggtggtctgactactntctgtcttcacttccc

SEQ ID NO: 39366 - DNA, 599 bp, Homo sapiens
  misc_feature: GYAE6OF02F43AY.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatacaacaaaagcctggccaggcctcccagacctcctcatctctggtgcatcttcggacgggccacgtggtcgtcccagccgtaggttcaggtggacaggttggggtctagggaactaggtacgttcacttcctaccaccatcagccggcctgcagtctagaagttatttcgacttagttttacttacgtgttacagtctaagttataagttgtacgtttggtttttactcgtacgtttccggcccttagggtaacctaaagggttcgtactttacgaacggtaaccggtaacgttcgggtacggtcttacggaccctaccgttattccgtttacgttccttacgtaccg

SEQ ID NO: 39367 - DNA, 501 bp, Homo sapiens
  misc_feature: GYAE6OF02G4PGK.10.20.B09.1.454.CMB.1.raw
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtcgtcccagccaggttcagtggcagtgggtctgggaacagagttcactctcaccatcagcgcctgcagtctgaagtatttgctagtttattacttgtcagcagtataatgtacttgggttttattctactttcgcctggaccaagttggtattcagtcgaactggtggctgcacntctgttcttntac

SEQ ID NO: 39368 - DNA, 568 bp, Homo sapiens
  misc_feature: GYAE6OF02HOMKV.10.20.B09.1.454.CMB.1.raw
  modified_base (295)..(295): a, c, t, g, unknown or other
  misc_feature (295)..(295): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaaacaaaagcctggccaggctcccagactcctcatctctggtncatcttcgagggccacgtggtgtcccagccaggttcagtggcagtgggtctggaacagagttcactctcaccatcagcgcctgcagtctgaagtatttgctagtttattatttgtctagctagcgttagcgtagggttcgtcctttcgtacgttttccggggacccggggtaacaaaggttcggaaacttaccgaaaacggtaacgttggtacggtcgtaggaccaaccgtagttccgttacggttcctttaccgtacttccctttaccccgg

SEQ ID NO: 39369 - DNA, 619 bp, Homo sapiens
  misc_feature: GYAE6OF02I5OAZ.10.20.B09.1.454.CMB.1.raw
  modified_base (193)..(193): a, c, t, g, unknown or other
  misc_feature (193)..(193): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccagggganagagcccaccctctcctgcagggccgtcagaatattgctaccaattgcctggtatacaaacaaaagcctggaccaggcctcccagacctcctacactctctggtcactacttcgttcggacgggccctacgtcggtcgtcccagtccgtaggttcaggtcggctaggtcgggtactaggaactaggtacgttcacgttcctcaacctatccgacggccggtcctgacgtacgtcttaggaaacttgtttcgacttagtttacttacgtcgttacagtctaagtaagttaagtcggtaccgttttgggttttacttacgttaaccgtttccggcccgttagggaacctaaggttcgttagtttacgacgtaacggtaaccttgggtacgtccgtagtacctactagttcttcggttactaccttacg

SEQ ID NO: 39370 - DNA, 518 bp, Homo sapiens
  misc_feature: GYAE6OF02JCGQQ.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcacagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaaacaaaagcctggccaggctcccagactcctcatctctggtgcatcttcgagggccactggtctcccagccaggttcagtggcagtgggtctggaacagagttcactctcaccatcagcgcctgcagtctgaagtatttgctagtttattacgtgtcagctatataagtgtacttgggttttatctacgtttcggcccgttaggaacctaagttgtatttcgagtacgtaactggtggctagctacgtattctcgttcttctacg

SEQ ID NO: 39371 - DNA, 538 bp, Homo sapiens
  misc_feature: GYAE6OF02G3BNX.10.20.B09.1.454.CMB.1.raw
  modified_base (194)..(194): a, c, t, g, unknown or other
  misc_feature (194)..(194): n is a, c, g, or t
  modified_base (295)..(295): a, c, t, g, unknown or other
  misc_feature (295)..(295): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctcccagacctcctcatctctggtncatcttcgaggccatggtctcccagccaggttcagtggcaggtgggtctaggaacaggtagttcactctcacctatcagcggtcctgcagtctagaagtatttgactagtttattactgtcagctagtatatgtagttggttttatcgttactttcggtcccgtaggaaccgtaagttggtatttcgaaggtaacgtaactggtacggtactgactaccgtattcgttagttttccattcccg

SEQ ID NO: 39372 - DNA, 649 bp, Homo sapiens
  misc_feature: GYAE6OF02I7SCO.10.20.B09.1.454.CMB.1.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccgtcagaatatgctaccaacttagcctggtatcaaacaaaagcctggccaggcctcccagacctcctcatctctggtgcatcttcggacggcctacgtggtctcccagcctaggttccaggtcggactaggtgggtctaggaacaggtacgttcactctaccaacctatccgacggccgtccgtagacgtacggtcgtaggtaaagttacgttttacggacttaaggttttacttacgttcgtacgtaacgtaccgttaagtaactttaaagtcggttaaccggttttagggttttttaaaccttccgtttaaccggttttccgggtacccgttagggtaaaaccctaaggttcggttacgtttacgaacggtaaccgtaacttgggtacgtcgttacgacctaccgttattccgttcgttacttcgtacc

SEQ ID NO: 39373 - DNA, 761 bp, Homo sapiens
  misc_feature: GYAE6OF02IX4EL.10.20.B09.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
tcagcatagtagtgcacgaccggtgctcgatttagtgtagtgtgaagggggaggaactgctcagttaggacccagacggaaccatggaagccccagctcagcttctcttcctcctgctactctggctcccagtttcagataccacggagagattgtgttgacacagtctccagccacctgtctttgtctaccgaggggaangccacctctcctgcagggccagtcagagtgttcggcgtcctacgtagcctaggtacccaacgagaaaccgtggaccaggcctacccgaggccccctnactctaggtcggtcgacactaccgaaacgacgggtccaacgtcggacctacgtccccgaagtcccgtaggtttaccaggttcggaccgtagggtcggggtacgtaggggaacctacggtacctttcgaaccgttcctaccgaacctctacacgttaccgacgtccgtaggaacgtaccgtaggtaacgtagttacggttacgtacgtttaagttttaacgttaacgttacgttaaccgtaaacctacgttaccggtaaccggtagggttaccgggtccccgggttacccgggggtacccttaaccgggtttcccgggtacccgtaacggggtaaaccgtaaacgggttacggttaacgttacgtaaccgtaaaacgggtaccgttacgggttacggtaccgttaccggtacctaaccggttaaccgttcgttaccgtttaccgttaccgttaacgtttccccg

SEQ ID NO: 39374 - DNA, 498 bp, Homo sapiens
  misc_feature: GYAE6OF02FMST9.10.20.B09.1.454.CMB.1.raw
  modified_base (194)..(194): a, c, t, g, unknown or other
  misc_feature (194)..(194): n is a, c, g, or t
  modified_base (316)..(316): a, c, t, g, unknown or other
  misc_feature (316)..(316): n is a, c, g, or t
  modified_base (495)..(495): a, c, t, g, unknown or other
  misc_feature (495)..(495): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctccccagactcctcatctctggtgcatcttcgagggccactggtntcccagccaggttcagtggcagtgggtctggaacagagttcactctcaccatcagcggcctgcagtctgaagtatttgctagtttaattactgtcagcagtataatgacttgggttttattctactttcggccctggaccaagtgtattcagacgaatgtggctgcaccatctgtcttntac

SEQ ID NO: 39375 - DNA, 554 bp, Homo sapiens
  misc_feature: GYAE6OF02H3MDQ.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgccagggccggtcagaatattgctaccaattagcctggtatcaacaaagcctggccaggctcccagactcctcatctctggtgcatcctggaggccactggtcgcccagccaggttcagtggccaggtgggtctggaacagtagttcatctcacatcagcgcctgcagtctagagtatttgctagttttattacttgtacagctagtaattaagtgtacgtttgggttttactttacgtacgttttccggcccgttagggaacctaaagttggtacgtttcaaggtaacgttaaccgttggtacggcttacggcctaccgtattccgttacgttccttactacg

SEQ ID NO: 39376 - DNA, 519 bp, Homo sapiens
  misc_feature: GYAE6OF02JC3NM.10.20.B09.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (350)..(350): a, c, t, g, unknown or other
  misc_feature (350)..(350): n is a, c, g, or t
  modified_base (407)..(407): a, c, t, g, unknown or other
  misc_feature (407)..(407): n is a, c, g, or t
tcagcatagtagtgcacgaccggtgctcgatttagtgtagtgtgaaggtggaggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcagggccgtnagaatnttgctaccaacttagcctggtatcaacaaagcctggccaggctcccagactcctcatctctggtgcatctcgagggccactggtcgtcccagccaggttcagtggcaggtgggtctggaacngagttcactctcaccatcagcggctgcagtctgagtatttgctagtttatactgtcngctagtataatgtacgttgggttttacttcgtacgtttccggtcccgttagggaccgtaagtggtactttcgaggtacgaacgtgtacggctgactacctatctgttcttac

SEQ ID NO: 39377 - DNA, 768 bp, Homo sapiens
  misc_feature: GYAE6OF02H337Z.10.20.B09.1.454.CMB.1.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcgagggccggtcagtaatattcgcctaccaacttgcctaggtactacaaacaaagccgtaggccaggtcctcccgaagtacctcctacacttcgtcgtggtcactattcgttccggacgggcctacgttcggtacgtcccgaggtcccgtaggttccaggtcggaccgttaggttcggggtactacgggaaaccaggttaacgttcctaacgttcctaccaacccgtagttacccgagggtcccggtcccgttaggaccgttaacggtaccgttagggtaaacgtttagttttaccggacgttttaaggttttaaccgtttacgtttacggtaccgtaacgttaccttaaacgtttaaacgtttaacgttacccggtaaccccttagtttaccctaaccgttacgttttcccgggaacccgttaggggtaaaaccccttaagggtaccggttaactttaaccgtaccggtaaacgggtacccgttaacggtacggtttcggacccgttacggtaccctaacccgttatttccggtttacccggtactttaacccgg

SEQ ID NO: 39378 - DNA, 597 bp, Homo sapiens
  misc_feature: GYAE6OF02HCH0G.10.20.B09.1.454.CMB.1.raw
  modified_base (196)..(196): a, c, t, g, unknown or other
  misc_feature (196)..(196): n is a, c, g, or t
tcagcatagtagtgcacgaccggtgctcgatttagtgtagtgtgaaggggggaggaactgctcagttaggacccagacggaaccatggaagccccagcgcagcttctcttcctcctgctactctggctcccagacaacactgcagaaatagttatgacgcagtctccagccaccctgtctgtgtctccaggggganagagcccaccctctcctgcagggccggtcagaatattgctaccaacttagcctggtatcaacaaaagcctggccaggcctcccagacctcctcatctcgtggtcgctatcttcggacgggccacgtggtcgtcccagccgaggttcaggtggctaggtcgggtcgtggaacagtagttcactctacaccatcgagccggcctgcagtctaggtaagtattttgacttagtttattacttgtacagtactaagttaactaagtagttacgtttgggtttttacttaccgttacgttttccgggtcccgttagggtaacctaagggttcggttactttacgacggtaacgtacgttggtcggtcttagacctaccgtagtttcgtacggtttcttacgtaccg

SEQ ID NO: 39379 - DNA, 659 bp, Homo sapiens
  misc_feature: GYAE6OF02JHY7E.10.20.B09.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtntctccaggggganagacgcccaccctctcctgccaggggccgtcaagaatattgcctaccaattagcctggtatacaacaaaagcctggccaggcctcccagtacctcctcacttcctcgtggtcgctacttcgttcggacgggtccacgtggtcgtcccgagtcccgtaggttccaggtcggcgtaggtcgggtactagggaactaggtacgttacacctcgtccaacctactcgaggcccggtccgtagaccgtacggtacctaggaaacgttacgttttgaccgttaaggttttacttaaccgtgttaccagtacgtaagtattaacgtggttacgttttagggtttactttaccggtaccgttttaccggtacccggttaggtaaccttaaggttcggttagtttacgaacgtacggtaacgttggtaccggtcgtacgtaccgacttccgtgtttacgttccttataacccg

SEQ ID NO: 39380 - DNA, 516 bp, Homo sapiens
  misc_feature: GYAE6OF02GQD82.10.20.B09.1.454.CMB.1.raw
  modified_base (194)..(194): a, c, t, g, unknown or other
  misc_feature (194)..(194): n is a, c, g, or t
  modified_base (390)..(390): a, c, t, g, unknown or other
  misc_feature (390)..(390): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaaagcctggccaggctcccagactcctcatctctggtgcatcttcggagggccactggtgtcccagccaggttcagtggcagtgggtctggaacagagttcactctcaccatcagcggcctgcagtctgaagtntttgctagtttattactgtcagcagtataatgtacttgggttttattcgtacgttttcggccctgggaacctaagttggtatttcgagtacgtaacttggtggctgccacctatctgtcttcgtac

SEQ ID NO: 39381 - DNA, 560 bp, Homo sapiens
  misc_feature: GYAE6OF02G9HAW.10.20.B09.1.454.CMB.1.raw
  modified_base (195)..(195): a, c, t, g, unknown or other
  misc_feature (195)..(195): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (386)..(386): a, c, t, g, unknown or other
  misc_feature (386)..(386): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccacctctcctgcagggccgtcagaatattgctaccaacttagcctggtatcaaacaaaagcctggccaggctccagacctcctcatctctggtgcatctcgaggccacgtggtctccagccaggttcagtgcagtggtctggaacngtagtcactctcacntcgacgcgcctgcagtcgtagaatntttgcttagtttattacgtgtcagtcaagttataagtgtacgtttagggtttttactcgttacgtttccggtaccggttagggaaacctaaaggttgtacgtttacgaaggtaacgtaagttcggtacggtcgttacggacctaccgtattccgttcgttaccttcttaacccg

SEQ ID NO: 39382 - DNA, 513 bp, Homo sapiens
  misc_feature: GYAE6OF02GHPK2.10.20.B09.1.454.CMB.1.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (368)..(368): a, c, t, g, unknown or other
  misc_feature (368)..(368): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctntcctgcagggccggtcagaatattgctaccaacttagcctggtatcaacaaagcctggccaggctcccagactcctcatctctggtgctatcttcgagggccacgtggtgtcccagccaggttcagtggcaggtgggtctaggaacagagttcactctcaccntcgagcgctgcagtctgaagtatttgctagtttatactgtcgagtcagtataagtgtatttggttttatacgtactttccgtccgtaggacctaagtgtattcgagtacgtaactggtgcgtgctaccgtnttcgtgttctntac

SEQ ID NO: 39383 - DNA, 676 bp, Homo sapiens
  misc_feature: GYAE6OF02JPUKH.10.20.B09.1.454.CMB.1.raw
  modified_base (181)..(181): a, c, t, g, unknown or other
  misc_feature (181)..(181): n is a, c, g, or t
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (394)..(394): a, c, t, g, unknown or other
  misc_feature (394)..(394): n is a, c, g, or t
tcagcatagtagtgcacgaccggtgctcgatttagtgtagtgtgaaggggagggaacgtgctcagttaggacccagacggaaccatggaagccccagcgcagcttctcttcctcctgctactctggctcccagacaacactgcagaaatagttatgacgcagtctccagcccaccctgtcngttcgtctccgagggganagagcccacccgtctcctgcacgggcccggtcaggaactnttgacctaccaattacgcctggtaatcaaataaacgcctggccaaggccctaccacgacctcctcagtcctcgtggcgcatcttcggacgggtccacgtggtccgtcccgagtccgtagttccgaggttcggcgtaggttcggtcgtaggaaacncggtaattcccaacttcccgactaacccagttccgacgggtaccgtccgttcggccgttaagtcccgtaggtaaacgttagtttcgaccgttaagttttactacgttggtacctacgtacgttataacgttacgtggttaacgtttagggttttaccttactccggttttaccggcccggttaacggtaacgtaagttcggttaacttcggaacgtaaccggttaagtcggtcgttaaccgtgtaccgacctaagttcgtttaccgttacgtttacgtaccg

SEQ ID NO: 39384 - DNA, 863 bp, Homo sapiens
  misc_feature: GYAE6OF02JFAL0.10.20.B09.1.454.CMB.1.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcgagggccgtcagaatattgctaccaacttagcctggtatcaacaaagcctggaccaggcctccagacctcctcactctacgtggtcgctatccgttacggacgggtccctaacgttgggttaccgtaccccgaggtcccgtaggtttccgaggttcggaccgtagggttcggggtaccgttacgggaaacgtaggtacgttacacgttccgtaccgaacccgtatccgaacggccggtacccgtacggaccgtaacggtttaccgtagggtaaacggtttacgtttttacgaccgttttaacgtttttaacgtttaccgtttcggttaccgtaacggtaaccgtttaaaggtttaaacgttaaacgtttcgggtttaaaccggtttttacggggtttttttaaacctttacccggttttaacccggttttttccccggggtaaccccgggttttaaacggggttaaaaccccgttaaaggggtttaccggggttttaaccgtttttaaccgggaaaccggggtttaaacccggtttaaaccgggtttacggggtttaaccgggtaccgttttacccggggaacccctttaacccggtttaccgttttacccggtttaccgggttttaccctttacccggtttaaccccgg

SEQ ID NO: 39385 - DNA, 572 bp, Homo sapiens
  misc_feature: GYAE6OF02GXUDD.10.20.B09.1.454.CMB.1.raw
  modified_base (401)..(401): a, c, t, g, unknown or other
  misc_feature (401)..(401): n is a, c, g, or t
  modified_base (423)..(423): a, c, t, g, unknown or other
  misc_feature (423)..(423): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagcccaccctctcctgcagggccggtcagaatattgctaccaacttagcctggtatacaacaaaagcctggccaggcctcccagacctcctcatctcgtggtgcatcttcggacgggcctacgtggtcgtcccgacgtccgtacggttcaggtcggcgtagggtcgggtctagggaacaggtacgttcacgtctacaccatcgngcgcctgctaggtctagaagtntttagcttagtttattactgtcagtcagtatagtgtacgtttaggttttatcgttacgttttccgacccgttaggaacctaaggtggttatttcgaacggtacgtaacgttggtggacctggtaccacgtattccgtgttccttatacc

SEQ ID NO: 39386 - DNA, 640 bp, Homo sapiens
  misc_feature: GYAE6OF02GDYK2.10.20.B09.1.454.CMB.1.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgcccaccctctcctgcgagggccgtcaagaatattcgactaaccaacttagccttggtactacaaacaaacgcctcggaccaggcctacccgagacctcctcacttcctcgtggtgctagttcgttacggacggcctacgtcggtcgtcccgaggtccgtaggttcaggtcggcgtagggtgggtctagggaacgagtacgttccacttcctaccaacctacgtacgacggtcccggtccgtcgaccgtagttcgtaggtaaagtttacgtttgacgtttagtttacttacgttgttacgagtacgtaagttaactagttacgttaacgtttggtttttactccgttacggttccgaccgtaggtaacgtaagttcgtactttacgacggtaacgtacgttaggtcgtactcgtacctactagttcctgttccttacgtcc

SEQ ID NO: 39387 - DNA, 545 bp, Homo sapiens
  misc_feature: GYAE6OF02GMOBK.10.20.B09.1.454.CMB.1.raw
  modified_base (541)..(541): a, c, t, g, unknown or other
  misc_feature (541)..(541): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaaacaaaagcctggccaggctcccagacctcctcatctctggtgcatcttcggagggccacgtggtcgtcccagcccgtaggttcaggtggcaggtggggtctagggaacaggtagttccactctaccaccatacgaggccggcctggcgtaggtcgtagtaaagtactttgacttagttttattacgtgtcagtctagtataatgtacgttggtttactcgtactttcgcctaggaactagtgtattcgagacgtactggtcgtctgacctacgtattcgtcgttctntacg

SEQ ID NO: 39388 - DNA, 538 bp, Homo sapiens
  misc_feature: GYAE6OF02GJEWD.10.20.B09.1.454.CMB.1.raw
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtcagaatattgctaccaacttagcctggtatcaacaaaagcctggccaggctcccagacctcctcatctctggtgcatcttcgagggccactggtcgtcccagcccgtaggttcaggtgcgagtgggtcgtggaacagagttcactctcaccatcagcgcctgcngtcngaagtntttgcctagtttattactgtcagcagtaataatgtacgttgggttttattctacttttccggccttggaacctaaggtgtacttcgaaggtacgtaacgtggtacgtcgtgacctaccgtacgttccgtgttccgttcttaccg

SEQ ID NO: 39389 - DNA, 532 bp, Homo sapiens
  misc_feature: GYAE6OF02FUUN5.10.20.B09.1.454.CMB.1.raw
  modified_base (194)..(194): a, c, t, g, unknown or other
  misc_feature (194)..(194): n is a, c, g, or t
  modified_base (297)..(297): a, c, t, g, unknown or other
  misc_feature (297)..(297): n is a, c, g, or t
  modified_base (519)..(519): a, c, t, g, unknown or other
  misc_feature (519)..(519): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaaacaaaagcctggccaggcctcccagacctcctcatctctggtncatcttcggaggccacgtggtcgtcccagccgtaggttcaggtcggcaggtgggtctagggaacaggtagttccacgtcctaccaccatcgacggccggtcctgctagtctaggtaagtatttcgacttagtttattactgtcagtctagtatatgtagtttggtttatctcgtttcgcctaggacctaagtgtattcgagtacgtatggtcgtctgcactntctgtccttatcc

SEQ ID NO: 39390 - DNA, 679 bp, Homo sapiens
  misc_feature: GYAE6OF02J0HY8.10.20.B09.1.454.CMB.1.raw
  modified_base (194)..(194): a, c, t, g, unknown or other
  misc_feature (194)..(194): n is a, c, g, or t
  modified_base (249)..(249): a, c, t, g, unknown or other
  misc_feature (249)..(249): n is a, c, g, or t
  modified_base (284)..(284): a, c, t, g, unknown or other
  misc_feature (284)..(284): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatgttatgacgcagtctccagccaccctgtctgtgtctccgagggganagacgcccacccttctcctgcagggccgtcagatatgctacaattgctgatcaanaaagctgcagctccagactcctcatctcgtggtcncactcttcggacgggccacgtggtcgtcccgagcccgtaggttccaggtcggctaggtcgggtcgtagggaacaggtagtttccgaacctccgttacaaccctacgtacgtaccggcggtcccgttgaccgtacgttacgtagtaacgttacttttacgacttaagttttagttaacctttcggttaccgtagtacgtaagttaacgtttaacgttgttaacggttttcgggtttttaacttccgttaaccggttttccgggtaccccgttaggggtaaacccttaaagggttcggttaactttaccggaacggtaacgttaacggttcggttacgggtaccgttacgggtaccttaaccgtacctttaccggtcggttacctttaccgtaaccg

SEQ ID NO: 39391 - DNA, 700 bp, Homo sapiens
  misc_feature: GYAE6OF02GV7GF.10.20.B09.1.454.CMB.1.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (291)..(291): a, c, t, g, unknown or other
  misc_feature (291)..(291): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctntccngaccgagggccgtcaagaatattgctaaccaacttagcctggtacacaacaaaagcctggccacggcctaccagactccnctatcctctggtcgctatcgttcgacggtccactggtcgtcccagccgaggttcgaggtggccagggttgggtcgtaggaacgacggtagtacctacctcgtaccacgtagtcgacgtccgggtcctggctaacggttctaacgggtaatttacgtttcgaacgttacgttttttaacgttaacgttcggtactactaacggtaattaagttaaacttcgggtaaccgtttttacggggttttttaactttccgtaacccggtttttcgggaaccccggttaacgggaaaccgttaaacgggttagggtttaccttttaccggaaacgtaaccgggttaactttccggggacgttaccgttcgaacccgttaccctagttacggtttacggttaccctttactacccgg

SEQ ID NO: 39392 - DNA, 861 bp, Homo sapiens
  misc_feature: GYAE6OF02H7PCJ.10.20.B09.1.454.CMB.1.raw
  modified_base (194)..(194): a, c, t, g, unknown or other
  misc_feature (194)..(194): n is a, c, g, or t
  modified_base (324)..(324): a, c, t, g, unknown or other
  misc_feature (324)..(324): n is a, c, g, or t
tcagcatagtagtgcacgaccggtgctcgatttagtgtagtgtgaaggggaggaactgctcagttaggacccagacggaaccatggaagcccagcgcagcttctcttcctcctgctactctggctcccagacaacactgcagaaatagttatgacgcagtctccagcccacctgtctgtcgtctccgagggganagacgcccaccctctccgtgcgaggggcccgtagaagaacttagttcgactaccctaacgttagcccgttaggtaactacgaaaacaaaacgccgtggaccaacggcctaccccgaagtaacctccctanacttcctctaggtcactacttccttacggaccggtcctacggtggttccgtacccgagtacccgtaagggtttccaaggtggccggtaaggtcgggttacaggggtaaaccctgggtaactttcccgaatttccgacctaaaccgtcgtcgtaaccggtcggtcccgttacggtaccgtaaggttaccttaacggggtaaacgtttacggtttttaacggtcttaaacgggttttttaactttaaacggttacggttacgtaaccgtttaacgtaaggtttaaaacgttaaacggtttaggtttaaaccgggtttttaacgggttttttaacctttacccgggtttaacccggtttttttaccggggaaccccgggttttaaacgggtaaacccggtttaaaaggggttaccgggttaacgttttaccgtaacgggtaaacccgggttaacggtttacgggtacggttaccgttaccggtaccgttaaccgtttaaccggttccggtttaccgtttaccggttaacctttacccggg

SEQ ID NO: 39393 - DNA, 745 bp, Homo sapiens
  misc_feature: GYAE6OF02I8QG0.10.20.B09.1.454.CMB.1.raw
  modified_base (191)..(191): a, c, t, g, unknown or other
  misc_feature (191)..(191): n is a, c, g, or t
  modified_base (304)..(304): a, c, t, g, unknown or other
  misc_feature (304)..(304): n is a, c, g, or t
  modified_base (390)..(390): a, c, t, g, unknown or other
  misc_feature (390)..(390): n is a, c, g, or t
  modified_base (425)..(425): a, c, t, g, unknown or other
  misc_feature (425)..(425): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagtatgacgcagtctccagccaccctgtctgtgtctcgagggngagcgccacctctcctgcacgggccggtcagaacttatcgcctaacctaacttacgccttaggtaactccaaaactaaaacgcctcgggccaggtcctcccaacgaccttccnctatccgttctagggtcactattccgttcggacggcctagtcggtcgtccccagtcctaggttcacgttggactaggggttcggtntaacgggacgtagagtttacacctctaccaccgtntacgacggccggtaccgtcggactacggttccgtaaggtaaacgtttagtttcggtaaccgttagtttttaacgttacgttttcggtacgtaacgtacgttaacgtaaattaacgttacggtttacgtttttacgggttttttactttacccgttaaccggttttttcccgggtaccccggttaagggtaaaccccgttaaaggtttcgggtttaaccgtttttaccggaaacgggttaacccgttaacggttgggttaccggtaccgttggaaccctttacggtaaccttccgtttacggtttccgttaccgtttaccg

SEQ ID NO: 39394 - DNA, 503 bp, Homo sapiens
  misc_feature: GYAE6OF02FIDN2.10.20.B09.1.454.CMB.1.raw
  modified_base (500)..(500): a, c, t, g, unknown or other
  misc_feature (500)..(500): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggctgcagtctgaagtatttgctagttttattactgtcagctagtataatgtattgggttttattctacttttcggcccttgggacctaaagtggtattcagtacgaactgtggctgcacatctgtctntac

SEQ ID NO: 39395 - DNA, 741 bp, Homo sapiens
  misc_feature: GYAE6OF02FHXTH.10.20.B09.1.454.CMB.1.raw
  modified_base (314)..(314): a, c, t, g, unknown or other
  misc_feature (314)..(314): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcagaaatagttatgacgcagtcctccagccaccctgtctgtgtctcgaggggagagacgcccaccctctcctgccgaggggcccggtcagaatattcgctaaccaacgttacgccttggtactacaaacaaaagccgtggccaggcctcccagtacctcctcatctctggtnctattcgttcggacgggccagtggtcgtcccgacgcccgtaggttcaggtcggacgtagggttcggggtcgtagggaaccgaaggtacgtttaccgaccttcccgtaccaacctaactccgacggtcccggtaccgtggacctaggttaccgtaggtaaaggtttacttttacggactttaaggtttttacttaaccgtttcgttacgacgtacgtacggtccggttaccgtacccgttacggttttccggggaccgggttacggttccggtacccgtttaaccgggtttcccggggacgggttaaacggggaaaccctaaaaggttacgggtaaccgggtaaccgtaaaaccggtaacggttccgggttacggtaccgttaccggaaccctaacccgttagttcccgttacggtttcccttaaccg

SEQ ID NO: 39396 - DNA, 542 bp, Homo sapiens
  misc_feature: GYAE6OF02INMY1.10.20.B09.1.454.CMB.1.raw
  modified_base (194)..(194): a, c, t, g, unknown or other
  misc_feature (194)..(194): n is a, c, g, or t
  modified_base (403)..(403): a, c, t, g, unknown or other
  misc_feature (403)..(403): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctcgagggganagagccaccctctcctgcagggccgtcagaatattgctaccaacttagcctggtatcaacaaaagcctggccaggctcccagactcctcatctctggtgctatcgttcgacggccactggtcgtcccagcctaggttcaggtggcaggtgggtctgggaacaggtagttcactctacaccatcgagcgcctagcgtatcgtagtaagtntttgacttagtttacttacgtgtctagtcgtagtaattatgtagtttggttttatcgttacgttccgtccgtaggtaactaagtgtacttacgacgtacgtaagttgtagtcgtacgactacgtatctcgttctatccg

SEQ ID NO: 39397 - DNA, 556 bp, Homo sapiens
  misc_feature: GYAE6OF02IYBRS.10.20.B09.1.454.CMB.1.raw
  modified_base (195)..(195): a, c, t, g, unknown or other
  misc_feature (195)..(195): n is a, c, g, or t
  modified_base (543)..(543): a, c, t, g, unknown or other
  misc_feature (543)..(543): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcagggccgtcagaatattgctaccaattagcctggtatcaaacaaagcctggccaggcctcccagacctcctcatctctggtcgctatcgttcggacgggtccacgtggtcgtcccagccgtaggttcaggtcggctaggttcgggtctagggaactaggtacttcactctacactatccgagtccggcctgactagtctaggaagttgtttacgacttagtttattacgtgtcagtctagttataagtgtacgtttggtttacttctacgtttccgccgttaggaacctaagtcgtatttgagtacgtacgtggtcgcgtagactactntctcgttctctac

SEQ ID NO: 39398 - DNA, 547 bp, Homo sapiens
  misc_feature: GYAE6OF02GGVS0.10.20.B09.1.454.CMB.1.raw
  modified_base (294)..(294): a, c, t, g, unknown or other
  misc_feature (294)..(294): n is a, c, g, or t
  modified_base (364)..(364): a, c, t, g, unknown or other
  misc_feature (364)..(364): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtnctatcttcggacgggccacgtggtcgtcccagccaggttcagtgcagtcgggtctggacagagtcactcncaccatcagcgctgcagtctgagtatttgctagtttatactgtcagcagtactaatcgtagttggttttacttcgtacgtttccggtccctagggtaaccaaggttcggtactttacgacggtaaccgtaacgttcgggtcggtcgtacgtcctacctagtccgttcgttaccttcttaaccg

SEQ ID NO: 39399 - DNA, 623 bp, Homo sapiens
  misc_feature: GYAE6OF02GBYZJ.10.20.B09.1.454.CMB.1.raw
  modified_base (195)..(195): a, c, t, g, unknown or other
  misc_feature (195)..(195): n is a, c, g, or t
  modified_base (618)..(618): a, c, t, g, unknown or other
  misc_feature (618)..(618): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcgagggccggtcagaatattgacctaccaacttagcctggtactacaaacaaacgcctggccaggcctccgagacctcctacattcctcgtggtcgctactcgttcggacgggcctacgttggtcgtcccagccgtacggttcaggtcggacgtaggttggtcgtaggaacgaggtacgttcgactctaccgacctatcgacggcgtacctgacgtagtcgtagaacgtttctttagaccgttaagttttacttacgtcgttacgacgtactaagttaattagtggttaacgtttgggttttattccgttacgtttccgaccggttaggaacttagggttcgttattcgtaaggtaacgtagttggtcgtacgtagtcctaaccgttgttccgttcgttaccttntaccg

SEQ ID NO: 39400 - DNA, 640 bp, Homo sapiens
  misc_feature: GYAE6OF02IIJ9P.10.20.B09.1.454.CMB.1.raw
  modified_base (197)..(197): a, c, t, g, unknown or other
  misc_feature (197)..(197): n is a, c, g, or t
  modified_base (635)..(635): a, c, t, g, unknown or other
  misc_feature (635)..(635): n is a, c, g, or t
tcagcatagtagtgcacgaccggtgctcgatttagtgtagtgtgaaggggggaggaactgctcagttaggacccagacggaaccatggaagccccagcgcagcttctcttcctcctgctactctggctcccagacaacactgcagaaatagttatgacgcagtctccagcccaccctgtctgtgtctccgagggganagacgcccaccctctcctgcacggggccgtcagaatattgactaccaacttagcctggtactcaaacaaaagcctggccaggcctcccagtactccctcatctcgtggtcgctatcgttcggacggtccacgttggtcgtcccgagtccgtaggttcgaggtcggcgtaggttcgggtcgtaggaaacgtaggtacgttcaaccttctaccaacctatccgaggtcccggtccctgaccgtagttacgacggttaagttagtttacggctttaagtttactttactcggttacacgtactaaggtaacgttaattcggttaacgttttacggttttacttaccgttaccggtttcccggtaccggtacgggtaaccgtaaggttcggtattaccgtaggaacgttacgtggtcgctacgccactcgtactgttacctntaccg

SEQ ID NO: 39401 - DNA, 571 bp, Homo sapiens
  misc_feature: GYAE6OF02FYP78.10.20.B09.1.454.CMB.1.raw
  modified_base (397)..(397): a, c, t, g, unknown or other
  misc_feature (397)..(397): n is a, c, g, or t
tcagcatagtagtgcacgaccggtgctcgatttagtgtagtgtgaagggggaggaactgctcagttaggacccagacggaaccatggaagccccagcgaagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctccagactcctcatctctggtgcatccttcgacgggccactgggtctcccagccaggttcaggtggcaggtgggtctggaacaggagttcactctcaccatcagccggcctgctagtctagaagtnttttgctagtttattacttgtcagcaagtattaagtgtacgtttgggtttttaacttcgtaaccgttttccggacccgttagggaaccctaaaggttgggtaactttcgaagtaccggtaagtggttacggccttcggacctaaccgtatccgttgtcgtttaccatttccccg

SEQ ID NO: 39402 - DNA, 844 bp, Homo sapiens
  misc_feature: GYAE6OF02GY5NM.10.20.B09.1.454.CMB.1.raw
  modified_base (195)..(195): a, c, t, g, unknown or other
  misc_feature (195)..(195): n is a, c, g, or t
  modified_base (815)..(815): a, c, t, g, unknown or other
  misc_feature (815)..(815): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctccgtgcgacggggtcccggtacaagtaattacttcgaccttaaccctaacgtttacggcccttagggttaacctaaccgaaaaaccgaaaacggtcccgtacgggacccgtaacggtaccttaccccgaacgtacccttcccgttacctaacttcccgtcgttcggtacgaccttacgttccgttacgggaccgggccctacggttcggtacccgtaccgtaccggccgtacggttacgacgggttcgaccgtaggggtttcggttacgtacggtaaacgtacggttacgttacctaccgttaccctaccgtaaaccgtactaccggtacggtcccgggtacccgttcgggtaccgttaacgttaccggtaaagttaaacggttttacgtttacgtaccggtttaaacgttttacgttaaccggtttcaacggttactaacggttaatttaaacggttaaggttcggtttaaaccggttttacggttttactttaccgggttaccggtttaccgggtaaccggtaggttaaccggttaagttacgtttacgtaacgtaaggtaaccggtagtttaccgggtacgtacttaccggacttaccggttnttaccggttacttaccgttccttacccgg

SEQ ID NO: 39403 - DNA, 668 bp, Homo sapiens
  misc_feature: GYAE6OF02H7OOZ.10.20.B09.1.454.CMB.1.raw
  modified_base (154)..(154): a, c, t, g, unknown or other
  misc_feature (154)..(154): n is a, c, g, or t
  modified_base (195)..(195): a, c, t, g, unknown or other
  misc_feature (195)..(195): n is a, c, g, or t
  modified_base (663)..(663): a, c, t, g, unknown or other
  misc_feature (663)..(663): n is a, c, g, or t
tcagcatagtagtgcacgaccggtgctcgatttagtgtagtgtgaagggggaggaactgctcagttaggacccagacggaaccatggaagccccagcgcagcttctcttcctgctgctactctggctcccagacaacactgcagaaatagttangacgcagtctccagcccacctgtctgtgtctccgagggganagacgcccaccctctcctggcgacggggccgtcaagaattattcgacctaaccaaacttgcctaggtatacaaacaaaacgcctggaccgaggcctacccagtaccttccctactactccgttcgttggtcgactacgttccgttaccggacggccctaacgttcgggtcgtaccccgagcccgtaggttcgaggtcggcgtaggtcggtctaggaacgaggtacgttcacgtcctaccacctagtccgacggcccggtactggactacgtactaggtaattagttttacgacgtttaagtttacgttacgttgtaccgtagtacttaaaggtaattaacgttagttacgttttagggttttacttaccgttaccgttttccggacccgttaagggaaccttaaggtcgttatttacggaacgttacggtacgttggtacgtcgtgtaccaccgttatcgtttacgtnttacg

SEQ ID NO: 39404 - DNA, 501 bp, Homo sapiens
  misc_feature: GYAE6OF02GLAYS.10.20.B09.1.454.CMB.1.raw
  modified_base (194)..(194): a, c, t, g, unknown or other
  misc_feature (194)..(194): n is a, c, g, or t
  modified_base (389)..(389): a, c, t, g, unknown or other
  misc_feature (389)..(389): n is a, c, g, or t
  modified_base (417)..(417): a, c, t, g, unknown or other
  misc_feature (417)..(417): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgccagggccgtcagaatattgctaccaacttagcctggtatcaacaaaagcctggccaggctcccagactcctcatctctggtgcatcttcggaggccacgtggtgtcccagccaggttcagtggcagtggtctggaacagagttcacgtctcacatcgagcggctgcagtctgaagtntttcgctagtttattctgtcagcagtanatcgtagttggttttattctacgtttcgcctaggactaagtgtattcagtcgaacttggtgcgtagcactattctgttctctac

SEQ ID NO: 39405 - DNA, 742 bp, Homo sapiens
  misc_feature: GYAE6OF02F7L7S.10.20.B09.1.454.CMB.1.raw
  modified_base (340)..(340): a, c, t, g, unknown or other
  misc_feature (340)..(340): n is a, c, g, or t
tcagcatagtagtgcacgaccggtgctcgattagtgtagtgtgaagggtaggaactgctcagttaggacccagacgaaccatgaagccccagcgcagcttctcttcctcctgctactctggctcccagacaacactgcagaaactagttatgacgcagtcctccagccaccctgtcctgtgtcctcccgaggggtacagacgccctaccccttctccctgccgacgggcccgttcagacttctcggcctaccacttacggcccttaggtactaccaaacgaacgccctgggcccacgggccttaccccaggaaccctccctcctactccttccgtgttcnctaattcgttcgacggtccacgtgtacgtccccagtccccgtaggttcgacggttcggctagggttcgggtccttagggaaaccaggtaccgtttccaacctttccgacccaccctagtccgacggtcccgtccgtacgcctaacggttcccgtaggtaaacgttacgttttacgtcccgttaaagtttaaccggttttaacctcggtttaccgaacgtaccgttaaggtaactttaaacgttcgggtaaccgttttacgggttttttaaactcccgttaacgttttcccggggaacccttacggggtaacctaaccgggttaggtacctttaccgagtaacccggtaacgtcgttacggtccgtacgtacccaccgtacttccgtccgtccttccgtaccc

SEQ ID NO: 39406 - DNA, 735 bp, Homo sapiens
  misc_feature: GYAE6OF02IY801.10.20.B09.1.454.CMB.1.raw
  modified_base (195)..(195): a, c, t, g, unknown or other
  misc_feature (195)..(195): n is a, c, g, or t
  modified_base (729)..(729): a, c, t, g, unknown or other
  misc_feature (729)..(729): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganaggagcccaccctctcctgcgacggggtccggtacaaggaatatcgctacctaattacgcctggtactaccaaacaaaacgtccgtggaccacggcctacccagacctcctcacttcctacgtggtacgctacgttccgttacggaaccggggtccaacgttcggggttaccgtacccccgtaaggtacccgtacggggttcaacggggtttcggaccgttaagggttcggggttacctaggggaaactacggttacgttaccaccgttcctaaccgtacccgtatcccggtaacgggtcccggttccgtagtccgtaacggttactacgggttaaagttcgttttacgacgtttaagttttaacgttcctgttacgagttactaacgttaataacgttggttacggttttagggttttaactccggttaaccggtttcgaacccgggttacggtaaaccgttaggtcgttaacgtttcgaacggttagtaaccggtgtacggtctgacccttatcgttaccgtgtttaccgtntaccgg

SEQ ID NO: 39407 - DNA, 536 bp, Homo sapiens
  misc_feature: GYAE6OF02GDQC6.10.20.B09.1.454.CMB.1.raw
  modified_base (410)..(410): a, c, t, g, unknown or other
  misc_feature (410)..(410): n is a, c, g, or t
  modified_base (532)..(532): a, c, t, g, unknown or other
  misc_feature (532)..(532): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagcccaccctctcctgcgagggccggtcagaatattgctaccaacttagcctggtatacaacaaaagcctggccaggcctccagacctcctcatctctggtgcatcgttcggacgggccacgtggtcgtcccacgccaggttcaggtggcaggttgggtctagggaacagtagttaccactctcacatcgagcgcctgcagtcgtagtaagtntttgcttagtttacttactgtacagtctagtataagtgtacgttggttttattctacgtttcggcctagggaacctaagtgtacttcgagacgtacgtggtcgctgactacattctctcttntacc

SEQ ID NO: 39408 - DNA, 749 bp, Homo sapiens
  misc_feature: GYAE6OF02GSGMK.10.20.B09.1.454.CMB.1.raw
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtcctccagcccaccctgtctgtgtctccgaggggnagacgcccaccctntcccgtgcgagggccggtnagtaatattcgctaccaattcgcctaggtactacaaacgtaaacgccgtaggaccgacggtcctacccgacgaccttcctctacttccgtcgtggtcgtactacttccgttacggacgggcctacgttggtccgtacccgacggtacccgtaggttaccgaggttcggacgtagggttcgggtacgtacgggaacgtaggtcgttaccacgttcctacccgtaaccgtagtaccgacgggtaccggtcccgtagtccgtacggttacgtaggttaaactttacgttttaggtacgtttaagttttaacttacgttaggtaccgacgttacgtaagttaactaacggtttacggttacggttttaggtttttaacgttaccgtttacccggttttccgggaccggtttagggtaaacccgttaagggtaccgtttacttacggaacggtaaccgttacggttaggtcggtacctacggtacctaacggttcgttacgttccggttacttaccgtttacccg

SEQ ID NO: 39409 - DNA, 599 bp, Homo sapiens
  misc_feature: GYAE6OF02IEUBD.10.20.B09.1.454.CMB.1.raw
  modified_base (194)..(194): a, c, t, g, unknown or other
  misc_feature (194)..(194): n is a, c, g, or t
  modified_base (364)..(364): a, c, t, g, unknown or other
  misc_feature (364)..(364): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcagggccggtcagaatattgactaccaacttagcctaggtaatacaaacaaaaagcctggccaggctcccagactcctcatctcgtggtgactatcttcggagggccaacgttggtcgtacccagcctaggttcaagtcggcaggtcgggtntaggaacaggacgttcacgtctacacatcaagcggtcctgctagtctagaagtattttcgattagttttaacttcgttagtacaaggtaataatggaagttgggacgtcggtcccgttaccgttacttacgttttggacccgtaaagggtaccgtaaagttcgggaacctaagtaacaaaacggtaacgttggacggtactgacctaacccgtatttaccgttcgttaccttacc

SEQ ID NO: 39410 - DNA, 929 bp, Homo sapiens
  misc_feature: GYAE6OF02GSKZG.10.20.B09.1.454.CMB.1.raw
  modified_base (195)..(195): a, c, t, g, unknown or other
  misc_feature (195)..(195): n is a, c, g, or t
  modified_base (318)..(318): a, c, t, g, unknown or other
  misc_feature (318)..(318): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcgacgggccggtacagaatattcgactacctaacttagcctggtactacgaaacaaacgtcctggaccaggcctacccgagtacctcctcacttccgtcgtggtcnctacgttccgttacggacgggccctacgttcggtccgtacccgtaggtcccgtaacggtttcgacggtcggtacgtacggggttacggggttccgtaacgggtaaacgtacggttaacggtttaccaacccgtttcgtaaccgaaccccgtagttacccggacgggtacccgggtcccgttgaaccggttacgttacgttaacgggttaaagtttacgttttacgggtacttttaaacggttttttaaccgtttaacgttccggttaaccgtaaacggttaccgttaaaagggttttaacctttaaaacggttttacggggtttaaacccgtttttttacgggggttttttaaacccttttacccgggttttaaaccccgggttttttccccggggtaacccccgggttttaaacggggttaaaaacccggtttaaacgggttttaccggggttttaaacgtttacccggttaaaaccggggttaaacccggttaaacccgggttttcggggttacccgggttaacccgtttaacccggtaaccccgtttaaccgttaaccgttttcccgggtttaacccggttttccctttaaccccgggtttacccccg

SEQ ID NO: 39411 - DNA, 634 bp, Homo sapiens
  misc_feature: GYAE6OF02FSJX8.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgccgagggccggtcagaatattgctaccaacttagcctggtatcaacaaaagcctggccaggctcccagactcctcatctctggtgctatcttcggagggccacgtggtcgtcccagtccgtaggttcaggtcggcgaggtgggtctagggaacagtagttcaactctacaccgtatcaggccggccctgacgtagtacgtaggtaacgtttagttcgacgtttagtttacgttactcgtactagacgtaagttaagtagttacgtacggttttagggtttacttccgttaccgtttccgtacccggtaacggttaaaccgtaacgggttcgttaacgttccggaaacgggtaaccgttagttccgggtacggttcgtacgtacccggtacccttgttaccgtttcgttacctacgttaccccg

SEQ ID NO: 39412 - DNA, 686 bp, Homo sapiens
  misc_feature: GYAE6OF02GJE5O.10.20.B09.1.454.CMB.1.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcgagggccgtacagaatattcgactaaccaacttacgcctggtatacaaacaaaacgcctaggaccaggcctaccccagtacctcctcattctcgtggtcgctattccgttcggacgggcctacgtggtccgtcccagccgtaggttcaggtggacgaggtgggtacgtaggaacaggtacgttacacgttacctaccgaacctacgtaccgaacggtcccgggtaccctggaccgtagttacgtagggtaaaacgtttgttttacggacgtttaagttttaactttaacgtggttacgaagtacgtaaagttaagttaaagttacggttaacggtttttgggttttttaacttccgttaaccggttttccgggaccccgttagggaaaccttaaaggttcggttaacgtttcgaacggtaacgtaacgttggtacggtactacgactaccgtattcttcgtcttacgtaccg

SEQ ID NO: 39413 - DNA, 623 bp, Homo sapiens
  misc_feature: GYAE6OF02IMOTC.10.20.B09.1.454.CMB.1.raw
  modified_base (195)..(195): a, c, t, g, unknown or other
  misc_feature (195)..(195): n is a, c, g, or t
  modified_base (452)..(452): a, c, t, g, unknown or other
  misc_feature (452)..(452): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgcccaccctctcctgcgacgggccggtcagaatattgcctaccaacttagcctggtactacaacaaaagcctggccaggcctaccagactcctcactctactggtcgctatccgttcggacgggccacgttggtcgtcccaggccctagggttcaggtcggacgtaggttcgggtacctagggaacaggtacgttccaacgttctaccaaccgtatcgacggccggccctagccgagttcgtacgtaaagttnttttacgacttacgttttattactagtacagtctaagtactatgtacgtttgtttatacgtacgtttccggccgtaggaaaccgttaagtgttattacgaacgtacgtaacgttgggttacgtacgtacggtcctaaccgttagtcccgttaggttacccttacgtacccg

SEQ ID NO: 39414 - DNA, 806 bp, Homo sapiens
  misc_feature: GYAE6OF02HV8XJ.10.20.B09.1.454.CMB.1.raw
tcagcatagtagtgcacgaccggtgctcgatttagtgtagtgtgaagggggaggaactgctcagttaggacccagagggaaccatggaagccccagctcagcttctcttcctcctgctactctggctcccagacaccaccggagaaattgtgttgacacagtctccagccacgcctgttcttgtcctccggaaggggaaagcgcccacccttcctccgtgacgacgggccagtcaggtagttgttcgactacgttcggttagggtgtactacaactaataacgtccggacgacggtccctaccgacggtcccttccgtactactttcgtttagtagttcgttcctttaaccgaaaccgggtacccgggtcccccggttcggggaccccgtaccccggacgggtaccggtaccgggttaccgagggttcggacggtacggggttcggggttaccggtacgggaccgtaacgttaccttaccgaacctttcccgtaccaacctaacgtaccgacggtaccgaaccgtaccgtaaggtaccggtacccgtaggtaaacgttttagttttacgtacgtttaagttttaacgttacgttcgtacgtacgtacgtacggtcgttcgtaccgttacggtttcgggacgggtaggtccgtaccgttacggttccggggaacgggtaacggtaaaccgtaaacggtaacggaacgggtaaccgaacggtaacgttcgggtacggtcgtaccggacctaaccgttacgttacgtaccgtttaccttacgtaccctttcccgttacccgacttaccg

SEQ ID NO: 39415 - DNA, 669 bp, Homo sapiens
  misc_feature: GYAE6OF02HBVA7.10.20.B09.1.454.CMB.1.raw
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctccctgccgaggggccggtcagtaatattgctaccaacttagcctggtactacaaacaaagcctggccaggcctcccagacctcctcatctctggtncactccttcggagggccctacgtggtcgtcccaggtccgtaggttccaggtcggcgtaggtgggtctaggaacnggtaacgttcaacttctaccgacatcgacgccgggtcctggacctaggttcgtaggtaaagttacgttttcgaccgttagttttactttacgtgttaccaagtcctaaaggttacttaaggttacggttaaccgttttggggttttaacttaccgtttaccgtttcccggtaccggttaacggaacgttaaaggtggttactttacggacggtaaccggtacgttagggtaccggtacgttacgaccgttaccgtagtttcggttaccgtttaccgttacgttaacccg

SEQ ID NO: 39416 - DNA, 812 bp, Homo sapiens
  misc_feature: GYAE6OF02JVEHJ.10.20.B09.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctcgagggganagacgccacctctcctgcgacgggccgtcagaatnttcgactaactaaacttcgcctaggtactacaaacaaaacggtcctggaccaacgggccttacccgaagtaccttcctcattcctcgtagggtcactactcgtttaccggacggtacctacgtcggtcgtacccgtggaccgtacggttcgaaggtcgggacttacgggtcggggttaccgaacgggtaaacgaggttaaacggtttaccgtaccgtacccgttaacctaaccgaacgtacggtaaccggccgggttccctaagggtcccgtaaagggttcgttaaaccggggttaagtttaaacgttttttccgggaaccgttttaacggttttttaaggtcctttacggtacgttaacgggaaccgttaaagttttagttaaacggttttacgggtttaacggtttttcgggttttaaaaccgtttccggtttaacccggttttaccgggacccggtttaaacggggaacgtttaacgggttcgttacgtttacgtaaaccgggtaacgttaacggttcgggtacggtaccttaacggggaacccttataccggttttacgcttttaccgtagtttaccccg

SEQ ID NO: 39417 - DNA, 871 bp, Homo sapiens
  misc_feature: GYAE6OF02I2ESE.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagcccccagcgcagcttctcttcctcctgctactctggctcccagacaacactgcagaaatagttatgacgcagtctccagccaccctgtctgtgtctccaggggnagagcccaccctctcctgacgacgggccggtcagaatagttcgcctaccaacgttacgcctaggtactcaaacaaaagtccgtaggcccgtacggcctccccgaacgaccttcctacctaacgtccttcgtaggtcggtcctaacgttccgtttcggaaccggggtccctaaccgttcgggtttaccgttacccccgacggtccccgtaaggggttttccaccggggttcggacccggtagggtttacggggttaccgttaacggggaaacgtacggtaacggtttacccgaccgttacccgttaccctaacccgtacgttaccgaacgggtccccgggtcccgtacggccgttaacggttccgttaaggtaaacgttttacgtttaccggttacttaacggtttttacgtttaccgttacgttacgttacgacgttaacggttaagttaaacgtttacgggttaaccgttttttaggggttttttacttttaacccgtttaccggttttacccggggttaaccccggtttaaccgggttaaacccggtttaaaggggtaccgttttacgttttaaccggtaccgggtaaacggttaaccgttgggttacccggttaaccgttcgaacccgtccttaagttacccgtttaccggtttaccgtttacccttaccccgg

SEQ ID NO: 39418 - DNA, 750 bp, Homo sapiens
  misc_feature: GYAE6OF02F5WVC.10.20.B09.1.454.CMB.1.raw
  modified_base (198)..(198): a, c, t, g, unknown or other
  misc_feature (198)..(198): n is a, c, g, or t
  modified_base (712)..(712): a, c, t, g, unknown or other
  misc_feature (712)..(712): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagaaaccaccggagaagttgtgttgacgcagtctccaggccaccctgtctttgtctccgaggggaaanagcccacccttctccctgccagggccagtcactatgttagtgacaacttacttagccttggttgctagcaaccaaaccgtggaccaggtcctcccgaggtcctccctacacttctatgctcggactactccccagtccgaacggggccccacggtgggccctaccgtaccccgaggtaccctacgggttccaaggttcgaccggtagggttcggggtcgtacgggaacgtggtaccgttcggcttaccggtaccacctaagttcccgacgtcgagttccgaggtacgttagtcggtaaggttaacggttacgtttttgggaaccttttaagttttacttacgttgtaaccggttaagtaaactttgtacgtaccgttcgggtaccgttccgggttccctaaccgggtttaaacgtttaccggtttacggaacccggttaaaccggggtacctttaacgggttaacgtaccgtaaccgttaaccggaaacccgtttcggttaccggttacccggngttacccgtaccggtacccttacgtcccgttttaaccg

SEQ ID NO: 39419 - DNA, 746 bp, Homo sapiens
  misc_feature: GYAE6OF02GR8H5.10.20.B09.1.454.CMB.1.raw
  modified_base (196)..(196): a, c, t, g, unknown or other
  misc_feature (196)..(196): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccgagggganagagcccaccctctcctgcgagggccgtcagaatattgcctaccaacttagcctaggtatacaaacaaaacgcctggccaggcctcccagacctcctcatctcgtggtcgctagttccgttacggacgggtccctacgttcgggtaccgtccccgacgtcccgtagggtttccaggtcggccgtaaggggttcggggtcgtaggggaaactaggtaacgtttccaaccttccgtaccaaccctacgttccgaacgggtcccgggtacccttggacctacggtttaccgtaaggtaaagtttagttttcgaccgtttaagttttacttacgtcgttacagtactaagtttaagttaagttaggttaacgttttcggggttttttaacttaccgttaccggtttttcccggacccggtttacgggaaaccgtaaagggtttcggttaacttttccggaaacggttaaccggtaacgtttcggggtacggtaccgtttacggtacctaacccgttaagtttcccgtttacgtttaccgtttaccttaacccgg

SEQ ID NO: 39420 - DNA, 770 bp, Homo sapiens
  misc_feature: GYAE6OF02IX9NL.10.20.B09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccgagggganagacgcccaccctctcctgcgacgggccggtacaagtaattagttcgacctaaccaaacttacgccttaggtaactacaaacgaaaaacgccgtacggccaacggcctaccccaagacctccctctacttccgtcgtcggtcgctacgttcggttaccggacgggccctacgtcgggtccgtacccgagtccgtacgggttccgaggtcggcgtacggttcgggtacgtacggaaacgtaggtacgttaccaaccgttccgtactaacccgtacgttaccgaacgggtcccgggtacccttacgggacgtaacgtttccgttaagggtaaacgttttacgttttaggacccgttttaaaggtttttaacttaacgttcgttacgtaacggtacgttaacgtttaaagttaattacgggttaacggtttttcgggtttttaacttcggttaaccgttttcccgggtaccgttacggggtaaaccgttaagggttacgttacgtttacgaacggtacggttaacggtcggtcgtaccgtacgacctaaccgttcgttctcgttaccttcccgttaccg

SEQ ID NO: 39421 - DNA, 747 bp, Homo sapiens
  misc_feature: GYAE6OF02IN8MH.10.20.B09.1.454.CMB.1.raw
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (332)..(332): a, c, t, g, unknown or other
  misc_feature (332)..(332): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtcctcgagggganagacgccctaccctctcctgcgacgggccgtanagtaattnttcgacctaccaacttacgccgtggtactacaaaacaaacgccgtcggacccaggcctacccgaagtcccttaccctctacttccgtcgtgggtcncctagttccgtacggccgggtacctacggtcggtccgtcccacggtccgttaggttcgaggtcggcgtagggttcgggtacgtacggaacgtaggttaccgttcctaaccgtcctacctacctagtccgacgggtcccgtcctacggaccttaggttacctaagggttaactttacgtttcggtaacgttttagttttaacttccgtgacttagacgtttaagtattaagttcggtttaacggttttttaccgtttacttacccggtttacgtttcccgggtaaccgggtttaacggtaaaaccgttaagggtttccgttacgttaacggtaccggttaaccggttacgttcgggttacgtaccgttcgtaacccgtacgtttacttccggtttaccgttccgttaccttaccgg

SEQ ID NO: 39422 - DNA, 702 bp, Homo sapiens
  misc_feature: GYAE6OF02GGVOL.10.20.B09.1.454.CMB.1.raw
  modified_base (195)..(195): a, c, t, g, unknown or other
  misc_feature (195)..(195): n is a, c, g, or t
  modified_base (676)..(676): a, c, t, g, unknown or other
  misc_feature (676)..(676): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgcccaccctctcctgcgagggccgtacaagtaattacgttgacctaacctaacgttacgccttggtaactacaaacaaaaacgtcccgtaggaccaagggtcctaccccgagaccttccctccgaattcctctgggtcgctattccgttacggaggcctacgtgggtctcccgacgccgtaggttcaggtggaccgtaggtcgggtctaggaaacaggtacgttcacttcgtaccaacctacgtccgaacggtccggtacctcggactagttcgtaggtaaacgttactttaggcttaagttttatttaccgttcggttactaacggtctaaggttaattaaacgtggtacgttttgggtttttaacttccgttaacgttttcccgggtaccctttacgggaaaaccttaagggtcggttactttaccggaacgttaaacggtaaccgttggtacggacgttacgaccgtaaccgtnttaccgtacgtttcctaccgttaccg

SEQ ID NO: 39423 - DNA, 608 bp, Homo sapiens
  misc_feature: GYAE6OF02FX87J.10.20.B09.1.454.CMB.1.raw
  modified_base (195)..(195): a, c, t, g, unknown or other
  misc_feature (195)..(195): n is a, c, g, or t
  modified_base (417)..(417): a, c, t, g, unknown or other
  misc_feature (417)..(417): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgccagggccgtcagaatatgctaccaattgcctgatcaacaaagcctggccaggctaccagacctcctacatctcgtggtcgctatccttcggacgggcctacgtggtcgtcccagaccgtaggtcaggtggacgtggtaggtcgtaggaactagtacgttcactcctacacctactcgagccggtctgcagtctaggaaagttntttcgacttgtttattacgtgttactagtctaagtataacgtgtaccgtttggttttacttacgttacgtttaccggtacccgtagggtaaccgtaaaggttcggttaacgtttacgaacgggttaacgttaacggtcggttacggtacctcgtaccgacgtacgttcttacggttacctttaccgttacg

SEQ ID NO: 39424 - DNA, 436 bp, Homo sapiens
  misc_feature: GYAE6OF02INOUC.10.20.B09.1.454.CMB.1.raw
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (312)..(312): a, c, t, g, unknown or other
  misc_feature (312)..(312): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (422)..(436): a, c, t, g, unknown or other
  misc_feature (422)..(436): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttaatgacgcagtctccacgcccacctgtctgtgttcncgagggganacgacgccctacctcctccgtgcgtaggggccggtcagaattattcgacctacctaacttgtacgngtanacaaataaacgcgtagccgacgcctaccgacgacctcccgtactntacctcggtaggctacatttccgtcggacggtccctagtcgtcgtcagctagtcagtcggngagttcgggactagaagcgtattcataccgtnaccnacncggtcncgtnnnnnnnnnnnnnnn

SEQ ID NO: 39425 - DNA, 695 bp, Homo sapiens
  misc_feature: GYAE6OF02HKX4O.10.20.B09.1.454.CMB.1.raw
  modified_base (157)..(157): a, c, t, g, unknown or other
  misc_feature (157)..(157): n is a, c, g, or t
  modified_base (179)..(179): a, c, t, g, unknown or other
  misc_feature (179)..(179): n is a, c, g, or t
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (328)..(328): a, c, t, g, unknown or other
  misc_feature (328)..(328): n is a, c, g, or t
  modified_base (440)..(440): a, c, t, g, unknown or other
  misc_feature (440)..(440): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatgttatgacncagtctcagccacctgtctgtntctcagggganagacnccaccttcgtctcggcacgggccgttacaagtaaactagttgacctaaaccaagtttcgccttggtaactcaaaactaaacggccgttcgaccgtaggcctaccccaagtctccgtacctatctcgtcggtancaacttcggtacgacgggtccacgttcggtaccgttaccacggtcgtaacgttcgaggtacggctagggtcggtacgtaggaactacggtcttacgaacgtctacgaacgtnttccgaacgtccgacgtgtactagtacgttacggaactttagtttcgaacgtttcgtttaagttaccgtggtaaccgagttacttaacggaagtttacgtaacgggttacttttaagggttttaccttttacccggttaacggttttcccggtaccggttaaccggagttaaaccgttgtacctttacggaacgttacgacgttacggtagtaccgtcgtacctacgtacgttcggtttacttcggtaccttacg

SEQ ID NO: 39426 - DNA, 779 bp, Homo sapiens
  misc_feature: GYAE6OF02GQ7XM.10.20.B09.1.454.CMB.1.raw
  modified_base (196)..(196): a, c, t, g, unknown or other
  misc_feature (196)..(196): n is a, c, g, or t
  modified_base (350)..(350): a, c, t, g, unknown or other
  misc_feature (350)..(350): n is a, c, g, or t
tcagcatagtagtgcacgaccggtgctcgatttagtgtagtgtgaagggggaggaactgctcagttaggacccagacggaaccatgggaagccccagcgcagcttctcttcctcctgctactctggctcccagacaacactgcagaaatagttatgacgcagtctccagccaccctgtctgtgtctccaggggganagaggcccaaccctctcctgcctaggggccggtacagaactattgaccttaaccaaactttagcccttagggttaatactaaacgaaaaacgcctaggacccagggtacctaccccgaagtaccttaccctacaacttccgtcgtggggttacnctaacgttccgttacggacggggtacctaacgttcgggttaccgtccccgacgtccccgtaagggtttaccaaggttcggacgtacgggttcgggtacgttagggaactagtaacggtttcaaccgtcttacgaacctacgttccgaacggcccgggtaccttaggactaacgggttccttaaggggtaaacgttaggtttttacggaccgttaaggtttttaactttaccgttacggttacaacgggttacctaaagggtttaacttaaacggtttggtaacgttttacgggggtttttttaacttacctttacccggtttttaccgggccgttacggaaaccgttaagttcgggtaactttacgaacggtaacggtaacgttcggtacggtcgtacgacgtacctacttcgtacgttcttactaccg

SEQ ID NO: 39427 - DNA, 782 bp, Homo sapiens
  misc_feature: GYAE6OF02IY9NQ.10.20.B09.1.454.CMB.1.raw
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctccagacaacactgcagaaatagttatgacgcagtctccagcccaccctgtctgtcgtctccgagggganagacgccaccctctccngcgagggccgtacagaatntcgacctaccaattcgccgtaggtactacaaaacgaaacgtccgtggaccgacggacctacccgaagtaccttccgtcaacttcgtccgtgtcgactacgtcgttaccggacggtccctacggttcgtccggtacccaggtacccgtaggttcaggtcggcgtacgggttcgggtccttaagggaacctaggttaccgttacgaccgtcctaccgtaaccgtagtccggacggtacccggtcctacggaccgttaacggttcgtaaacggttaacgtttaacggttttccgaaccggtttaagtttttaaccttaacggttcgtacgtaacggttacgttaaagttacgttaaacgttcggtttaacgttttacgggttttttaaacctccgggttttaaacccggtttcgggtaacccgggttaacggttaaaaccgttaacgggttaggttacccgttttaaggaaccggttaaaccggttacggttggttaccggacgtttaccggacctaacggttaccgttccgtcggtttacccttattaccgg

SEQ ID NO: 39428 - DNA, 723 bp, Homo sapiens
  misc_feature: GYAE6OF02HWAQM.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctctgctactctggcctcccagacaacactgcaagaaattagttatgacgcagtctccagccctaccctgtcgtgtcgtcgtccggaggggagacgacgcccacctcctccgtgcgacggggccggtacaggaattacgttcgaccttaaccaacttacgccgttaggtactacaaacgaaacggtccgtacggaccgaacggtccctacccacgtaccttccttacctactttccgtagtcggtcgaccttagtccgttcgggacggtcctacggttccggcgtaccgccgtcgtacggttaccggtggcggtacgtacggtcgggtaacgtacggaacgtacgtacggttactacccgtactaccacgtctacgacgggccgtacgtcacgactgttagttaacgttgtttacgtctttaagtttactcgtcgtacgtagaacttagtaagttacgtaccggaccgtccgggtacccgttacgggtaccggttaccgggaaccgggtaggtaacggtacggtacgttaacccacgtaacgggtcggttcggtaccggtacgtaccgacgtacgtttctccggttaccggttaaccttcgtacccgttcccg

SEQ ID NO: 39429 - DNA, 683 bp, Homo sapiens
  misc_feature: GYAE6OF02JWEJ9.10.20.B09.1.454.CMB.1.raw
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctaccgagcccaccctgtctgtgtcctaccgaggggananacgcccaccctctcctgcgacgggccgtcaagtaattnttcgacctaacctacttagccttaggtataccaaacgaaacgcctaggaccacggccctacccagtacctcctacatcctcgtggtcactacttcgttcggacggtcctacgttacggtcctccacgtccgtaggttcaggtcgcgtaggttcgggtacacggaagagtacgttcgaccttactccgtaacccaggtacctacggcccggtacctcggcgtaagttccgtagtaagtttgtttacgcggtttaaatttcttaacgttcgacgttagggtactagttaacgtacttcggttacgttttagggttttacctacggtttcccgtttacgggcccttaaggggttaaccttaacgggttcgttagtttccgaacggttacgtaccgttggtcgtcgtaccgtcctaacgtcttacgttcgtttccgtactttacccg

SEQ ID NO: 39430 - DNA, 648 bp, Homo sapiens
  misc_feature: GYAE6OF02GOV5P.10.20.B09.1.454.CMB.1.raw
  modified_base (153)..(153): a, c, t, g, unknown or other
  misc_feature (153)..(153): n is a, c, g, or t
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (276)..(276): a, c, t, g, unknown or other
  misc_feature (276)..(276): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatgttangacgcagtctccagccaccctgtctgtgtctccagggganagagcccaccctctctgcgagggccgtnagatatgctaccattgcctgatcaaacaaagcctggccaggcctccagactcctnatctgtggtgactatcttcggaggccagttggtctcccaggcctaggttcaggtcggacgtaggtcgggtcgtaggaacaggtacgtttacaccgttctaccgactactcgaacggccggtccctggctaaggttcctaaggtaaagtttagttttggaccgtttaagttttaaccgtttaagttcgttacgacggtaaccttaagtttaaataaccgttaggtacggtttttacgggtttttaactaccgttaccgttttccggaccccggttaaagggtaaccgtaaaaggttcgggttattaccggtaaggaaccgttaagttcgggtagtccgttagacctacctagttcgtagtttcctacttaccg

SEQ ID NO: 39431 - DNA, 709 bp, Homo sapiens
  misc_feature: GYAE6OF02HFC3H.10.20.B09.1.454.CMB.1.raw
  modified_base (193)..(193): a, c, t, g, unknown or other
  misc_feature (193)..(193): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccagggganagacgccaccctctcctgcagggccgtcagactattgacctacaacttagccttggtactacaaacgaaaacgccgtaggccaacgggcctaccccgagtacctcctactaattctccgtaggtcgacctaagttccgtttaccggaacggggtcccctaacggttcgggtccggttaccccgacgtacccggtaagggttccaaggttcggaccgtaagggttcgggtaccgtaggggaaacctaggtacggtttaccaacgttaccttaccggaacctacgttaccgaacggtcccgggtccgttacggacgtacggttaccgttaagggaaacgtttacgttttacggaccgttacggtttttaaacgtttaccgtacgttacgagtaccgtagtccgtacgaccgttacgtttcgggacgtacgtcgaccttacggttcggacggaggaacctaagtacggacgtaacaacggtaactggacggattcgaccgttacacgtcgtctattccg

SEQ ID NO: 39432 - DNA, 756 bp, Homo sapiens
  misc_feature: GYAE6OF02HHFFX.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtcctccgaggggagagacgcccaccctctcctgcgagggccgtacagtaatattcgctaccacttgcctggtactacaaacaaacgtccgtacggaccacggcctaccccagtaccctcctacactctcgtggtctctacttcgtacggacggcctacggttcggtccgtacccacggtccgtaggttacgaggttacggcgtagggttcgggtactacgggaactaggtactttaccaccgttaccttaccgaacctacgtaccggaacggccggttaccgtggaccgtaacggtttccgtaaaggttaacgttttgtttaccgtacgttttaacggttttacgtttaccgttaggttacccgtaagtaaccgtttaaagttaagttaacgtttaccgggtttaacggttttttagggttttaacccttttccggtttaacccggttttccgggaccccggttaagggtaaccgtaagggtttaccgttactttacggaacggtaacggttcggttaggtccgtacgtacgtacctacgttccgttcgtttacggttaccttacgtttacccg

SEQ ID NO: 39433 - DNA, 695 bp, Homo sapiens
  misc_feature: GYAE6OF02G8XUJ.10.20.B09.1.454.CMB.1.raw
  modified_base (303)..(303): a, c, t, g, unknown or other
  misc_feature (303)..(303): n is a, c, g, or t
tcagcatagtagtgcacgaccggtgctcgatttagtgtagtgtgaagggggaggaactgctcagttaggacccagacggaaccatggaagccccagcgcagcttctcttcctctgctactctggctcccagacaacactgcagaaatagttatgacgcagtctccacgccacctgtctgtcgtcctaccggaggggagagacgccacccgtcctccgtgccgacggggccggtacaagtaatacgttacgaccttaacctaaacgttacgccgttaggtaactaacaaaacgaaaacgtccgnggaccgacggccctaccagtaccctcctctattcctcgtggtcgacttattacgttcggaccggtcctacggttcggtctcccacgtccgtaggttcaggtcgacgtagggttcggtacgtaaggaacgtacgttacgttaccaccgttctaaccgactacgtcgacgcccggtactgacgtacgtctaggtaattacgttcgacgtttagtttaattcgtacgtcaaacgtctaaagttattaacgtcgttaacggttttagttttaccttcgttaccggtttccgtaacccggtaggtaaacctaaggttccttaagttcgtaacggtaccgtacggttagtccgagtttaccaccgttaactacgtttcgtaccttcgttaccgtcccg

SEQ ID NO: 39434 - DNA, 880 bp, Homo sapiens
  misc_feature: GYAE6OF02G16JO.10.20.B09.1.454.CMB.1.raw
  modified_base (192)..(192): a, c, t, g, unknown or other
  misc_feature (192)..(192): n is a, c, g, or t
tcagcatagtagtgcacgaccggtgctcgatttagtgtagtgtgaagggggaggaactgctcagttaggacccagacggaaccatggaagcccagcgcagcttctcttcctcctgctactctggctccagacaacactgacagaaatagttatgacgcagtctccagccaccctgtctgtgtctcgaggganagacgccacctctccgtgcgacgggccgtacgaagtaattacgttcgaccttaaacctaacgttacggccttaggtactaaccgaaaacaaaacgtccgttacggaccacggtcctacccgagtaccctccttctaacgttcccgttcgttcgggttacacttacgttccgttcgggaaccgggcctaacggttcggtaccgttccccgaacggtccggttaacggttcgtaaggggttcggacggtaagggtttcggggttaccaaggggaaaccgttacggtacggtttacctacccgtttaaccgtacctaaccgtaactccggaacgggtccggtacccgtcggacttacgggttacgttacggtaaacggttttacgtttccggtaacgttttaacggtttttaacgttaacgttttcgtaacggtaacggttaaaccttaagtttaaacgggttacgttaacgggtttaacgttttttttaacgggttttaccgtttaaccgttttacccggggtttaccggttaacccgggttaacgggtaaaaaccgtttaaggggtttacggttaccggtttaacggtaccgggttaaacgggttaaccggttcgggttaacggacccgtttaaccggacctttaccggttaacgttcgtttacggttttacccgtacctttaacccgg

SEQ ID NO: 39435 - DNA, 719 bp, Homo sapiens
  misc_feature: GYAE6OF02HDQ3Z.10.20.B09.1.454.CMB.1.raw
tcagcatagtagtgcacgaccggtgctcgatttagtgtagtgtgaagggggaggaactgctcagttaggacccagacggaaccatggaagccccagcgcagcttctcttcctcctgctactctggctccagacaacactgcagaaatagttatgacgcagtctccagaccaccctgtcttgtcgtctccgaggggagagacgccaccctctcctgcgacgggccgtacagtaattagttcgcctacctaacgttacggccttaggtactaccaaacaaaacgtccgtacggaccacggcctaccgagtacctcctcattctcgtggtcgctattccgttacggacggtcctacggttcggtcctacccgacgccggtagttaccgagggtcgacgtagggttgggtacgaggtaacgtacggtactttacacttcctactaccgtacgtcggtaccggcggtcctaggccgtaagttcgtaaggtacggtttaactttcggtaactttacgtttaacttacgttcgttaagtcggtacttaaggttaacttaagtcgggtttacgttttagggtttaactttccgttacccgggtttccgtaccgggttaacgggtaaacttagggttagttccgtttaaggaacggttactaacggttcgggtacgttaccgttaccgaccttaacgttacttcccgttacgtttccgtacctcccgg

SEQ ID NO: 39436 - DNA, 700 bp, Homo sapiens
  misc_feature: GYAE6OF02JXOWQ.10.20.B09.1.454.CMB.1.raw
  modified_base (156)..(156): a, c, t, g, unknown or other
  misc_feature (156)..(156): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
tcagcatagtagtgcacgaccggtgctcgatttagtgtagtgtgaaggtggaggaactgctcagttaggaccagacggaaccatggaacgcccagcgcagcttctcttcctctgctactcgtggcctccagacaacactgacaagaaattagttancgacgcacgtcctccacgccctacctgtaccgtgtcgtcgacggagggngacgcnccctacctctcgngacggacgggccgtagaagtaattctcgacctacctaacgttacgcgttagtaacctaacgaaaactacggccgtggacccgacggtccctaccgaacgttacctcctagtctccgttacggcgggttccacgtacgtttccggtacggccggtaccttacgggtcgtacccgtaccgtacggtaccgttaggtcgacggtcgacggttaacgggtcggttacaaggtaactacgggtacttactcctaccgccaacgtacgtacggccggtacgtccaggtacgtacggttaacgtaagtcgtttacgtagtactttaacgtttctagtacgtacacgtacgtacggtacggcgttcgtccgggtacgtacgtcccggtagtaccggacgtaacgtaggtacacctaggtaaccgctaaggtcggtaccgtaactccggtacgtacgttcgtaactttccttaccgtacgttccg

SEQ ID NO: 39437 - DNA, 679 bp, Homo sapiens
  misc_feature: GYAE6OF02G7WY1.10.20.B09.1.454.CMB.1.raw
  modified_base (196)..(196): a, c, t, g, unknown or other
  misc_feature (196)..(196): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtcgtctaccgagggganagcgccaccctctccgtcgcgacgggccgacaagaattagtcgcctaacctaacttacgacgtagtactacaaacgaaaacgccgtcggacacggcctaccgacgaccttctacactctcgtaggtcgctacttcggtcgacggcctacgtcggtcgtcccacggtctacggttcgaggtacgtcgtagggtcgtcgtaggtaactggtacgttaccgacttccgtacgaccagtacacggaactacggtacgtacgacgtcgttaaggtaacgttagttcgacgttaggttaccttttaagacttacggtacgacgttacgtaagttaccgtacggtaaccttaaccgggtaaccgttaaaggtttaccgggttaggaaccccggtaacgggtaaactaccgggtagtaacggaggtaaacctaacggaacgttaggaccgttaggaccacgtacgtaccgtaccttacgttcgtacttacg

SEQ ID NO: 39438 - DNA, 585 bp, Homo sapiens
  misc_feature: GYAE6OF02FWFJ3.10.20.B09.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (298)..(298): a, c, t, g, unknown or other
  misc_feature (298)..(298): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggganagagccaccctctcctgcgagggccgtnagaatattgctaaccaattagcctggtatcaaacaaaagcctggccaggcctcccagactcctcatctctggtcncatcttcggacgggccacgtggtcgtccccaggccctagggttccaggtcggacgtagggtcgggtctagggaacaggtagttccactcgtaccacctatcgacgcggtcctggcagtctagaagtatttgctagtttattacgtgtcgagtctagtatatgtacgttggttttattacgtacgtttccggccgtacgggtaacgtaagttcggttactttacgaacggtaacgtacgtcggttcggtacgtggtccgtacgtacttcgttacgttcttacgtaccg

SEQ ID NO: 39439 - DNA, 752 bp, Homo sapiens
  misc_feature: GYAE6OF02HHNJZ.10.20.B09.1.454.CMB.1.raw
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (494)..(494): a, c, t, g, unknown or other
  misc_feature (494)..(494): n is a, c, g, or t
tcagcatagtagtgcacgaccggtgctcgatttagtgtagtgtgaagggggaggaactgctcagttaggacccagacggaaccatggaacgccccagcgcagcttctcttcctcctgctactctggctcccagaccaacactgcagaaattagttatgacgcagtcctccagccctaccctgtctgtacgtctccgaggganacgacncccaccctctccgtcgacgacgggccgtnaagtaattcttcgctaaccagttacgctagtacacaacgtaaacgcctacggtcgacgtccacccgtacgtaccgtcctacgtacttccgtcggttggtcgacttaccgttccggttacggaccgggtcctacggttcgggttaccgtacccgtaccggtcccggtaagttccgaggtaccggcgtaggttcggtaccgtaacggaacacggttcgttactaccgtacgtacctaccgtacgtaccgtcgggtaccnccgttcgtacgtacggttacgtagttacgttatttccggtacgttatttacttcgtgacgtacgtactaacgttaagttaacgttcggtttacgttttaggtttaccttacgttttaccgggtccgttaaccgttacggaacgtttaacggtacgtacgtttaacggtccggtaaacgttccggttaggtaccggttaccgttacggtacccgttaacgtttcggttacccgtttacggttacctttcgttaccccgg

SEQ ID NO: 39440 - DNA, 689 bp, Homo sapiens
  misc_feature: GYAE6OF02HKYUH.10.20.B09.1.454.CMB.1.raw
  modified_base (243)..(243): a, c, t, g, unknown or other
  misc_feature (243)..(243): n is a, c, g, or t
  modified_base (336)..(336): a, c, t, g, unknown or other
  misc_feature (336)..(336): n is a, c, g, or t
tcagcatagtagtgcacgaccggtgctcgatttagtgtagtgtgaagggggaggaactgctcagttaggacccagacggaaccatggaacgccccagcgcagcttctcttcctcctgctactctggctcccagacaacactgacagaaatagttatgacgcagtctccacgccacccttgtctgtcgtcctccgaggggagacgacgcccacctctcctggcgacggggccggtacagtaatnttcgactacctaacttagccttaggtactacaaaacgtaaacgccgtaggaccgacggcctacccgagacctcctatactcttcgtcggtacnctacttcgttcggacggccgtacgttggtcgtaccgtacgaccgtcggttcgaggtcggcgtaggtcgggtacgtaggtaacgagtacgtcctacttccgacacgtactcgacgccgtctgtaccgtaggtcctaagtaacgttacgtttgaacgttttaacgtttacttaacgtcgttacaagtactaagttaaacttacggtagtttacggttttagttttaacttccgtaccggttttaccggcccggttaaggaaccgtaagggttctacgtttaacggacgtaaccggtgttcggtacggtacctacggtaccaacgttacgttcttacggttaccgttacgttaccg

SEQ ID NO: 39441 - DNA, 1001 bp, Homo sapiens
  misc_feature: GYAE6OF02GK1ED.10.20.B09.1.454.CMB.1.raw
  modified_base (192)..(192): a, c, t, g, unknown or other
  misc_feature (192)..(192): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtcaccagccacctgtctgtgtctcgagggganagacgccacctctcctgcgacgggccgtacagaatattcgacctacctaattacgcctaggtactacaaacgaaacgcctacggaccgtacggcctacccgaacgtacctcccgtacacttccttcgttacgggtcgtactacgttccggttacggacggggtaccctacggttcgggtccgttaccccgacggtacccggtaacgggtttacgacggggttacgggacgttaacgggggtttacggggttaccggtaaacgggtaaaccgtacggttaacgtttacccctaaccgttcccgtaaaccctaacccgtaaccgttacccgggtaacggggtaccccggttaccgttcgggtaaaccgtttaccggttacggtttaaacggttaaaggttttaaaccgtttttacggtaacccggttttttaaaagttttttaaccctttaacgtttaccggttaacgtaacccggttaaacgttaaacgggtttttaacttaaacggttttaacgggtttttaacccggggtttttttagggtttttttaaaaccgtttccccggttttaaacccggggttttttacccggggttaaaccccggtttaaacgggggttaaacccctttaaaacgggggttttccgttttaaccggtttttaaaccggaaccgggttttaaaacccgtaaaccgggggtttttagggtttaacccgggtaacccggtttaacccggaaccccgtttaacccgttaaccggtttacccgggtttttaaccgtttaccccgttttaacccgggttttaccccc

SEQ ID NO: 39442 - DNA, 731 bp, Homo sapiens
  misc_feature: GYAE6OF02GPCDK.10.20.B09.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtcctccgagggganagagcccaccctctcctgcagggccgtnagaatattcgctaccaacttagcctggtatcaacaaagcctggccaggcctcccgagactcctcactctcgtggtgctatcgttcggacggccacgtcggtcgtcccagcctaggttcaggtcggacgtaggtcgggtctagggaaacctaggtacgttactaccttccgtaccgacccgtagtacgacgggtccgggccctggcctaacggttcttaagggtaaacgtttacgttttcggaccgtttaagtttttaacttacggttcggttacgaaggtaccgtaagtttaacgttaaacgttacgggttaccgtttttagggtttttactttacccgttaccggtttttacccgggacccgttacggggtaaaaccttaacgggttagggtttactttaccggaacggttaaccggttaaacgtttcggggttaccggtaccgttaacggtacccgtaaccgttacggtttacccggtacggttttcccttacggtttaaccccg

SEQ ID NO: 39443 - DNA, 850 bp, Homo sapiens
  misc_feature: GYAE6OF02HITCA.10.20.B09.1.454.CMB.1.raw
  modified_base (141)..(141): a, c, t, g, unknown or other
  misc_feature (141)..(141): n is a, c, g, or t
  modified_base (160)..(160): a, c, t, g, unknown or other
  misc_feature (160)..(160): n is a, c, g, or t
tcagcatagtagtgcacgaccggtgctcgatttagtgtagtgtgaagggggaggaactgctcagtttaggaccccagacggaaccatggaagccccagcgccagcttctcttcctcctgctactctggctcccagacaacnctgcagaaatgttatgacncagtctccagccaaccctgtctgtgtctccgagggagacgcccaccctctcctgccgaggggccgtcaagtaatattcgacctaacctaaccgttagcctaggtaactacgaaacaaaagcccgttacggaccgacggtccctaccgaacgacctaccttacacttcgtacgttggtacgactacgttccttacgggacggtccaacgttcggtccgtacccgtacgacccgttaggtcacggttacggaccgttaggttacgggggtacttaacgggaaacccgtaagggttaacccgtttacccgaaaccgttttacccggtaacccgtaacccgtaacggtttaaccgaacccggggtacccggttacccgttaacgggaacccgaacgggtttaccgtaaggttaaaacgtttagttttaccggtaaccgtttaacggtttttaacgttaacccgttacgttacgttaacggaacgtaagttaaccgttaaacgttacggttaacgttttacgggtttttaacttaccggtaaccgttttcccgggtaaccggttacgggaaaccgttaaccggttaggtaaccttttacggaacggttaaacccgtaacggttcgttaaccgggtacgttaaccgacccggtaacccgttacgtttaccgttaccttaccgttaccttaacccgg

SEQ ID NO: 39444 - DNA, 779 bp, Homo sapiens
  misc_feature: GYAE6OF02FQZ35.10.20.B09.1.454.CMB.1.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggcctccagacaacactgcagaaatagttatgacgcagtctccagccacctgtctgtcgtctcgagggganagacgccaccgtctccgtgcgacgggccgtanaagtatagtcgacctacctaagttcgccttaggtactactaaaacgaaacgtccgttacggacccgacggtaccttaccccgaaggtacccttccgtacctaacgttccgttacggtaggttccgtactacgttccgtttacgggacggggtacccttacggttcgggttaccgtaccccgtacggtacccgttacggttacggcggttaccgggacgtacgggttcgggtaccgtaagggaacgtaacggttcgttactaccgttcctaccgactactcggacgtccggtactcgtacgtacggttactacggttaagtttcgtttaccggtacgtttaacgtttttaacgttacgtacgttaaccgtacgtacgttaagtttacgtaacgttagtttacgggttttacgttttacttaccggttaccgtttaccggaccggttaacggtaaaccgttagttacggtacttaaccgaaggtaacgttaaccgggtcggtacggttcctacgtaacccgtacttaccgttcggttaccttactaccgttacccg

SEQ ID NO: 39445 - DNA, 531 bp, Homo sapiens
  misc_feature: GYAE6OF02JAQVR.10.20.B09.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
  modified_base (401)..(401): a, c, t, g, unknown or other
  misc_feature (401)..(401): n is a, c, g, or t
  modified_base (488)..(488): a, c, t, g, unknown or other
  misc_feature (488)..(488): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacacactgcagaaatagttatgacgcagtctccagccaccctgtctgtgtctccgagggganagacgccaccctctcctgcagggccgtnagatntgctaccatagcctagtatcaacaaacgctgccaggcctcccagactcctcattctcgtcggtnacctatcgttcggacggtccacgtggtcgtcccagcccaggttcagtggcacggtggtctaggacagtgtcgactctacacatcgagccggctcgagtcgtctagtaatntttcgacttagttacttactgtacaggtctagtatactagtacgttggtttactgtacgtttccgcgtacgactaagttcgagttanacggtacgtatggtacgcgtcgcacgtctctcgtcttactacg

SEQ ID NO: 39446 - DNA, 807 bp, Homo sapiens
  misc_feature: GYAE6OF02H5JCK.10.20.B09.1.454.CMB.1.raw
  modified_base (197)..(197): a, c, t, g, unknown or other
  misc_feature (197)..(197): n is a, c, g, or t
  modified_base (774)..(774): a, c, t, g, unknown or other
  misc_feature (774)..(774): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtctctaccgagggganagacgccctaccctcctccgtgcgacgggcccgtacagaatagttcgacctaacctaactttacgccgttaggtaactacaaaaaccgaaacggtcccgtacggacccgaacggccccttaccccgaagtacccttcccctactaacttccgttccgtacggtcgtaccgttacgttcccgtttaccggggaccggggtacccccttaacggtttcggggtccccgttaaccccccgagggacccccggtttaaggggttaccctaggggtcggtaccggtaggggtttccgggttacgtaaagggtaaactacgggttacctttaccgaaccctttccgaaacctaccgtaacgtccgtaaccgggccgtcccgtaggaccctaaggtttccgaaagttaagtttactttgtaacgttttaagttttaacgcgtttactacgtctaacgtattaacgtaagttcggttttaacgtttacgggttttcttaccggtttaccggttccggtaacccggttaggtaaacgttaggttagttacgttaccgtaaacgcgttaagtcggtacgttcgtacnccgtaacttgtttcgtacgttccttaactcccg

SEQ ID NO: 39447 - DNA, 860 bp, Homo sapiens
  misc_feature: GYAE6OF02FUNOK.10.20.B09.1.454.CMB.1.raw
  modified_base (197)..(197): a, c, t, g, unknown or other
  misc_feature (197)..(197): n is a, c, g, or t
tcagcatagtagtgcacgaccggtgctcgatttagtgtagtgtgaagggggaggaactgctcagttaggacccagacggaaccatggaagccccagcgcagcttctcttcctcctgcttactctggcctcccagacaacactgcagaattagttatgacgcagtcctacagccacctgtctgtgtcctcgagggganagcgcccaccctctccgtgtaccgaggggtccggtcaagtaattacgttcgaccttaaccaacgtttacggccttagggtactaacctaaactaaaacggccttcgggtacccaacgggtccttaccccgtaaggtacccttcccgtacgtaaccctttccgttcggttacgggttccggaaccgttaccgtttcccggtttaaccggggaccgggttaacccttacccggttcggggtttacgttaccccccgggtaacggtacccccggttaaggggtttccaaacgggggtttcgggttacccgtaggggtttaccggggttcgttaccgggaaacgtaccggttaacgttaccggtaccttccctaccgtaaacctaacgtttccggaccggtccggtcccgtagacccggtagttacggtagttaacggtttctttacggacgtttacgttttacgttacgtacttgacggtaccgttaatttaacgttacgttacggttagttttacggtttaccttaccggtttaccgtttccggaccgggttaacggtaacgttaacgggtttcgttacgttccgaaggttaccggttaacgtcggttaaccggttccgtcgacccgttacgttaccttcggttaccgttacctacgttacccgg

SEQ ID NO: 39448 - DNA, 781 bp, Homo sapiens
  misc_feature: GYAE6OF02JA9SZ.10.20.B09.1.454.CMB.1.raw
  modified_base (159)..(159): a, c, t, g, unknown or other
  misc_feature (159)..(159): n is a, c, g, or t
  modified_base (197)..(197): a, c, t, g, unknown or other
  misc_feature (197)..(197): n is a, c, g, or t
  modified_base (507)..(507): a, c, t, g, unknown or other
  misc_feature (507)..(507): n is a, c, g, or t
  modified_base (716)..(716): a, c, t, g, unknown or other
  misc_feature (716)..(716): n is a, c, g, or t
  modified_base (727)..(727): a, c, t, g, unknown or other
  misc_feature (727)..(727): n is a, c, g, or t
  modified_base (736)..(736): a, c, t, g, unknown or other
  misc_feature (736)..(736): n is a, c, g, or t
tcagcatagtagtgcacgaccggtgctcgatttagtgtagtgtgaagggggaggaactgctcagttaggacccagagggaaccatggaagccccagctcagcttctcttcctcctgctactctggctcccagaaactaccgcagaattgtgttgaccanagtctccagcccacctgtctttgctccgaaggggaaancgccacccttctcctgcgagggcccagtccagtacgttcgtttccccgcttacgttacgcccgtacggtaaccaaacgagaaccgcctaggccacggtcctaccccgaaggcccttcctcgattacgtatcggaattcggacctacgaaccccaaggtaccggggtccctaaacgtcggaacccaccgttaccccgacggtacccggttaggttccgaggttcgggaccgttagggttccgggtatacggccgaaagtccgttaaccgtttcgtaacccttcccgaccaaaccctaagtacccgaaaacnccgtaacccgttaacgaaaccgtttaagtaaccgtttagttttaccgttaactttaacgttttcgtttaaccgtacgttaaccgaacccgttagtaaccggttccctaacggttacccggccggtttacccgtaccgggtacccggtttacggaccgggtaaccgggaaccgtagggttaggaccgttacgaagtaccgaacgttacgnggttacggacnccgtaaccncgttaacttcgttacttcccgttatacccgttccctcccgtaccg

SEQ ID NO: 39449 - DNA, 668 bp, Homo sapiens
  misc_feature: GYAE6OF02IH3B0.10.20.B09.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
  modified_base (624)..(624): a, c, t, g, unknown or other
  misc_feature (624)..(624): n is a, c, g, or t
tcagcatagtagtgcacgaccggtgctcgatttagtgtagtgtgaagggggaggaactgctcagttaggacccagacggaaccatggaagccccagcgcagcttctcttcctctgctactctggctcccagacagcactgcaagaaattagttatgacgcagtcctccgagcccacccgttgtctgtcgtctacggaggganagacgccctaccctctcngcgcgggccgtaagtaatntcgactaacctattcgcttagtaactaacaaacgaaacgtccgtcgaccgtacgcctacccgagtaccctccgtactacttctacgtggtctacgtacttccggtacggcggacctaggttcgtccgtaccgacggtccgtaggtcgtaggtcggtcgtagggtcggtctaggaacgtagtctacgactaccgtactacgacgtacgaccggcgtcgtgtaactagttcgtaagtacgtttctttcgacgtttaatttacgtagtcaacgtacgtatagttaacgtagttagttacggtttacgtttactacggttaccgttcggtaaccgttaaggtaacgtaggttacgttaccgttaggaacgtcggttaacggttggtacncggtacttccgtaccttaagttccgtttaccgtgttttaacccg

SEQ ID NO: 39450 - DNA, 748 bp, Homo sapiens
  misc_feature: GYAE6OF02JZS7S.10.20.B09.1.454.CMB.1.raw
  modified_base (107)..(107): a, c, t, g, unknown or other
  misc_feature (107)..(107): n is a, c, g, or t
  modified_base (141)..(141): a, c, t, g, unknown or other
  misc_feature (141)..(141): n is a, c, g, or t
  modified_base (156)..(156): a, c, t, g, unknown or other
  misc_feature (156)..(156): n is a, c, g, or t
  modified_base (166)..(166): a, c, t, g, unknown or other
  misc_feature (166)..(166): n is a, c, g, or t
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
  modified_base (473)..(473): a, c, t, g, unknown or other
  misc_feature (473)..(473): n is a, c, g, or t
tcagcatagtagtgcacgaccggtgctcgatttagtgtagtgtgaaggtggaggaactgctcagttacggacccagacggaaccatggaagccccagcgcagcttcncttcctcctgcctactctggctacccagacaacnctgcaagaaatgtangacgcagtcncagcccacctnctgntcacgaggganagcnccncctnccgngcacgggtctnaatactagtcgacctacaagtttcgccgttagtactacgaaaagaacgcctggacacgcctacgancctacctcgattctcgngtancgcttcgtaacggcgtaccacggttcgtcgacccgtaggtactcgggttacncggttacggccgttaaggtcggttaccgtaaggaagttacggtcttaaccgacgtcctaacctacgacgttacggccgccgggtctacgtacgtaaccgtgtagttaaaccgtttnttacgttaaacgtttactttaacgtacgttaacgtaacgttaacgtaaacggttttaagtttaacggttagttttaacccgggtttttaagggtttttaacctttttaaccgggtttacccggtttaccggggtttaacccgtaccgggttttaaaacggttaccggttaaacggttttacgtccgttttaaaagggaccggttaaacgttacggttccgttcggtaaccttaccgggtcctttaacgttcgtttacgttaacccgttcttaacg

SEQ ID NO: 39451 - DNA, 826 bp, Homo sapiens
  misc_feature: GYAE6OF02F5MZU.10.20.B09.1.454.CMB.1.raw
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
tcagcatagtagtgcacgaccggtgctcgatttagtgtagtgtgaagggggaggaactgctcagttaggacccagacggaaccatggaacgccccagcgcagcttctcttcctcctgctactctggctcccagacaacactgcagaaatagttatgacgcagtctccagccaccctgtctgtgtctccgagggagagacgcccaccctctcctgcgacgggccgtnagaattnttgcctaacctaacgttacgccgtaggtactacaaacgaaacgtccgtaggacccaaggtccctacccgtacgaccttccctacgtacttccgttcgttcggtgacctagttccgttccggaggaccctaactaactcacccgtagaccgtaggttccgagtcggacgtagggtcgggttccgggtacgtacgtcggtttccaccgttccgtacctaacccggaagttcccgacggaccgtaccgtaccgttcgtaaccgtacggtttacgttaagggtaaaaccgttttctttttaccgggaacggttttaacgtttttaaccgtttacgttacccggttaacgtacgttacccggttaaagtttaccgttaggttaacccgttaacccgggttccggtttaccccgtttaacggttaacgttttacccggggtttaccgggggacccggggtaaccaacggggtttaccgacggttaaacccggttacggaaaccggttcccggttaaaggttccgggttacccggtacccgttcggaaccccggttaacccgttcggtttaccccggtttacgtttcccgtttaaccccg

SEQ ID NO: 39452 - DNA, 817 bp, Homo sapiens
  misc_feature: GYAE6OF02FIV7I.10.20.B09.1.454.CMB.1.raw
  modified_base (89)..(89): a, c, t, g, unknown or other
  misc_feature (89)..(89): n is a, c, g, or t
  modified_base (154)..(154): a, c, t, g, unknown or other
  misc_feature (154)..(154): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagcatagtagtgcacgaccggtgctcgatttagtgtagtgtgaaggggaggaactgctcagttaggacccagacggaaccatggaanccccagcgcagcttctcttcctcctgctactctggctcccagacaacactgcagaaactagttangacgcagtctcacgccaccctgtctggtctcctccgagggganacgcncccacctctccgtgccgacgggccgtanagtaactagttgacctaaccgtacttacgccttagtactaccaaaacgaaacgcctacggaccacggtcctaccgagtacctccgtactactccgtacgtggtacgaccgttacttccgttaccgggacggtacctacggttccgggtactacccgtaccggtacgtacggttctacggcggaccggttagggtaccggtcgtacggaactaggtaccgttaccgacttccgtaacctacctaacgtccgacggtacccggtctacggtcgtaccgtaagtacggttaaacgtttgttaccgaagttttacggtttttaaacgtccgtaacggtttaccgaacgttacgtaaacgtttaaagttcggtttaacccggttaaggtttttaccgggttttttaacctaccggtttacccggttttaccgggtaacccgggttacgtaaaaccgggttaggtttacccggttacctttacggtaacccgggttaaacggttaccggtttacgggtacgggttaacccgtttacggtaccgttaaccgtttaccggtttaccgtaacgttttacccgttaccctttaacgg

SEQ ID NO: 39453 - DNA, 692 bp, Homo sapiens
  misc_feature: GYAE6OF02FXIBZ.10.20.B09.1.454.CMB.1.raw
  modified_base (195)..(195): a, c, t, g, unknown or other
  misc_feature (195)..(195): n is a, c, g, or t
  modified_base (351)..(351): a, c, t, g, unknown or other
  misc_feature (351)..(351): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgcccaccctctcctgcgagggccgtcagaatattgactaccaacttagcctggtatacaaacaaacgtcctggccacggcctcccaagtacctcctacacttcctgtcggtgctattcgttacggacggtccctacgtgggtacctacccgnggtcccgtaggttcgaggtcggaccgtaagggttcgggtacgtacgggtaaaccaggttaacgttaccgtactccgttaaccgaaccctagtccgtacggtacccgggtctcggacgtacgttacgtaggtaaagttacgttttcgacgtttaagttttaaccttacgttgtacaccgataacggttaattaaacgttcgtaacggttttggttttaacttccgtacggttttcccggacccgttagggaaccttaagggttacgttacttacgaacggtaccgtagtacggtcgtaactcggacctaaccgtagtctttacccggttactagttaccccg

SEQ ID NO: 39454 - DNA, 769 bp, Homo sapiens
  misc_feature: GYAE6OF02I4GP5.10.20.B09.1.454.CMB.1.raw
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
  modified_base (187)..(187): a, c, t, g, unknown or other
  misc_feature (187)..(187): n is a, c, g, or t
  modified_base (197)..(197): a, c, t, g, unknown or other
  misc_feature (197)..(197): n is a, c, g, or t
  modified_base (469)..(469): a, c, t, g, unknown or other
  misc_feature (469)..(469): n is a, c, g, or t
tcagcatagtagtgcacgaccggtgctcgatttagtgtagtgtgaaggggagaactgctcagttaggacccagacggaaccatggaagccccagcgcagcttctcttcctcctgctactctggcctcccagacaacactgcanaaatgttangacgcagtcctaccagccctacctgtctgtctccncggagggganacgacgccctaccctctccgtgacgacgggtccgtacaagtaattacttcgaacctaaccgtaacttcggaccgttaggtaactaaccaaaacgtaaaacgccgtacggaccgaacggtccctaaccgacgtaccttccctacgtacgttccgtacgttgggtcctacttaaccgttccgttaaccggacggtacctacggttcggtcccgtacccgagtcccgtaaggttcgacggtcggtacgtgggttcggtacgtaggaacgtacgtnttaccacgttaccaccgtactacgtacgacggtccgtcgtcgtaccgagtcgtaacgaagtttcgttacgtacgtttacgtttacgtacgttacgtcgtaaactacgttaagttaaccgttaagttcggtttacggttttagttttaacccgtaccggtttacccggtttacccgtaaccggtacgttaaaaccggttaggtttaccttacggttaacgaacggttaaccggttagttacggtgtttaccgaccggtaccttacggttaacgttccggttactttccgttacgtaacccg

SEQ ID NO: 39455 - DNA, 768 bp, Homo sapiens
  misc_feature: GYAE6OF02FU2FD.10.20.B09.1.454.CMB.1.raw
  modified_base (589)..(589): a, c, t, g, unknown or other
  misc_feature (589)..(589): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctccctagatataaccgccggagaaattgtagttgacacacgtctccagcccaccctgtccttgtcctccgaaggggaaagagcccacccgtctctcgacagggtccaggtcaggagttgttacgccaacttaacttagtcgtcggtaacctaacgataaaccgtggccacgggtcctaccccgaggtaccgttcctaccacggttactagtacgaagtttcacggtaaccttcccggaacggaccgggaccctaaggtccggacaccgtaccaccgccgttacggtttacgatcggccgtaaggtccggggtacttcggggactacgtaaccttcgtaaccctccttacgacccgtcgtttaacccgacccggtaccgtaccggtaaccctaccggtaacgttaacgttttcggtacttacgtttacgttaaccgtggtacctaacgggctagaccggttanccgacgtccgtccggtcccctaccggttccccgtaacttaccggttccgggtaccgggtaaccggtaccgggtaacggtacgggacgtaccgtaaccgaaacgttaaccggtacggttcggtaacggtaccgtaccgtaccgtacgttacctcggttaacggttccacgttacccccgg

SEQ ID NO: 39456 - DNA, 742 bp, Homo sapiens
  misc_feature: GYAE6OF02IR3WY.10.20.B09.1.454.CMB.1.raw
  modified_base (126)..(126): a, c, t, g, unknown or other
  misc_feature (126)..(126): n is a, c, g, or t
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (493)..(493): a, c, t, g, unknown or other
  misc_feature (493)..(493): n is a, c, g, or t
tcagcatagtagtggcacgaccggtgctcgatttagtgtagtgtgaagggggaggaactgctcagttacggacccagacggaaccatggaacgccccagcgcagcttctcttcctcctgctactcnggctccagacaacatgcagaaatagttatgacgcagtctccagccaccgtgtctgtgtctcgaggganagacgacccaccttcnccgtgccgacgggccggtanagtaactagttcgactaaccctaaattgaccttggtatacgaaaacaaacgcctggcctacggcctaccccgaagttacctccgtacctaacgttactcgtacggtacgctaacgtccgttaccggcgggtaccctaggtcggtacgttccccgagtccgtaaggttcgtaaggtccgtcgtaggggtacgggtacctggggtaaacctaggtaacggttccaccgttcgaacctaccgatttaccggacggccgtaccacgngtacgtcgtagtacgttatttgaaccgttagttttaaccttgggatacggcagtaataattagtcggtaactttagggttttacttccgggtatttacccggggtaccggtaaggttaaacccgtaaagttggtaccgttttaaccgaaaccgggtaaccggttaccgtaaaggggttccgttaaccgttaccggtaacccgttaactccccgtttaaaggttccccttttaacggttacccgttaacc

SEQ ID NO: 39457 - DNA, 186 bp, Homo sapiens
  misc_feature: GYAE6OF01DIMV4.49.57.F02.1.454.CMB.1.raw
  modified_base (181)..(186): a, c, t, g, unknown or other
  misc_feature (181)..(186): n is a, c, g, or t
tcagagtcgagagacacgaccggtgctcgatttagctcgatatagttgggtttgggggtttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 39458 - DNA, 183 bp, Homo sapiens
  misc_feature: GYAE6OF01AH51N.49.57.F02.1.454.CMB.1.raw
  modified_base (173)..(183): a, c, t, g, unknown or other
  misc_feature (173)..(183): n is a, c, g, or t
tcagagtcgagagacacgaccggtgctcgatttagctcgatatagttgggtttgggggaagaggaagactgacggtcccccaggagttcaggtgctgggcacagcggccctgggctgcctggtcaaggactacttcctcgtagcactctgagcgggctggcaaggcgcatagnnnnnnnnnnn

SEQ ID NO: 39459 - DNA, 761 bp, Homo sapiens
  misc_feature: GYAE6OF01DKUSE.49.57.F02.1.454.CMB.1.raw
  modified_base (256)..(256): a, c, t, g, unknown or other
  misc_feature (256)..(256): n is a, c, g, or t
tcagagtcgagagacacgaccggtgctcgatttagctcgatatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcactacggaaccaccaatgacgttgtactatattctntctctaggtaccaactaactacccggacaaacgtaccccaaactcatgtattcgtttgaggtctagtgactccggcccgtacgtaggggtttctctacgtccgtcctttcgtccggtcctacctaacggtcgtacggacaacgcccgaccggtaccctcccgtacgtaacctacgttccgtacgttcggggccctaccgcgggtacgtacgggaacggacggtaggtaccgtagttacgtttaacgttactcggacagtcctacgtaattaagtaaaccaaaactaacgttaaaccgtacggggtttaggggttaaccgggttcccggggtaaccggggacccgggtaaaaacccgtaaaccgtaccggggtaaacccccgtttccgaaacccgggtttaccgaaacccggtaccccggtaaagggtcccccgttccccggacccccccgtttcggtaaccccgttaacctttccccggtccccggtttccccccggttcccccc

SEQ ID NO: 39460 - DNA, 187 bp, Homo sapiens
  misc_feature: GYAE6OF02G25NR.49.57.F02.1.454.CMB.1.raw
  modified_base (181)..(187): a, c, t, g, unknown or other
  misc_feature (181)..(187): n is a, c, g, or t
tcagagtcgagagacacgaccggtgctcgatttagctcgatatagttgggtttgggggtttgggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 39461 - DNA, 181 bp, Homo sapiens
  misc_feature: GYAE6OF02IWNY1.49.57.F02.1.454.CMB.1.raw
  modified_base (181)..(181): a, c, t, g, unknown or other
  misc_feature (181)..(181): n is a, c, g, or t
tcagagtcgagagacacgaccggtgctcgatttagctcgatatagttgggtttgggggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 39462 - DNA, 181 bp, Homo sapiens; identical to SEQ ID NO: 39461
  misc_feature: GYAE6OF02IKELA.49.57.F02.1.454.CMB.1.raw
  modified_base (181)..(181): a, c, t, g, unknown or other
  misc_feature (181)..(181): n is a, c, g, or t

SEQ ID NO: 39463 - DNA, 182 bp, Homo sapiens
  misc_feature: GYAE6OF02IGS7X.49.57.F02.1.454.CMB.1.raw
  modified_base (182)..(182): a, c, t, g, unknown or other
  misc_feature (182)..(182): n is a, c, g, or t
tcagagtcgagagacacgaccggtgctcgatttagctcgatatagttgggtttgggggtttgggggaagaggaagactgacggtccccccaggagttcaggtgctgggcacagcggtcctgggctgcctggtcaaggactacttcctctctcgactctgagcgggctggcaaggcgcatagn

SEQ ID NO: 39464 - DNA, 182 bp, Homo sapiens
  misc_feature: GYAE6OF02GNE3N.49.57.F02.1.454.CMB.1.raw
  modified_base (182)..(182): a, c, t, g, unknown or other
  misc_feature (182)..(182): n is a, c, g, or t
tcagagtcgagagacacgaccggtgctcgatttagctcgatatagttgggtttgggggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 39465 - DNA, 182 bp, Homo sapiens
  misc_feature: GYAE6OF02G3PGI.49.57.F02.1.454.CMB.1.raw
  modified_base (181)..(182): a, c, t, g, unknown or other
  misc_feature (181)..(182): n is a, c, g, or t
tcagagtcgagagacacgaccggtgctcgatttagctcgatatagttgggtttgggggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 39466 - DNA, 244 bp, Homo sapiens
  misc_feature: GYAE6OF02J0021.49.57.F02.1.454.CMB.1.raw
  modified_base (127)..(127): a, c, t, g, unknown or other
  misc_feature (127)..(127): n is a, c, g, or t
  modified_base (142)..(142): a, c, t, g, unknown or other
  misc_feature (142)..(142): n is a, c, g, or t
  modified_base (163)..(163): a, c, t, g, unknown or other
  misc_feature (163)..(163): n is a, c, g, or t
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (189)..(194): a, c, t, g, unknown or other
  misc_feature (189)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (200)..(244): a, c, t, g, unknown or other
  misc_feature (200)..(244): n is a, c, g, or t
tcagagtcgagagacacgaccggtgctcgatttagctcgatatagttgggtttgggctggcaaggcgcatagtgacgggctggcaaggcgcataggtgacgggctggacaaggcgcatagtgcggtnggacaggcgcatagnggacgggctggacagcgctanagcggctggcagngcagtngngcagnnnnnngngngnnnnnnnnnnnnnnnnnnnnnnnnnnnnnnnnnnnnnnnnnnnnn

SEQ ID NO: 39467 - DNA, 191 bp, Homo sapiens
  misc_feature: GYAE6OF02HY353.49.57.F02.1.454.CMB.1.raw
  modified_base (182)..(191): a, c, t, g, unknown or other
  misc_feature (182)..(191): n is a, c, g, or t
tcagagtcgagagacacgaccggtgctcgatttagctcgatatagttgggtttggggggtttgggggaagaggaagactgacggtcccccaggagttcaggtgctgggcacagcggccctgggctgcctggtcaaggactacttcctctctcgactctgagcgggctggcaaggcgcatagnnnnnnnnnn

SEQ ID NO: 39468 - DNA, 550 bp, Homo sapiens
  misc_feature: GYAE6OF01CRDCH.24.36.D03.1.454.CMB.1.raw
  modified_base (255)..(255): a, c, t, g, unknown or other
  misc_feature (255)..(255): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (531)..(550): a, c, t, g, unknown or other
  misc_feature (531)..(550): n is a, c, g, or t
tcagactactatgtcacgaccggtgctcgatttagctgcgtcacgatcctcttcgttaggaattgtctcgtggaggttgggtttctagttatgtagtggcgagtggggaggacatactacgcagacctccgtgggacgggggtccgttcccacccctcctccaagagaactaacttaccaaagaactacgttgtatactaacaaatgaacacgaccgtaagggtccgaacgacgaccggccgtacttaattacgnggccgcgagtgaccgtccccggactccgaccccgaacggctagtcgactacgtacggtccgggggacccccggaccgacggtccaccgtcctcctcacgccctaccaaccgacggcccagtccggtcccttccccgnggcccgccctgcctccgagggacnccacccgcgagcncacgngcccggccgtgggctcgccgtggacaacgtctaccctccactagtagtacgtcgtaggacgggccgggtcgtgggacgaacgggccgacgagtacgnnnnnnnnnnnnnnnnnnnn

SEQ ID NO: 39469 - DNA, 523 bp, Homo sapiens
  misc_feature: GYAE6OF01BKOWT.24.36.D03.1.454.CMB.1.raw
  modified_base (482)..(482): a, c, t, g, unknown or other
  misc_feature (482)..(482): n is a, c, g, or t
  modified_base (487)..(497): a, c, t, g, unknown or other
  misc_feature (487)..(497): n is a, c, g, or t
  modified_base (499)..(523): a, c, t, g, unknown or other
  misc_feature (499)..(523): n is a, c, g, or t
tcagactactatgtcacgaccggtgctcgatttagctgcgtcacgatctctcttggaattgtctctggagtgggtttcagttatgtatggcgatgggaggacatactacgcagactccgtggaggggccggttcaccctctccagagacaattccaagaactacgttgtatctacaaatgaaacagcctaagggtcgacgacacggccgttctattactgcgcgagtgacttccccggactcgcccaacggcatcgcactcggtcgggccccggacacggtccaccgtcctcctcacgccctaccgacgaacgggcccacgtccggttccttcccccgtggcccgccctcgcctcgacggcgccaccgtcgagacgcaccgagccggcctgggctcgccgtcggtacaacggtaccttaccgtccaactagtacggtaacgtcgtacggacggcggcgtcgggaaccgaaggccgataacgngtcannnnnnnnnnntnnnnnnnnnnnnnnnnnnnnnnnnn

SEQ ID NO: 39470 - DNA, 435 bp, Homo sapiens
  misc_feature: GYAE6OF02GAXY6.24.36.D03.1.454.CMB.1.raw
  modified_base (365)..(365): a, c, t, g, unknown or other
  misc_feature (365)..(365): n is a, c, g, or t
  modified_base (426)..(435): a, c, t, g, unknown or other
  misc_feature (426)..(435): n is a, c, g, or t
tcagactactatgtcacgaccggtgctcgatttagctgcgtcacgatctctcttgggcagtcagtcgccatctcctgcactggaaccaacaatgatattggtggttataactatgtctcctggtaccaacatcaccccggcaaagcccccaaactcctaatttttggtgtctatcaacggccctcaggggtccctgatcgcttctctgcttccaagtctggcaacacggcctccctgaccatctctgggctccaggctgaggatgaggctgactattattgctgctcatatgcaggcaactccggatctgtcttcgggactggggaccatggtcaccgtcctcggtcagcccaaggccaaccccnctgtcactctgttcccaccctcctcacatagtagtctgagcgggctggcaaggcgcatagnnnnnnnnnn

SEQ ID NO: 39471 - DNA, 128 bp, Homo sapiens
  misc_feature: GYAE6OF02JG11Z.24.36.D03.1.454.CMB.1.raw
  modified_base (122)..(122): a, c, t, g, unknown or other
  misc_feature (122)..(122): n is a, c, g, or t
  modified_base (127)..(128): a, c, t, g, unknown or other
  misc_feature (127)..(128): n is a, c, g, or t
tcagactactatgtcacgaccggtgctcgatttagctgcgtcacgatctcgtcttggaattgtctctggagtgggtttcagttatgtatggcgatgggaggacatactacgcagactccgtnagggnn

SEQ ID NO: 39472 - DNA, 545 bp, Homo sapiens
  misc_feature: GYAE6OF02G8IL6.24.36.D03.1.454.CMB.1.raw
  modified_base (174)..(174): a, c, t, g, unknown or other
  misc_feature (174)..(174): n is a, c, g, or t
  modified_base (215)..(215): a, c, t, g, unknown or other
  misc_feature (215)..(215): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
  modified_base (510)..(511): a, c, t, g, unknown or other
  misc_feature (510)..(511): n is a, c, g, or t
  modified_base (513)..(545): a, c, t, g, unknown or other
  misc_feature (513)..(545): n is a, c, g, or t
tcagactactatgtcacgaccggtgctcgatttagctgcgtcacgatctctcttggaattgtctctggagtgggtttcagttatgtatggcgatgggaggacatactacgcagactccgtggaggggccggttcaccctctccagagacaattccaagaacacgttgtatctanaaatgaacagcctaagggtcacgacacggccgtctattacngcgcgagtgactcccggactgaccccaacggcagtgacacgtacgtcggggggcccccggaccacggtcacccgtctcctcagccctccaccgaagggccccagtccgggtccttcccccgnggcccgccctgcctccgaggacnccacctccgganacgccacgacggcccggccccgtggggcctcggcccgttgggtaaccgaaacgggtacccttaccttcccaactagtaacggttttacgcgtacggcgggcggggtcctcgggtacgaaagggcgacgtagtagcganngnnnnnnnnnnnnnnnnnnnnnnnnnnnnnnnnn

SEQ ID NO: 39473 - DNA, 474 bp, Homo sapiens
  misc_feature: GYAE6OF02HRYOQ.24.36.D03.1.454.CMB.1.raw
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (451)..(474): a, c, t, g, unknown or other
  misc_feature (451)..(474): n is a, c, g, or t
tcagactactatgtcacgaccggtgctcgatttagctgcgtcacgatctctcttgggcagtcagtcgccatctcctgcactggaaccaacaatgatattggtggttataactatgtctcctggtaccaacatcaccccggcaaagcccccaaactcctaatttttggtgtctatcaacggccctcaggggtccctgatcgcttctctgcttccaagtctggcaacacggcctcctgaccatctctgggctccaggctgaggatgaggctgactattatgctgctcatngcaggcaactcggatctggtcttcgggactggggaccagtcggtcctaccgtcctcggtcacggccccaagggccccaaccccncttcgctaccgttctcgttccccaccctcccnctaacattacgtatcgtagacggtcgggctgggacaggcgcagtagnnnnnnnnnnnnnnnnnnnnnnnn

SEQ ID NO: 39474 - DNA, 519 bp, Homo sapiens
  misc_feature: GYAE6OF02HDQQO.24.36.D03.1.454.CMB.1.raw
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (332)..(332): a, c, t, g, unknown or other
  misc_feature (332)..(332): n is a, c, g, or t
  modified_base (487)..(519): a, c, t, g, unknown or other
  misc_feature (487)..(519): n is a, c, g, or t
tcagactactatgtcacgaccggtgctcgatttagctgcgtcacgatctctcttggaattgtctctggagtgggtttcagttatgtatggcgatggggaggacatactacgcagactccgtgaggggccggttcaccctctccagagacaattccaaagaacacgttgtatctacaaatgaacagcctaagggcacgacacggccgtntattactgcgcgagtnatccccggatcgccccaacggcatgccactaccgtcggggcccccgggaccacggtcaccgtctcctcagccctccaccaagggcccatccggtcttccccctggccnccctgcctccaggcgccacctccgagacgcacgacgccgggcccgtgggcctcggcccttgggtaccgaaagggaccttaccgttacccaacacgttacgtacgtcctggacggcggggactgggtaccaagggccgacctaagtagctagcgtnnnnnnnnnnnnnnnnnnnnnnnnnnnnnnnnn

SEQ ID NO: 39475 - DNA, 608 bp, Homo sapiens
  misc_feature: GYAE6OF02HJPCA.24.36.D03.1.454.CMB.1.raw
  modified_base (216)..(216): a, c, t, g, unknown or other
  misc_feature (216)..(216): n is a, c, g, or t
  modified_base (570)..(571): a, c, t, g, unknown or other
  misc_feature (570)..(571): n is a, c, g, or t
  modified_base (574)..(608): a, c, t, g, unknown or other
  misc_feature (574)..(608): n is a, c, g, or t
tcagactactatgtcacgaccggtgctcgatttagctgcgtcacgatctctcttggaattgtctctggagtgggtttcagttatgtatggcgatgggaggacatactacgcagactccgtgaggggccggttcaccctctccagagacaattccaagaacacgttgtatctaacaaatgaacagcctaagggtcgacgacacggccgtctattacngccgcgagtgactccccgggactcgaccccgtaaagggcctaagttcggaccaaccgttaaccgggtccggggggccccccgggaaccaccgggtccaacccggttcctcccctcgacgcccctacccgaacccgaacggggcccctagtcccgggtcccttccccccgtggcccgccccgtcgccgtccgacggacgcctacccgtccgaagtacgaccacgaccggcccggtcccgtggggacctccggtccgtgggtaccgaaacggtaccttacccttaccaacgtacgttacgttaacgtccgtagggacggcgggtacgtgggaaccgacgggcgactaacgtagacnncgnnnnnnnnnnnnnnnnnnnnnnnnnnnnnnnnnnn

SEQ ID NO: 39476 - DNA, 223 bp, Homo sapiens
  misc_feature: GYAE6OF01CLDGP.7.89.I01.1.454.CMB.1.raw
  modified_base (219)..(223): a, c, t, g, unknown or other
  misc_feature (219)..(223): n is a, c, g, or t
tcagcgtgtctctacacgaccggtgctcgatttagtatgctagtatcgcggggacgagggccgattattactgcgggacctgggataccagtctgagttctgtggtgttcggcggagggaccaagctgaccgtcgcaggtcagcccaagtctgcccctcggtcactctgttcccaccctcctctagagacacgctgagcgggctggcaaggcgcatagnnnnn

SEQ ID NO: 39477 - DNA, 220 bp, Homo sapiens
  misc_feature: GYAE6OF01COSDM.7.89.I01.1.454.CMB.1.raw
  modified_base (219)..(220): a, c, t, g, unknown or other
  misc_feature (219)..(220): n is a, c, g, or t
tcagcgtgtctctacacgaccggtgctcgatttagtatgctagtatcgcggggacgaggccgattattactgcgggacctgggataccagtctgagttctgtggtgttcggcggagggaccaagctgaccgtcgcaggtcagcccaagtctgccccctcggtcactctgttcccgccctcctctagagacacgctgagcgggctggcaaggcgcatagnn

SEQ ID NO: 39478 - DNA, 219 bp, Homo sapiens
  misc_feature: GYAE6OF02IWEY8.7.89.I01.1.454.CMB.1.raw
  modified_base (217)..(219): a, c, t, g, unknown or other
  misc_feature (217)..(219): n is a, c, g, or t
tcagcgtgtctctacacgaccggtgctcgatttagtatgctagtatcgcgggacgaggccgattattactgcgggacctgggataccagtctgagttctgtggtgttcggcggagggaccaagctgaccgtcgcaggtcagcccaagtctgcccctcggtcactctgttcccaccctcctctagagacacgctgagcgggctggcaaggcgcatagnnn

SEQ ID NO: 39479 - DNA, 283 bp, Homo sapiens
  misc_feature: GYAE6OF02FYJE8.7.89.I01.1.454.CMB.1.raw
  modified_base (231)..(231): a, c, t, g, unknown or other
  misc_feature (231)..(231): n is a, c, g, or t
  modified_base (237)..(283): a, c, t, g, unknown or other
  misc_feature (237)..(283): n is a, c, g, or t
tcagcgtgtctctacacgaccggtgctcgatttagtatgctagtatcggcggggacgaggccgattattactgcgggaccgtcgggataccagtcctgaggttctgtgggtgttcggcggaggggaccaagcgtgacccgtcgcaggtcagcccaagtctgcccccctcggtcacctcctcgttccccgcccctcctctagagacacggcgtgagcgggctggacaaggcncagtgnnnnnnnnnnnnnnnnnnnnnnnnnnnnnnnnnnnnnnnnnnnnnnn

SEQ ID NO: 39480 - DNA, 201 bp, Homo sapiens
  misc_feature: GYAE6OF01DZ7O2.3.81.H04.1.454.CMB.1.raw
  modified_base (200)..(201): a, c, t, g, unknown or other
  misc_feature (200)..(201): n is a, c, g, or t
tcagagacgcactccacgaccggtgctcgatttagtagtgtagattcgcgggcacgaccggtgctcgatttagtagtgtagattccgcgggcacgaccggtgctcgatttagagagcgtcacaggggcacagcggcctgggctgcctggtcaaggactacttccgagtgcgtctctgagcgggctggcaaggcgcatagnn

SEQ ID NO: 39481 - DNA, 755 bp, Homo sapiens
  misc_feature: GYAE6OF01ALS4Q.3.81.H04.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
tcagagacgcactccacgaccggtgctcgatttagtagtgtagattcgcgggggaacgtggctcagttaggacccagacggaaccatggaagcccagcgcagcttctcttcctcctgctactctggctccagatatcactggaagaaacagtgctgacgcagtctccagccacctgtctgtgtctcgaaggggaancgccaccctctcctgcacggccagtcagngtgtagncaatgccgtgtaccngctagttattcgtcggcacggtcctacccgagccgtcctacgtactcgtacgtggtcgcctactcccgaacccgggcctagttcgggtaactccccggagtaccgtggttacgacggtcggtacctagggtttcgggccgtacgggacgtacgggttctttaccgaccgttacctaccgtaacacggttaccgaacgtccgtacgtaccggtacgggtaacctcggttacgaaacgtacccgttagttccgaagtttaacggttttagttaccgtggttccgtaacgttaaccgtaagttttaactaacggttttaaccggtttaccggggacccgggttttagggggtaaacccttttaccggggaaccggtaaaaccggggttaacggtaaaacggggttaaaccgttaaaggtaaacccggtaaaaacggttacggttaggggtaacgtcggtacgtaacccaacggtacgtttaccgtagtttccgtaacgttactacccccgg

SEQ ID NO: 39482 - DNA, 707 bp, Homo sapiens
  misc_feature: GYAE6OF02JQQE5.3.81.H04.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (265)..(265): a, c, t, g, unknown or other
  misc_feature (265)..(265): n is a, c, g, or t
tcagagacgcactccacgaccggtgctcgatttagtagtgtagattcgcgggggaacgtgctcagttaggaccagacggaacatggaagcccagcgcagctctcttctcctgctactctggctccagatatcactggaagaaacagtgctgacgcacgtctcagccaccctgtctggtgtcaccgtaggggaaanagcccacctctccngccagggtccacgtcagacggtgttacgacgactaacttaggcctaggtaaccganctaattacgtttcgtcggccgacggtcgtcccctaggggccttccctacaagttcttcggtaggtccgtacacccgtacccgtacccggtacccgtaccgtacgtaccgtaccgtaccgtaccgtacggtacgtacggtcggtacgtcggtcggtcggtacggtacgtacgtacgtacgtacgtacctaccgtaccgtacgtacgtacgacgtaccgtaccggtacggtacggtacgtacgtaacgtacgtacgtacgtacgttacgtttacgttacgttacgtacgtacgtacgtaagttaacgttaacgttacgtaccggtacggtacggttacggttaccggtaacggtaacggtaacggtaacggtacgtaacgtaacgtaacgtacgtacggtacgtacgtacgtacgacgtaccgtacgtacgttacgtacgtacg

SEQ ID NO: 39483 - DNA, 436 bp, Homo sapiens
  misc_feature: GYAE6OF02HAIS1.40.58.F03.1.454.CMB.1.raw
  modified_base (424)..(436): a, c, t, g, unknown or other
  misc_feature (424)..(436): n is a, c, g, or t
tcagtctagcgactcacgaccggtgctcgatttagtctgatcgagaagggaaaggggctggagtgggttggccgtgttaagaccaaacctgagggtgggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccagggaaccctggtcaccggtctcctcagcctccaccaagggcccatcggtcttccccctggccgccctgctccaggagcacctccgagacgcacagcggccctgggctgcctggtcaaggactactccagtcgctagactgagcgggctggcaaggcgacatacgnnnnnnnnnnnnn

SEQ ID NO: 39484 - DNA, 536 bp, Homo sapiens
  misc_feature: GYAE6OF02HXHZQ.40.58.F03.1.454.CMB.1.raw
  modified_base (280)..(280): a, c, t, g, unknown or other
  misc_feature (280)..(280): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (507)..(509): a, c, t, g, unknown or other
  misc_feature (507)..(509): n is a, c, g, or t
  modified_base (511)..(536): a, c, t, g, unknown or other
  misc_feature (511)..(536): n is a, c, g, or t
tcagtctagcgactcacgaccggtgctcgatttagtctgatcgagaagggaaaggggctggagtgggttggccgtgttaagaccaaacctgaggggtggggcaatagactacgctgcacccgtgacaggcagattcgccatctcaagagatgattcagcaggcacggtgtatctggaaatgaacagctagaaagccgaggacacagccgtgtattattgtaccgcgagggctcggctacgtccgatactgactagtcgggccaggacctggtcaccgtcncctcacgcctccacgaaggcccagtcggtccttccccgnggccncccgtgcctccgaggacnccaccctccgagacgccacgacgccggtcccgttgggcctgccgttgggtacaaacggtacccttaccgttacccaaggttacgacgttaaggaacccttgggaacgggtccggggaccgtttgggaccgaaacggggtcacccgaagttaggnactnacgtncnnnannnnnnnnnnnnnnnnnnnnnnnnnn

SEQ ID NO: 39485 - DNA, 531 bp, Homo sapiens
  misc_feature: GYAE6OF01DI3FV.19.36.D03.1.454.CMB.1.raw
  modified_base (285)..(285): a, c, t, g, unknown or other
  misc_feature (285)..(285): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaagggcctctgattacacctttagcaactacggcatcacctgggtgcgacnggcccctggacaagggcttgagtggatgggatggatcgagcgcttacagtcaataacacaaactatgaccaaccgaactcgaggcaagacgtcaccataaccacagacacatccacgagcacagacctacagtaggaactggagggacgcctaggacgaggctaggaccgaacgacgggccgttagtattacgtgtaggacggaagtgggggaggtattagttcgtacgtagatcgtctaccgtcg

SEQ ID NO: 39486 - DNA, 626 bp, Homo sapiens
  misc_feature: GYAE6OF01DBWBL.19.36.D03.1.454.CMB.1.raw
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
tcagtactctcgtgcacgaccggtgctcgatttagctgcgtcacgatctctcttgggacccaaaaccacacccctccttgggagaatcccctagatcacagctcctcaccatggactggacctggagcatccttttcttggtggcagcagcaacaggtgcccactctcgagggtcagctggtgcagtctggagctaggagggttaagaaggccgtggggcctcgagtgaaggtcgcctgcaggcctntgattacaccttagacaacgtacggctatcaccgtgggtcncgacgacggcccctaggacgaagggtcttggaggtggagtgggagtaggatcgagtcgtacttacgacgtacaactaaacgaactaaactagtacgaccaaccggtaaacctccgaacgggacaggaaccgtaccaacctaacgtaaacccacgaacgacaacacgtaccgaacgacgcaacgacgacctaacgagtacgggaactaggacggtacgacctaggacgagtccgtagaccgacgaccggtacgtagttacgtacgttggacggtacgtaaagggtgggggaaacgtagtttacgttaggttaactacggtagttacgcccgttagttcg

SEQ ID NO: 39487 - DNA, 580 bp, Homo sapiens
  misc_feature: GYAE6OF01DGMS7.19.36.D03.1.454.CMB.1.raw
  modified_base (284)..(284): a, c, t, g, unknown or other
  misc_feature (284)..(284): n is a, c, g, or t
  modified_base (330)..(330): a, c, t, g, unknown or other
  misc_feature (330)..(330): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtgcgacnggcccctggacaagggcttgagtggatgggatggatcgagcgctanagtcaataacaacaaactatagacaaccgaaactccgagggcagatacacataaccacagacacatccaacgacgacacacgacctaacatacgggaactaggaagggacgacccgttaggaacgtagacgtaggaacccgtaacgaccgggccggttagtacgtttaccgtggtacgacggtaaaacggttggggggaagttaagttaagtttagtaccgttaggtagttaggcccgttaccgttccgg

SEQ ID NO: 39488 - DNA, 554 bp, Homo sapiens
  misc_feature: GYAE6OF01AQA31.19.36.D03.1.454.CMB.1.raw
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtgcgacacggcccctggacaagggcttgagtggagtgggatggatcgagcgtacttacgagtcaataaacgaacaaactatcgaccaaccgaaactccgaagggccaagacgtccaaccgaactaacccacacgaactaacactaccgacgacgtaccacacgcctaacagtacgaactgacgggacgccgtagacgacgtcgtaggaccgacgaccggcgtagtacttacgtgtagacgtaaggtgggagtatagttgtactgatcgtctcgtacg

SEQ ID NO: 39489 - DNA, 708 bp, Homo sapiens
  misc_feature: GYAE6OF01D58SN.19.36.D03.1.454.CMB.1.raw
  modified_base (257)..(257): a, c, t, g, unknown or other
  misc_feature (257)..(257): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcattccttttcttgggtggcagcagcaacaggtcgcccactctcgagggtcagcgtggtgctagtcgtggagctggaaggttaagacgccgtggggcctcgagtagaggtccgctgcaaggtcctcgtnacttacactttagactaacgtacggctactacgaccggtggtcgaccgacgaccggcccgtaggaacgaacgggtctggacgtagggagtgggagtcggatccggaacgtccgtacttaacgagtacctaaactaaacgaaactaaacgtagttaccgaaaccgtaaccggtaaacgtaccggaagggacctaaagtaccggttaaccaaacccgtaaacgtaaacccgaacgaacgaaccgaactaccgtaacccgaacgaacgtaccaaccgtaacgtacctaacgaccggtaacggaacgtaggaccggaacgtcctaacggagtaccgtacgtaacggaccgtaaccgcgggttaaccgtgttaaccgttacggaggtacggtaacggtaaagggtggggtaacgtagttagttacgggtataggtaccgtcgtacgtaccgttcgg

SEQ ID NO: 39490 - DNA, 548 bp, Homo sapiens
  misc_feature: GYAE6OF01BAWXC.19.36.D03.1.454.CMB.1.raw
tcagtactctcgtgcacgaccggtgctcgatttagctgcgtcacgatctctcttgggacccaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaggcctctgattacaccttagcaactacggcatcaccgtgggtgcgacgacggcccctggacaagggcttgagtggatgggatggatcagcgcttacagtacataacacaaactatagacaaccgaactccgaggcagacgtcacataaccacagacacataccacgacgacacacgacctaacacgtacggaactagaacggacgacctaggaggacgacgtacggaccgacgaccggcgtagtattacgtgtaggacgaaggtggggaaggtacgttagttacggttacgtaggtagtacgtcgtacgttacg

SEQ ID NO: 39491 - DNA, 705 bp, Homo sapiens
  misc_feature: GYAE6OF01DK3UP.19.36.D03.1.454.CMB.1.raw
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtcgcccactctcgagggtcagcgtggtgcagtctggagctggaggttaagagccgtggggcctcgagtagaacggtcgcctgcgaaggcctctgtacttactacctttagaccaacgtacggcatccgaccgtgggtcgcgacgacggcccgtaggacgaagggtcttaggaggtggagtgggataggatcgagcgtctacgagtacaataaaccaacgaaactagtacgtaaccgaaccgtaaacgtccgaagggacaacggtaacgtaccaacctaactaaacccgaacgacgtaaccaccgtaactaccgaacgacgaccaaccgacgtaaccctaacgtaacgtacggaaacgtcggaacgggaccgtaccgtaaggacgacggtaccgtaggaaccggtaccggaccgggttaccggttaacgttaacgttaccggttagggtaacgggtaacgggtaaaagggttggggggtaaacgttaaggtttacgttttaacgggtaactttacggtaacggttcgttacccgttagtttacccggg

SEQ ID NO: 39492 - DNA, 764 bp, Homo sapiens
  misc_feature: GYAE6OF01BMK8H.19.36.D03.1.454.CMB.1.raw
tcagtactctcgtgcacgaccggtgctcgatttagctgcgtcacgatctctcttgggacccaaaaccacacccctccttgggagaatcccctagatcacagctcctcaccatggactggacctggagcatccttttcttggtggcagcagcaacaggtgcccactctcgagggtcagctggtgcaggtctgggagcgtggaaggttaagaacgccgtggggcctcaggtggaacggtcgccgtggacgaagggccttacgtagtaacttaaccaccttttaggacctaaacgttaccgggactaattccgaacccgttggggtacgaccggaaccgaccgggtcccccgtagggaaaccgtaaggggcctttagggtaaggtcggggaagtggggagtacgggtagtacgtacggtaccggtaccgtttaacgaacggttaccaaacgttaaaacccaaacgaaaaccgttagtaccggtaaccaaacccggaaacttacccggaacggggaccaaacggtacgtaacccaactaaacgtaaacccgaacaacggaaccaacgtacacccgaagaccgacaacccgagaccctaagacgacgtaacgtaggaacgtacggacctaggaaggacgcgtaacggaaccgtaccggaacggtcggttaagtacgtttagacgggttaacggaaacggtaaggttacggggggaaatttaagttaaggttcgttaacggaggtactttacgggcttacccggtttacg

SEQ ID NO: 39493 - DNA, 623 bp, Homo sapiens
  misc_feature: GYAE6OF01CVOZ4.19.36.D03.1.454.CMB.1.raw
  modified_base (182)..(182): a, c, t, g, unknown or other
  misc_feature (182)..(182): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagtactctcgtgcacgaccggtgctcgatttagctgcgtcacgatctctcttgggacccaaaaaccacaccctccttgggagaatcccctagatcacagctcctcaccatggactggacctggagcatccttttcttggtggcagcagcaacaggtgcccactctcagggtcagctggtncagtctggagctgaggttaagagcctggggcctnagtgaaggtcgctgcaaggcctntgattacacctttagcaactacggcatcaccgtgggtgcgacgacggccctaggacaagggtcttaggagtggatggggatggactcgagcgtcttacagtcaagtaacacaaactatacgactaaccgaactcgaggcagacacaccagtaaccacagacacatccacgagccacacgtccctacagtacggacaggacggacgccgtaggacgacggtaccgtacggaacccggaaccggtaccgggtacccgggttacggttaacgttttaacccggtaggttacgggtaaccggtaaaaggttcgggggggaaagttacggttaagtttacggttaaccggttaggtaacggtttaccggtccgttaacccggttaccgg

SEQ ID NO: 39494 - DNA, 744 bp, Homo sapiens
  misc_feature: GYAE6OF01A6KKJ.19.36.D03.1.454.CMB.1.raw
  modified_base (208)..(208): a, c, t, g, unknown or other
  misc_feature (208)..(208): n is a, c, g, or t
  modified_base (520)..(520): a, c, t, g, unknown or other
  misc_feature (520)..(520): n is a, c, g, or t
tcagtactctcgtgcacgaccggtgctcgatttagctgcgtcacgagtctcctcttgggacccaaaaaccacaccccgtccttggggagaactccccgtagatcacgacgctcctcaccatggactggacctggagcatcccgttttcgttgggtggccaggcagcgaactaggtcgcccctactcctaccagggttcagcgtcggtnaccagttccgtggagctaggacggttaagacgccgtggggcctcgagtggaaggtccgacctgacgaagggcctacgtacgtagttacctaccgtttagacctaaccgtcggactactaccgaccgtggggtacaccgaccgtaccggtccccgtagggaccgtacgggtccgttggaaggttgggacggttgggagtaggtatacgaggtccgtacgttacgacggtacaactaaccaacaaccgttacgtacggaaccaccggtaaccgaccggacggacgacgaacgtaccaaccgtactaacccgaanacgaaccctacgtacctaccgaacggacgtaccaaccgtacgtacccaacgtaggtaccggtatacgggacggacgtccgagacgtcgaccgtagggaaccgtacccggacggttacgtgtaaccgttacgtaccgggtaagtacggggtaggggaacggttcttaacgggttaactaaacgggttaccggtagttacccgggtacttccggtccgttacccgg

SEQ ID NO: 39495 - DNA, 505 bp, Homo sapiens
  misc_feature: GYAE6OF02IXW6P.19.36.D03.1.454.CMB.1.raw
  modified_base (279)..(279): a, c, t, g, unknown or other
  misc_feature (279)..(279): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtncgacaggcccctggacaagggcttgagtggatgggatggatcagcgcttacagtcataacacaaactatgcacgaaactcaggcagacgtcaccataaccacagacacatccacgagcacagcctacactggaactgaggagcctagagagctgacgacacggccgtgtacttactgtcgcgaaagtgggggaagtagtagttacgtacgtgatcgactaccgtcg

SEQ ID NO: 39496 - DNA, 594 bp, Homo sapiens
  misc_feature: GYAE6OF02JLT5E.19.36.D03.1.454.CMB.1.raw
  modified_base (187)..(187): a, c, t, g, unknown or other
  misc_feature (187)..(187): n is a, c, g, or t
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
  modified_base (556)..(556): a, c, t, g, unknown or other
  misc_feature (556)..(556): n is a, c, g, or t
tcagtactctcgtgcacgaccggtgctcgatttagctgcgtcacgatcgtcctacttgggacccaaaaaccacacccctccttcgggagaatcccctagatcacagctcctcaccatggactggacctggagtcatccttttctggtggcagcagcaacaggtgcccactctcagggtcagctggtncagtctggagctgaggttaagagcctgggctcgagtgaggtcncctgcaggcctctgattacactttagcaactcggcatccaccgtgggtncgacacggccccgtggacaagggcttggaggtggagtgggatcggatcgagcgtacttaacgacgtacaataacgaactaaacgtatagaccaaccgaaactccgaaggcaagacgtaccaacctaactaacccgaacgaacgaaccaactaacctaccgaacgacgaccaacgacgaaccctaacgacgtaacgtaacgtacggacgggtacgaccgtaggaacgtacgacgtagaccgtacgacggtccgtagtacgtacgtaggcgacgtaagnggggaactagtagtcgtacgtgagtccgcgtacgtacg

SEQ ID NO: 39497 - DNA, 560 bp, Homo sapiens
  misc_feature: GYAE6OF02I24PA.19.36.D03.1.454.CMB.1.raw
  modified_base (279)..(279): a, c, t, g, unknown or other
  misc_feature (279)..(279): n is a, c, g, or t
  modified_base (453)..(453): a, c, t, g, unknown or other
  misc_feature (453)..(453): n is a, c, g, or t
tcagtactctcgtgcacgaccggtgctcgatttagctgcgtcacgatctctcttgggacccaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcgagtgaaggtcgcctgcaaggcctctgattacacctttagcaactacggcatcacctgggtncgacacggccctggacaaggcttgagtgatgggatggatcgagcgacttacagtcaataacacgtaaactagtcgacaaccggaaactccgaagggacaggacgtaccaacaactaaccgacagaacacataccacgagcacagacctacatacgaatggaagacgctagagancgtagacgacgacggtccgtagtacttacgtggtacgtacggaaaggttgggggaacgtagttacgttacgttacgtaggtacgttacggtaccttaccggttacgg

SEQ ID NO: 39498 - DNA, 552 bp, Homo sapiens
  misc_feature: GYAE6OF02GAE4J.19.36.D03.1.454.CMB.1.raw
  modified_base (348)..(348): a, c, t, g, unknown or other
  misc_feature (348)..(348): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtgcgacaggcccctggacaagggcttgagtggatgggatggatcgagcgcttacagtcataacacaaactntgcacgaaactcgaggcagagtacaccaataaccacagacacactccaacgacgacacacgacctaacagtaggaacctggaagggacgccgtaggacgagtccgtagaaccgaccgaccggtcgtgttaacgtacgttggtaggacggtaaaggtgggggaagaatttagttacggttacgtaggatcggtacctacgttcgg

SEQ ID NO: 39499 - DNA, 563 bp, Homo sapiens
  misc_feature: GYAE6OF02GQ50E.19.36.D03.1.454.CMB.1.raw
  modified_base (352)..(352): a, c, t, g, unknown or other
  misc_feature (352)..(352): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagccgtggggcctcagtgaaggtcgcctgcaaggcctctgattacacctttagcaactacggcatcacctgggtgcgacaggcccctggacaagggcttggagtggatgggatggatcgagcgcttacagtacataacacaaactangacaaccgaaactccgagggcagacgtacaccataaccacacgacacactccacgacacacacgcctacataggaactgaacgggagacccgtggaacgacgcgtaggaccgacgaccggtccgtagtacttacgtggtcggaacggtaaacggtgggggaaggtaagttagtttacggtaacgttagtagtcggtaccttaaccgttcgg

SEQ ID NO: 39500 - DNA, 556 bp, Homo sapiens
  misc_feature: GYAE6OF02JYKFX.19.36.D03.1.454.CMB.1.raw
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagagcctgggcctcagtgaaggtcgcctgcaaggcctctgattacacctttagcaactacggcatcaccgtgggtgcgacacggccctggacaagggcttgacgtggagtgggatggatcgagcgcttacagtcataacacaaactatgacaacgaactcgagggcagagtcacactaaccacagacacactaccgaacgacgacaacacgacctaacgagtacggaactggaacggacgaccgtaggacgacgctaggaccgaacgaccggtaccgtagtacttacgtggtacggaacggaaacgtgggggagtaagttagttacgtacgtaggtactcgtaccgtacttcgg

SEQ ID NO: 39501 - DNA, 636 bp, Homo sapiens
  misc_feature: GYAE6OF02HI1JB.19.36.D03.1.454.CMB.1.raw
  modified_base (280)..(280): a, c, t, g, unknown or other
  misc_feature (280)..(280): n is a, c, g, or t
  modified_base (360)..(360): a, c, t, g, unknown or other
  misc_feature (360)..(360): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccatctcagggtcagctggtgcagtctggagctgaggttaagaagcctggggcctcgagtgaggtcgcctgcgaaggcctctgattacacctttagcaactacggcatcaccgtgggtncgacacggccctaggacaagggtcttggaggtggagtgggatggatgagcgtcttacgagtacaataaacaacctaaatntacgacaaccgaaactccgagggacaagacgtaccaacctaacgtaaacccaactaacggaaccaacgtaaccgtaccaaccggaacgacctaaccgacgtacccgtaacacgtaacgggaactacggacgggactcccggtagaacggacgtacgtacggaaccgaccggtacggtccgttagtaattaccggtaggtacggtaacggaaacggttgggggaagtaagtttagttacggttaacagggttacgttacgtaccgttaccgttacgg

SEQ ID NO: 39502 - DNA, 623 bp, Homo sapiens
  misc_feature: GYAE6OF02HZJ68.19.36.D03.1.454.CMB.1.raw
  modified_base (241)..(241): a, c, t, g, unknown or other
  misc_feature (241)..(241): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaggtcgcctgcaaggcctntgattacacctttagcaactacggcatcacctgggtncgacncggccctggacagggcttggagtggatgggatgggatcgagcgnttacgagtcataacanaactatagaccaacgaaactccgaagggacagacgtacaccaacgtaaccacgaacgaacacatcccaacgacgacaaccagacccttacgaagtacggaaaccgtaggaacgggacggacccttaggaacgtacggacgtacgaccggaccgtaaccggcccgttaggttaacctttacggtcggtacggtaaccgggtaaacgggtggggggtaacggttattaaggtttacggtaaccggtttaagggtagttacgggttcccttaaccgttccggg

SEQ ID NO: 39503 - DNA, 523 bp, Homo sapiens
  misc_feature: GYAE6OF02GKEET.19.36.D03.1.454.CMB.1.raw
  modified_base (443)..(443): a, c, t, g, unknown or other
  misc_feature (443)..(443): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtgcgacaggcccctggacgaagggcttgagtggatgggatggatcgagcgcttacagtcaataacacaaactatgacaccgaaactccagggcagacgtcaccataaccacagacacactccacgagcacacgacctacagtaggaactgaggacgcctaggacgngactgaaccgacgacggccgtagtattacgtgtacggacgtaaagtggggaagtagttagttagtactagatgcctatcg

SEQ ID NO: 39504 - DNA, 609 bp, Homo sapiens
  misc_feature: GYAE6OF02GHR12.19.36.D03.1.454.CMB.1.raw
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattaccacctttagcaactacggcatcacgtgggtgcgacgacggcccctaggacgaagggcttaggaggtggagtgggatggatcgagcgtacttacgagtcaactaaacaacaaactatacgacaaccgaaactccgaggacacgacgtaccaacctactaaaccacaacgaacaacactaccaacgaacgaccacgacgaccctaacgacgtacggaaactacggaacggacgtaccgtaggaacgacgacgtcggaaccgaaccggtaccggtccgtacgttacgttacgtcggtacggaacggtaaggtcgggggaaggtacgttagttacggtacgtagtacgtcgtaccgtacgttcg

SEQ ID NO: 39505 - DNA, 631 bp, Homo sapiens
  misc_feature: GYAE6OF02H3RFA.19.36.D03.1.454.CMB.1.raw
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctggaaggttaaggaagccgtgggggcctacgaggttaggaagggttcgccgtagcgaaggcccttagtgtaacttacctacctttagactaaaccgtacggactatccaccgttgggtcgccgaacgacggtccccgtagggaacgaacgggtcgttaggaaggttcggaagtggggatgggatcgacgcgtactacgagtcaataacaactaaatanacgacaaccgaacctcgaggcagntaccacgaataaccanacgaacactacgaccacgaacgctacacgtacctacaacgtacggaaacgtggaacgggacgaccggtagacggtacgacgtaacgaccgtacggaccgtacgtagttacgtacgtggtacggaagtaagggtaggggaagttataggttacgtaggtagtagttagtccgtagtaccg

SEQ ID NO: 39506 - DNA, 701 bp, Homo sapiens
  misc_feature: GYAE6OF02GC5TU.19.36.D03.1.454.CMB.1.raw
  modified_base (222)..(222): a, c, t, g, unknown or other
  misc_feature (222)..(222): n is a, c, g, or t
tcagtactctcgtgcacgaccggtgctcgatttagctgcgtcacgatctctcttgggacccaaaaaccacacccctccttgggagaatcccctagatcacagctcctcaccatggactggacctggagcattccttttcttggtggcagcagcaacaggtcgcccactctcgagggtcagctggtgcagtcgtggagctggaggttaagagccgtgggcctnagtgaaggtcgcctgcaacggcctcgtgtacttacctacctttagcctaacgtacggacacttaccgaccgtgggtcgaccgaccgacggcccccgtagggaaccgtaagggtcttaggacggtggagtgggtagtggactcgagtcgtactacgagtacaataacgaactaaactagtacgaaccgaaccgtaacctccgaaggaccaaggtaccgtaaccaacctaacgtaaaccacgaacgtaccaactaccgacccgaacgacgaccaaccgtaacgaccgtaacgtacgtaacggtaacgtaggaaccggacgtacccgtaggaacgtacgtaccgtaacggaaccgtaccggtaccggtaccgtttagtaaccgttacgtacggtacggtaaacggtaaacgggttaggggtaacgttacgtttaacggttcgttaacggtagttaacggtccgttaccgttacccggttacg

SEQ ID NO: 39507 - DNA, 826 bp, Homo sapiens
  misc_feature: GYAE6OF02ITLP8.19.36.D03.1.454.CMB.1.raw
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaacgccgtgggctcgagtggaaggtcgcctgacgaaggcctcgtgtacttactacctttagactaaacgtacggctactcgaccgtgggtcgacgaccacgggtccccgtaggacgaacgggtcgttaggaggtgggagtggggtagtacgggattcgacggaccgtacgttaaccaggtaccgtaagtaaaccaaacgtaaaaccgttagtacgaacccgtaaacccgaaaacctaccggaaggggtaccaacggtaacgttacccgaactaacccgtaaacccaacgtaaacgaacccaaccgtaactacccgaaacggtaccgacccgtaaccaaccgtaccctaaaccgtaaccggttaaccgggaaaccttagggaaaccgggaacggtaccccggttagggaaaccgggtacggtaccgtaacgggaacccgggtaaaccggtaacccgggtaacccggttacgggtttaaacgttttaacccggtcggggttaacggggtaacgggttaaaaacgggggttcggggggtaaaagggttaacgggttttaaagtttaaccggggtacgtttaacgggtaacggtttaccgggttaaccgttacccgggttacccgg

SEQ ID NO: 39508 - DNA, 578 bp, Homo sapiens
  misc_feature: GYAE6OF02FV9AS.19.36.D03.1.454.CMB.1.raw
tcagtactctcgtgcacgaccggtgctcgatttagctgcgtcacgatctctcttgggacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcaccgtgggtgcgacacggccctaggacgaagggcttgaggtggagtgggatggatgagcgtcttacgagtacaataacaacaaactatcgacaacgaaactccagggcaagactacaaccactaaaccacaacgacaacactaccgacgacgaccacacgcctaacagtacgggaactaggaacggacgccgtaggaggacgtacgtacggaaccgaaccgtaccgggacgttacgtacgtttacgtggtaggtacgaaagggtggggaaggtagttagtacgttacgtgacgtcgtacctattccgg

SEQ ID NO: 39509 - DNA, 749 bp, Homo sapiens
  misc_feature: GYAE6OF02F55BG.19.36.D03.1.454.CMB.1.raw
tcagtactctcgtgcacgaccggtgctcgatttagctgcgtcacgatctctcttgggacccaaaaaccacacccctccttgggagaatcccctagatcacagctcctcaccatggactggacctggagcatccttttctggtggcagcagcaacgaggtcgcccactctcgagggtcagctggtgcagtctggagcgtggaggttaagacgtccgtgggactcgacgtagtacggtacgtccgcgtagacgacgtcctgagttacttacgttagtacgaactaccggtacgactacgtaccgtagggtcggtacgaccggtaacggccccggtaccggaacggaacgggtacggttaggtacggtagggaggttaggggagtacggtagtaccgtacggacggtacgttaaccgttacgtaacgtactaaaccgtaaaccaaacttaacggtacgtacccgaaaccgtaaaccgtaccgacggggtacggaaccgacttaaccggaaccaacctaaaccgtaaccaacgaaccgtaaccaacctaaccgtacgaaccgtacgaacccgtaacgtacccgtaaaccgtaagtaaccgggtaaccgtaaacggtcgggaaacgacgtacggtacggacggtacgtaaccgggtacgtaaccgacccggttacgtacgttacgttacgtacggtacggaaggtaacggtagggtacgagtttacgacgttagcgtagtcgtactacggttac

SEQ ID NO: 39510 - DNA, 679 bp, Homo sapiens
  misc_feature: GYAE6OF02I5FHH.19.36.D03.1.454.CMB.1.raw
  modified_base (96)..(96): a, c, t, g, unknown or other
  misc_feature (96)..(96): n is a, c, g, or t
  modified_base (157)..(157): a, c, t, g, unknown or other
  misc_feature (157)..(157): n is a, c, g, or t
  modified_base (192)..(192): a, c, t, g, unknown or other
  misc_feature (192)..(192): n is a, c, g, or t
  modified_base (319)..(319): a, c, t, g, unknown or other
  misc_feature (319)..(319): n is a, c, g, or t
tcagtactctcgtgcacgaccggtgctcgatttagctgcgtcacgatctctcttgggacccaaaaaccacacccctccttgggagaatccctagancacagctctcacatggactggacctggagcatccttttctggtggcagcagcaacgaggtncccactctcagggtcaggctgggtgcagtctggancgtgtaaggtttaacgaagtccgtacggggtcccttgaaggttgaacggttcgccttaggaccaacggccttacgtagtaacttaacctacgtttacgacctaaactaccgtacaatcaccgtggtnacgacgacgtccgtaggacgtaggcgttagaggtaggagtaggagtaggtactcgaaggtcgtacttacgtagtacaacttaacaactaaacgtacgtacgactaaaccggaaacttacgacggtaacgaactaccgtacaacgtacctaaaccggacacaacgtaacacgtaccaacggaacgtaccaacgacgactaacgacgtagaacgacgtaggacgacgtaagacgtacgaccttacggaacgtaccggacgtacgtaacgttacgtacgtacgggtactaacgggtaacgtagggtaaggttacgtttaacgttacggtacgttaacgtacgtacgtaccgttcggttaaccg

SEQ ID NO: 39511 - DNA, 616 bp, Homo sapiens
  misc_feature: GYAE6OF02JUUF4.19.36.D03.1.454.CMB.1.raw
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
  modified_base (466)..(466): a, c, t, g, unknown or other
  misc_feature (466)..(466): n is a, c, g, or t
tcagtactctcgtgcacgaccggtgctcgatttagctgcgtcacgatctctcttgggacccaaaaaccacacccctccttgggagaatccctagatcacagctcctcaccatggactggacctggagcatccttttcttgggtggcacgcagacaacaggtcgcccactctcagggtcagctggtgactagtcgtggagtcgtaggaggttaaagaagccgtgggcctcgagtcggagtcgtctggacaaggccctgtnacttactaccttagaccaacgtaggcactccgacggtggtgcgacncgccctggacgtaggtctagagtgagtcgggataggtctagagccgtaccgttagctaacgtaataacaactaaagtatcgaaccgttaacgaaaccgtcggaggacacgacgtacgaaccaactaacacaagtaccataacctccgaagtacacctaacncggaaccacgtgtaaccgaatcgggacgactacgagacgttagacgagtaccgggaacgtacgtaccgttacttagtccgttagaccggtaaggtacgggtaggaagttagttaaggttcgtagtaaccggtgtaacgttcctaagtccg

SEQ ID NO: 39512 - DNA, 827 bp, Homo sapiens
  misc_feature: GYAE6OF02GBL2Q.19.36.D03.1.454.CMB.1.raw
  modified_base (187)..(187): a, c, t, g, unknown or other
  misc_feature (187)..(187): n is a, c, g, or t
tcagtactctcgtgcacgaccggtgctcgatttagctgcgtcacgatctctcttgggacccaaaaaccacacccctccttgggagaatcccctagatcacagctcctcacatggactggacctggagcatccttttctggtgcagcagcaacaggtgacccactactcgagggtcaggtctgggtcncgtagtctagggagtctaggtaaggttaaacgaacggtccggttgggggacccttcgaacgggttaggaacgggtcccgtaccgtgaccgtaaagggtcccttacgtaggtaactttacctaaccgttttagacccgaaacgttaccgggcctaattaccgtccgttacgggggtcgaccgaaccgtacccgggtacccccgttagggaaccggtaaacgggggtcgttaagggtacggttacgggaaggttcgggggtaatacggggtacttaccggaacggggtaccgtaccgtttacgaaccggttactaaacgtaaaacctaaaccggtaaaactttcgtaaacgacccgaaaacccgtaaaacccggtccggttaaacgggaccgaacgggtaacttaacccgaaacccgttacgaaaacccggacgtaaaccgacctaaaccttcccgttaaaccgaacgaccggtaaccaccgactaaccgtaccacgggttaacggaaccggtgaacgggtcgacccgtaggagtacgagtacgaacgtaccgaccggtagtaccgttaagtcgtacgtagggaacgtaaggttacggggattacgtagttacgtactacggtacttacgtccgtatccggg

SEQ ID NO: 39513 - DNA, 674 bp, Homo sapiens
  misc_feature: GYAE6OF02HGLLS.19.36.D03.1.454.CMB.1.raw
  modified_base (197)..(197): a, c, t, g, unknown or other
  misc_feature (197)..(197): n is a, c, g, or t
tcagtactctcgtgcacgaccggtgctcgatttagctgcgtcacgatctcgtcttgggacccaaaaaccacacccctccttgggagaatcccctagatcacagctcctcaccatggactggacctggagcatccgttttcttggtggcgagcaggcaacaggtgcccatctcagggtcagctggtgcagtctgggancgtggaaggttagacgccgtgggcctgagtggaaggtccgccgtgcgaaggcctctgacttacctacctttagacctaacgtacggactatccgaccgtgggtgcgtaccgacggcccctggacgacgggtcttggaggtcggagtagggagtggatcgaggtcgtactacgagtacaagtaacgaacaaactatacgacctaaccgaactcgacggacgaggacgaccaacgaactaacccacgaacgacacacgtaccgaacgacgaccgtacaccgtcctaacgtacgtacggaaccgtaaggacgggaaccgtaccgtaggacggtaccgtacggtaacggaccggtaaccggacccggttaccggttacgttaaccgttaccgttagggttacggtaacgggtaaacggggtaggggtaaggtacgttagggttacgttacggtagttaccggtacgtaccgtcgttaccgg

SEQ ID NO: 39514 - DNA, 865 bp, Homo sapiens
  misc_feature: GYAE6OF02HFMRU.19.36.D03.1.454.CMB.1.raw
tcagtactctcgtgcacgaccggtgctcgatttagctgcgtcacgatctctcttgggacccaaaaaccacacccctccttgggagaatcccctagatcacagctcctcaccatggactggacctggagcattccttttcttggtggcagcagcaacaggtcgcccactctcgagggtcagctgggtgcagtcgtggagcgtggtaaggttaaggaacgccgtcggggtcctacgtaggtaggaacgggttccgcccgttaggaccgaacgggtcccgtcgtagtactttaaccgtaccgttttacgacctaaccgttaaccggactacttaccgaccggtggggtaccgtaccggtaaccggtacccggggtaccccgttacggggaaccggtaacggggttccgttaggggtaacgggtacggggtaggttacgggggtagttaggggtaacgttcccgggaacggtcccggtaccgtttaacggtaccggttaactaaaccgttaaaacccgtaaacgtaaaaccttaacgtaacccggaacccgaaacccggtaaacccggtaccggtaacggggaccgtaacggtaccggtaaccctaacccgtaaaccgttaaaccaacgaacgtaaccaaaccgtaacctacccggaaacgaccgaacccacgtaaccgtaccctaaagtacggtaacggtaacgtacggaacgggtaccgacgttacggaacggtacgaccggtacgaaccggtaaccggtaccggtacggtttactaccgtttagtacggtacgggtaaggtaaggggtacggggaacggttagtacggttacggtacgtaggtacgttcgtaccgttaccggttcg

SEQ ID NO: 39515 - DNA, 707 bp, Homo sapiens
  misc_feature: GYAE6OF02IS9GR.19.36.D03.1.454.CMB.1.raw
tcagtactctcgtgcacgaccggtgctcgatttagctgcgtcacgatctctcttgggacccaaaaaccacacccctccttgggagaatcccctagatcacagctcctcaccatggactggacctggagcatcctttttcttggtggcagcagcaacaggtgcccactctcagggtcagcgtggtgcagtctggagctggaggttaagaagccgtggggcctcaggtggaaggtcgcctgcgaacggcctctgacttactactttagcaacgtacggcatcaccgtgggtgcgacgacggcccgtaggacgaacgggtcttggaggtggagtaggggagtaggtactacgagccgtacgttaacgacgttacaaactaaacaactaaactaagtacgaccgaaaccgtaactaccggacggacgaacggacgtaaccaacctaacgaaacccagtaacggaacaaccgaactcccgaaacgtaacgacccaacgaccggaccctaacgtaacggtaccgggaaaccgtaggacgggtaacgtccgtaacggaacggacgtacgtaccggaaaccgggtaaccggaccggtaccggttagtaacgtttacgtacgggtacgggtaaccggtaaagggtgggggttaacgtaagttttaacggttacggtacggttacggtaacgtcggtttacccgtaccgtttccggg

SEQ ID NO: 39516 - DNA, 888 bp, Homo sapiens
  misc_feature: GYAE6OF02H6Q1Z.19.36.D03.1.454.CMB.1.raw
tcagtactctcgtgcacgaccggtgctcgatttagctgcgtcacgatctctcttgggaacccaaaaaccacaccctccttgggagaatccctagatcacagctcctcaccatggactcggacctggagctacttccttttcgttgggtggcagcaggcaacgaggtcgcctactctcgagggtcagtcgtggtgcaggtcgtggacgtgtaggtaaggttaagacggtccggaggggtcctacgtagggttacggaacgggtccgtaccggtgaaccggtaacgggtcccttacgttacggtaacctttaaccgtttaccgtttaacggaacgtaaaccggtaccggtaactacgtcccggtaacggttggggtcgaaccggaccggtaacccggtcccggtagggaaaaccggtacggggtcgtagggtaacggttcgggaagggttacgggtagtaggacgtaacgcggtacccttacgtaacgtacgtaacgttaacaaacgtaacaaacgttacgacgtaaccgaaaaccgtaccgtaccgaaaggggccgttaaaggaccgtaaacccaaccgtaaacgtaacccgaaacgaaacgacctaaaccgtacgaaccgaacggtaaaccgtcgaaacgtaccgttaaaccgtaacgttaacggtaacggacgtacgggtaaaccggtacgaccggtaacgagtaacccgtcggtaacccgggaacggttaaccggaccgggttaacgttacgggtttaaccttaaccgggtcggtaaaccgggcgggtttaaaacgggggtgggggaaacgttttacggttaaccgggttttacgaaaccggtttccgggtaaagtttacccccggttacggttacccgttccggg

SEQ ID NO: 39517 - DNA, 892 bp, Homo sapiens
  misc_feature: GYAE6OF02HD8PQ.19.36.D03.1.454.CMB.1.raw
tcagtactctcgtgcacgaccggtgctcgatttagctgcgtcacgatctctcttgggacccaaaaaccacacccctccttgggagaatcccctagatcacagctctcaccatggactggacctggagcattcctttcgtggtggcagcagcaacgaggtcgcccacgtctcgtagggtccagtccgtggtcgcgtacggtccgtggacgtaccgttaggtaacgggttaaaggaacggtcccgggtaggggtccctacgtacgggtacggaacggttccgaccgtggaccgtaacgggtccctacgtacggtaacttttaaccgtacccgttttaggacctaaaccggttaccggtaccacttccgtaaccggtggggtacgaccgaccggtaccgggtccccgttaagggaccgtaagggtcttaggacggtagggacggtttaggggagtacgggtactaccggtggtaccgtaccttaacgacgtaacgtaaaccgttaaacgaaactaacggttacgtacgaaaccccgttaaaccggaaaccgttccgaacggggaacctaaacgggtaacctacccgtaaaccctaaccgtaaacccgaacgtaaaccggaaccaaccgtaccgtaacccgaaacggaccgaacccgtaaaccgtaccgtaccctaacgttaacgggttaacccgggtaacgaacgggtaacgggaccggttaaccgtaacgggtacccggtaaagacccggtaacgaacccgggtaaacgccccgggttaagttaaccgttcgttaccgttcgggtaacgaacggggtaaacggttaggggtaaccgttaagttacggtttacgtacgtacgggttaaccgtacggttaccgtaccgtttaccgg

SEQ ID NO: 39518 - DNA, 248 bp, Homo sapiens
  misc_feature: GYAE6OF01BSDTG.35.67.G01.1.454.CMB.1.raw
  modified_base (246)..(248): a, c, t, g, unknown or other
  misc_feature (246)..(248): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnn

SEQ ID NO: 39519 - DNA, 246 bp, Homo sapiens
  misc_feature: GYAE6OF01BAR26.35.67.G01.1.454.CMB.1.raw
  modified_base (246)..(246): a, c, t, g, unknown or other
  misc_feature (246)..(246): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagn

SEQ ID NO: 39520 - DNA, 264 bp, Homo sapiens
  misc_feature: GYAE6OF01C7SVD.35.67.G01.1.454.CMB.1.raw
  modified_base (246)..(264): a, c, t, g, unknown or other
  misc_feature (246)..(264): n is a, c, g, or t
tcagtacagatcgtcacgaccggtgctcgatttagagtatacatattggggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccacctcctcacgatctgtactgagcgggctggcaaggcgcatagnnnnnnnnnnnnnnnnnnn

SEQ ID NO: 39521 - DNA, 252 bp, Homo sapiens
  misc_feature: GYAE6OF01B67ZA.35.67.G01.1.454.CMB.1.raw
  modified_base (244)..(252): a, c, t, g, unknown or other
  misc_feature (244)..(252): n is a, c, g, or t
tcagtacagatcgtcacgaccggtgctcgatttagagtatacatattgggtttggggtttggtggtctccactcccgccttgacgaggctgattattattgttgctcatatgcaggtagtagcactaatgtcttcggaactgggaccaaggtcaccgtcctaggtcagcccaaggctgcccctcggtcactctgttcccaccctcctcacgatctgtactgagcgggctggcaaggcgcatagnnnnnnnnn

SEQ ID NO: 39522 - DNA, 273 bp, Homo sapiens
  misc_feature: GYAE6OF01A543I.35.67.G01.1.454.CMB.1.raw
  modified_base (251)..(251): a, c, t, g, unknown or other
  misc_feature (251)..(251): n is a, c, g, or t
  modified_base (253)..(273): a, c, t, g, unknown or other
  misc_feature (253)..(273): n is a, c, g, or t
tcagtacagatcgtcacgaccggtgctcgatttagagtatacatattgggtttgggggtttgggtggtctccactcccgccttgacgaggctgattattattgttgctcatatgccaggtagtagcactaatgtcttcggaactgggaccaaggtcaccgtcctaggtcagcccaaaggccaaaccccactgtcactctgttcccaccctccgtcacgatctgtactgagcgggctggcaaggcgcatagnannnnnnnnnnnnnnnnnnnnn

SEQ ID NO: 39523 - DNA, 274 bp, Homo sapiens
  misc_feature: GYAE6OF01DEE4Q.35.67.G01.1.454.CMB.1.raw
  modified_base (242)..(274): a, c, t, g, unknown or other
  misc_feature (242)..(274): n is a, c, g, or t
tcagtacagatcgtcacgaccggtgctcgatttagagtatacatattgggtttggggggtttggtggtctccactcccgccttgacgaggctgattattattgtgctcatatgcaggtagtagcactaatgtcttcggaactggaccaaggtcaccgtcctaggtcagcccaaggccaacccactgtcactctgttcccgcctcctcacgatctgtactgagcggctggcaaggcgcatagnnnnnnnnnnnnnnnnnnnnnnnnnnnnnnnnn

SEQ ID NO: 39524 - DNA, 265 bp, Homo sapiens
  misc_feature: GYAE6OF01A2T3R.35.67.G01.1.454.CMB.1.raw
  modified_base (233)..(233): a, c, t, g, unknown or other
  misc_feature (233)..(233): n is a, c, g, or t
  modified_base (238)..(265): a, c, t, g, unknown or other
  misc_feature (238)..(265): n is a, c, g, or t
tcagtacagatcgtcacgaccggtgctcgatttagagtatacatattgggtttgggggtttggtggtctccactccgccttgacgaggctgattattattgttgctcatatgcaggtagtagcactaatgtcttcggaactgggaccaaggtcaccgtctaggtcagcccaaggccaacccatgtcactctgttcccacctctcacgatctgtactgagcggctggcaaggcnatagnnnnnnnnnnnnnnnnnnnnnnnnnnnn

SEQ ID NO: 39525 - DNA, 246 bp, Homo sapiens
  misc_feature: GYAE6OF01CP4LG.35.67.G01.1.454.CMB.1.raw
  modified_base (245)..(246): a, c, t, g, unknown or other
  misc_feature (245)..(246): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctccgatctgtactgagcgggctggcaaggcgcatagnn

SEQ ID NO: 39526 - DNA, 256 bp, Homo sapiens
  misc_feature: GYAE6OF01DCFF3.35.67.G01.1.454.CMB.1.raw
  modified_base (237)..(237): a, c, t, g, unknown or other
  misc_feature (237)..(237): n is a, c, g, or t
  modified_base (243)..(256): a, c, t, g, unknown or other
  misc_feature (243)..(256): n is a, c, g, or t
tcagtacagatcgtcacgaccggtgctcgatttagagtatacatattgggtttgggggttggtggtctccactcccgccttgacgaggctgattattattgttgctcatactgcaggtagtacgcactaatgtcttcggaactgggaccaaggtcaccgtcctaggtcagcccaaggccaacccactgtcactctgttcccacctctcacgatctgtactgagcggctggcaaggcncatagnnnnnnnnnnnnnn

SEQ ID NO: 39527 - DNA, 246 bp, Homo sapiens
  misc_feature: GYAE6OF01ENTKS.35.67.G01.1.454.CMB.1.raw
  modified_base (245)..(246): a, c, t, g, unknown or other
  misc_feature (245)..(246): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccgccctcctcacgatctgtactgagcgggctggcaaggcgcatagnn

SEQ ID NO: 39528 - DNA, 248 bp, Homo sapiens
  misc_feature: GYAE6OF01B9UVO.35.67.G01.1.454.CMB.1.raw
  modified_base (245)..(248): a, c, t, g, unknown or other
  misc_feature (245)..(248): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccaccctcctcacgatctgtactgagcgggctggcaaggcgcatagnnnn

SEQ ID NO: 39529 - DNA, 247 bp, Homo sapiens
  misc_feature: GYAE6OF01CKBJR.35.67.G01.1.454.CMB.1.raw
  modified_base (245)..(247): a, c, t, g, unknown or other
  misc_feature (245)..(247): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccaccctcctcacgatctgtactgagcgggctggcaaggcgcatagnnn

SEQ ID NO: 39530 - DNA, 246 bp, Homo sapiens
  misc_feature: GYAE6OF01CSOZD.35.67.G01.1.454.CMB.1.raw
  modified_base (246)..(246): a, c, t, g, unknown or other
  misc_feature (246)..(246): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagn

SEQ ID NO: 39531 - DNA, 562 bp, Homo sapiens
  misc_feature: GYAE6OF01DNLSM.35.67.G01.1.454.CMB.1.raw
  modified_base (198)..(198): a, c, t, g, unknown or other
  misc_feature (198)..(198): n is a, c, g, or t
  modified_base (550)..(550): a, c, t, g, unknown or other
  misc_feature (550)..(550): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaaagggactggagtggttggcagttgtgtggtatgatggaaagtaatagatactatgcagacaccgtgaaggccattcaccatctccagagaacaattccaagaacactttgtcctgacaaaatgaacagcctagagagccgaaggacacgggcaatataattactgtgacgaagaagacgagtaggggacgccgtaaccccggatacggagcgacgtgggccagggcaccgtggtcgccgtctctcacgccgtccaccgacggcccaagtccggtccttacccccgtcggtacctaccccgtcctccgaaacgacgcctacccgtcgtcggggtaccncgacggtcccgg

SEQ ID NO: 39532 - DNA, 247 bp, Homo sapiens
  misc_feature: GYAE6OF01D0KJ1.35.67.G01.1.454.CMB.1.raw
  modified_base (245)..(247): a, c, t, g, unknown or other
  misc_feature (245)..(247): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccgccctcctcacgatctgtactgagcgggctggcaaggcgcatagnnn

SEQ ID NO: 39533 - DNA, 248 bp, Homo sapiens
  misc_feature: GYAE6OF01D9I0R.35.67.G01.1.454.CMB.1.raw
  modified_base (246)..(248): a, c, t, g, unknown or other
  misc_feature (246)..(248): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnn

SEQ ID NO: 39534 - DNA, 248 bp, Homo sapiens; identical to SEQ ID NO: 39533
  misc_feature: GYAE6OF01DG999.35.67.G01.1.454.CMB.1.raw
  modified_base (246)..(248): a, c, t, g, unknown or other
  misc_feature (246)..(248): n is a, c, g, or t

SEQ ID NO: 39535 - DNA, 248 bp, Homo sapiens
  misc_feature: GYAE6OF01EEFT0.35.67.G01.1.454.CMB.1.raw
  modified_base (244)..(248): a, c, t, g, unknown or other
  misc_feature (244)..(248): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccacctcctcacgatctgtactgagcgggctggcaaggcgcatagnnnnn

SEQ ID NO: 39536 - DNA, 266 bp, Homo sapiens
  misc_feature: GYAE6OF01B9EKP.35.67.G01.1.454.CMB.1.raw
  modified_base (247)..(266): a, c, t, g, unknown or other
  misc_feature (247)..(266): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttccccgccctctcacgatctgtactgacgcgggctggcaaggcgcatagnnnnnnnnnnnnnnnnnnnn

SEQ ID NO: 39537 - DNA, 245 bp, Homo sapiens
  misc_feature: GYAE6OF01B3BV4.35.67.G01.1.454.CMB.1.raw
  modified_base (245)..(245): a, c, t, g, unknown or other
  misc_feature (245)..(245): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccaccctcctcacgatctgtactgagcgggctggcaaggcgcatagn

SEQ ID NO: 39538 - DNA, 248 bp, Homo sapiens
  misc_feature: GYAE6OF01B8R14.35.67.G01.1.454.CMB.1.raw
  modified_base (245)..(248): a, c, t, g, unknown or other
  misc_feature (245)..(248): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccgccctcctcacgatctgtactgagcgggctggcaaggcgcatagnnnn

SEQ ID NO: 39539 - DNA, 250 bp, Homo sapiens
  misc_feature: GYAE6OF01AC7SC.35.67.G01.1.454.CMB.1.raw
  modified_base (247)..(250): a, c, t, g, unknown or other
  misc_feature (247)..(250): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttccccgccctcctcacgatctgtactgagcgggctggcaaggcgcatagnnnn

SEQ ID NO: 39540 - DNA, 246 bp, Homo sapiens; identical to SEQ ID NO: 39519
  misc_feature: GYAE6OF01C6TLT.35.67.G01.1.454.CMB.1.raw
  modified_base (246)..(246): a, c, t, g, unknown or other
  misc_feature (246)..(246): n is a, c, g, or t

SEQ ID NO: 39541 - DNA, 507 bp, Homo sapiens
  misc_feature: GYAE6OF01EZFJP.35.67.G01.1.454.CMB.1.raw
tcagtacagatcgtcacgaccggtgctcgatttagagtatacatattgggtttgggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaaggccgattcacatctccagagacaattccaagaacactttgttcctgcaatgaacagcctagagagcgaggacacggcgatatattactgtgcgagaagcgagtgggacgcccgtaccccggatacgg

SEQ ID NO: 39542 - DNA, 519 bp, Homo sapiens
  misc_feature: GYAE6OF01A0D7I.35.67.G01.1.454.CMB.1.raw
  modified_base (387)..(387): a, c, t, g, unknown or other
  misc_feature (387)..(387): n is a, c, g, or t
  modified_base (419)..(419): a, c, t, g, unknown or other
  misc_feature (419)..(419): n is a, c, g, or t
  modified_base (514)..(514): a, c, t, g, unknown or other
  misc_feature (514)..(514): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacaggtgacgcctccagggtaggggtcttggggacctctggactgatccttggtctcccgctcctcaggctcaccggggcccagcactgactcagtggcatgtgtttctccctctttccagggtcctgggcacagtctgccctgactcagcctgcctccgtgtctgggtctcctggacagtcgatcaccatctcctgcactgaaccagcagcgatggttggggttatgaccttgtctcctggtatcaacngcaccaggacaacgccccaaactcttaattanaacgacactaagcgacctcgaggtatttactaatcgcttctctcgctctaagtctgcaactcggccctcctagacaactctacgtggctccgggntacgg

SEQ ID NO: 39543 - DNA, 247 bp, Homo sapiens
  misc_feature: GYAE6OF01C011M.35.67.G01.1.454.CMB.1.raw
  modified_base (245)..(247): a, c, t, g, unknown or other
  misc_feature (245)..(247): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcggctggcaaggcgcatagnnn

SEQ ID NO: 39544 - DNA, 311 bp, Homo sapiens
  misc_feature: GYAE6OF01C928D.35.67.G01.1.454.CMB.1.raw
  modified_base (253)..(253): a, c, t, g, unknown or other
  misc_feature (253)..(253): n is a, c, g, or t
  modified_base (255)..(311): a, c, t, g, unknown or other
  misc_feature (255)..(311): n is a, c, g, or t
tcagtacagatcgtcacgaccggtgctcgatttagagtatacatattgggtttgggggtttggtggtacctccactcccgccttgacgaggctgattattattgttgctcatatgcaggtagtagcactaatgtcttcggaactgggaccaaggtcaccgtcctaggtcagcccgaaggccaaccccactgtcactctgttccccacctcctcacgtattctgtacctgagcgggtctggcaaggcgcatagncnnnnnnnnnnnnnnnnnnnnnnnnnnnnnnnnnnnnnnnnnnnnnnnnnnnnnnnnn

SEQ ID NO: 39545 - DNA, 535 bp, Homo sapiens
  misc_feature: GYAE6OF01DRIIZ.35.67.G01.1.454.CMB.1.raw
  modified_base (505)..(505): a, c, t, g, unknown or other
  misc_feature (505)..(505): n is a, c, g, or t
  modified_base (527)..(527): a, c, t, g, unknown or other
  misc_feature (527)..(527): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgcagcctctggagtcaccttgagtagctatggcatgagctgggtccgccaggctccaggggacggggctgggagtgggtctcttctattagtgctagtggcggtctcacatactacgcagactctgtgaagggccggttcaccgtctccagagacaattccaagaacaccctgtatctgcaaatgaacagcctgagagccgacgacacggccgtatattactgtgacgaaaattggacgaacgtggggaagtggtacttcgatctcgtggggccgtggcacccgtggtcactgtctcctcacgcctccaccaacgggcccatcggtccttcccccgtggccgcccgtcgctccnggacgcaccctccgagagcacncggcccgg

SEQ ID NO: 39546 - DNA, 510 bp, Homo sapiens
  misc_feature: GYAE6OF01EBQGX.35.67.G01.1.454.CMB.1.raw
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
tcagtacagatcgtcacgaccggtgctcgatttagagtatacatattgggtttggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatctcaataactatggcatgcactgggtccgccagggctccaggcaagggactggagtggttggcagttgtgtggtatgagtggaagtaatagatactatgcagacacgtgaggcgatcacatctcagagacaattaccaagactactttcgttctgacaatagaacagcctgagacgccgaggacacggacgatatatactgtgcgagaagacgagtagggancccgtaccccggngtacgg

SEQ ID NO: 39547 - DNA, 270 bp, Homo sapiens
  misc_feature: GYAE6OF01BWHRF.35.67.G01.1.454.CMB.1.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (242)..(270): a, c, t, g, unknown or other
  misc_feature (242)..(270): n is a, c, g, or t
tcagtacagatcgtcacgaccggtgctcgatttagagtatacatagttgggtttgggggtttggtggtctccactcccgccttgacgaggctgattattattgttgctcatatgcaggtatagcactaatgttcttcggaactggaccaaggttcaccgtctaggtcagcccaaggccaacccatgtcactctgttcccacctctcacgatctgtacngagcgggctgggcaaggcncatgnnnnnnnnnnnnnnnnnnnnnnnnnnnnn

SEQ ID NO: 39548 - DNA, 520 bp, Homo sapiens
  misc_feature: GYAE6OF01E18XI.35.67.G01.1.454.CMB.1.raw
  modified_base (496)..(496): a, c, t, g, unknown or other
  misc_feature (496)..(496): n is a, c, g, or t
  modified_base (515)..(515): a, c, t, g, unknown or other
  misc_feature (515)..(515): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaagggttcgctgtatctgcaaatgaacagcctgagagccgacgacacggctgtgtattactgtgcgagaacacgtagagatggctacaatttggacgtcttttgatatctgggccaagggacaagtggcaccgtctcttcagcctccaccaagggcccatccggtccttcccctggccaccctcccncccaacgacgcaccctcgnggggc

SEQ ID NO: 39549 - DNA, 609 bp, Homo sapiens
  misc_feature: GYAE6OF01AWDU4.35.67.G01.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (335)..(335): a, c, t, g, unknown or other
  misc_feature (335)..(335): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaagggactggagtggttggcagttgngtggtatgatggaagtatagatactatgcagacacgtgaaggccattcaccatctccagagacaattccaagaacactttgtcctgacaaatgaaacngcctagagagccgaggacacggcgaatatattactgtgcgagaagcgagtagggacgaccgtacccccggatacggacgacgaccggtcggggacccgacgggccgaacccgtcgggtccgacccgttccgtccgttaccgacgtcccgtacccgacccgaacggcccgtacgtccggttcccttacccccgtcggtccctaccccttccctacccgaaaccgacgacccgtaaccccgtcggtaccgggggcccaaccggccggtaccccggg

SEQ ID NO: 39550 - DNA, 523 bp, Homo sapiens
  misc_feature: GYAE6OF01CEMSC.35.67.G01.1.454.CMB.1.raw
  modified_base (421)..(421): a, c, t, g, unknown or other
  misc_feature (421)..(421): n is a, c, g, or t
  modified_base (511)..(511): a, c, t, g, unknown or other
  misc_feature (511)..(511): n is a, c, g, or t
tcagtacagatcgtcacgaccggtgctcgatttagagtatacatattgggtttgggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttgggggttatgaccttgtctcctggtatcaacagcacccaggcaaacgcccccaaactcttaattataaggacactaagcgaccctcaggtatttcaatcgcttctctggctcaagtctgcactcgcctcctgacatctcgtgggctccgggctgaggacgaggctgattattattgttgctnatatgcaggtagtagctaactaatgtcgttacggaactgggaaccaaggtccaccggttctaggtccacgacccgaaggccccaaccccnctcgtcctaccg

SEQ ID NO: 39551 - DNA, 267 bp, Homo sapiens
  misc_feature: GYAE6OF01EN2AP.35.67.G01.1.454.CMB.1.raw
  modified_base (247)..(267): a, c, t, g, unknown or other
  misc_feature (247)..(267): n is a, c, g, or t
tcagtacagatcgtcacgaccggtgctcgatttagagtatacatattgggtttgggggtttggtggtctccactcccgccttgacgaggctgattattattgttgctcatatgccaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnnnnnnnnnnnnnnnnnnn

SEQ ID NO: 39552 - DNA, 250 bp, Homo sapiens
  misc_feature: GYAE6OF01CNBAO.35.67.G01.1.454.CMB.1.raw
  modified_base (245)..(250): a, c, t, g, unknown or other
  misc_feature (245)..(250): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccaccctcctcacgatctgtactgagcgggctggcaaggcgcatagnnnnnn

SEQ ID NO: 39553 - DNA, 267 bp, Homo sapiens
  misc_feature: GYAE6OF01B45CQ.35.67.G01.1.454.CMB.1.raw
  modified_base (248)..(267): a, c, t, g, unknown or other
  misc_feature (248)..(267): n is a, c, g, or t
tcagtacagatcgtcacgaccggtgctcgatttagagtatacatattgggtttgggggtttggtggtctccactcccgccttgacgaggctgattattattgttgctcatatgcaggtagtagcacgtaatgtcttcggaactgggaccaaggtcaccgtcctaggtcagcccaaggccaacccatgtcactctgttcccaccctcctcacgatctgtacctgagcgggtctggcaaggcacaatagnnnnnnnnnnnnnnnnnnnn

SEQ ID NO: 39554 - DNA, 551 bp, Homo sapiens
  misc_feature: GYAE6OF01COCKD.35.67.G01.1.454.CMB.1.raw
  modified_base (302)..(302): a, c, t, g, unknown or other
  misc_feature (302)..(302): n is a, c, g, or t
  modified_base (537)..(537): a, c, t, g, unknown or other
  misc_feature (537)..(537): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttggggttatgaccttgtctcctggtatcaacagcacccaggccaaaagcccccaaatcttaatttanaaggacactaagcgaccctgaggtatttcgtaatcgtcttctctggctccaagtctggcaactccggcctccctgacaatctcgtgggcctcgggctggagacgaggctgatttatattgttgctctatatgactaggtagtgactaacttaatcggtacttaggtaacgcgggtaaccaaggtcctacccggttcgtaacgggttccaacggtaccccaaaggccccaaacccncgtcgtcctacccg

SEQ ID NO: 39555 - DNA, 248 bp, Homo sapiens; identical to SEQ ID NO: 39518
  misc_feature: GYAE6OF01DZPW1.35.67.G01.1.454.CMB.1.raw
  modified_base (246)..(248): a, c, t, g, unknown or other
  misc_feature (246)..(248): n is a, c, g, or t

SEQ ID NO: 39556 - DNA, 280 bp, Homo sapiens
  misc_feature: GYAE6OF01CCOJ5.35.67.G01.1.454.CMB.1.raw
  modified_base (110)..(110): a, c, t, g, unknown or other
  misc_feature (110)..(110): n is a, c, g, or t
  modified_base (248)..(280): a, c, t, g, unknown or other
  misc_feature (248)..(280): n is a, c, g, or t
tcagtacagatcgtcacgaccggtgctcgatttagagtatacatattgggtttgggggtttggtggtcgtccactcccgccttgacgaggctgattattattgttgcctnatatgcaggtagtagcactaatgtcttcggaactgggaccaaggtcaccgtactaggtcagcccaaggccaaccccactgtcactctgttcccgccctcctcacgatctgtactgagcgggctggcaaggcgcatagnnnnnnnnnnnnnnnnnnnnnnnnnnnnnnnnn

SEQ ID NO: 39557 - DNA, 273 bp, Homo sapiens
  misc_feature: GYAE6OF01CBA9P.35.67.G01.1.454.CMB.1.raw
  modified_base (244)..(273): a, c, t, g, unknown or other
  misc_feature (244)..(273): n is a, c, g, or t
tcagtacagatcgtcacgaccggtgctcgatttagagtatacatattgggtttgggggttggtggtctccactcccgccttgacgaggctgattattacttgttgctcattatgcacggtagtagcactaatgtcttcggaactgggaccaaggtcaccgtctaggtcagcccaaggccaacccactgtcactctgttcccacctcctcacgatctgtactgagcggctggcaaggcgcatagnnnnnnnnnnnnnnnnnnnnnnnnnnnnnn

SEQ ID NO: 39558 - DNA, 261 bp, Homo sapiens
  misc_feature: GYAE6OF01CGNZ4.35.67.G01.1.454.CMB.1.raw
  modified_base (246)..(261): a, c, t, g, unknown or other
  misc_feature (246)..(261): n is a, c, g, or t
tcagtacagatcgtcacgaccggtgctcgatttagagtatacatattgggtttgggggtttaggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtctgagcgggctggcaaggcgcatagnnnnnnnnnnnnnnnn

SEQ ID NO: 39559 - DNA, 561 bp, Homo sapiens
  misc_feature: GYAE6OF01AZ5RD.35.67.G01.1.454.CMB.1.raw
  modified_base (198)..(198): a, c, t, g, unknown or other
  misc_feature (198)..(198): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaagggactggagtggttggcagttgtgtggtatgatggaagtaatagatactatgcagacaccgtgaagggccgattcaccatctccagagacaattccaagaacactttgttcctgcaaatgaacagcctgagagccgaggacacggcgatatattactgtgcgagaagcgagtgggacgccgtaccccggatcgagcaacgtcggggccagggccaccgtggtcgccgtctcgttcacgccctacaccgaacggcccacgtccggttcccttcccccggtcggccctacccctcccgtcccaacggacgtcccgaccgtccggtacggggccaccgacggtccccggg

SEQ ID NO: 39560 - DNA, 555 bp, Homo sapiens
  misc_feature: GYAE6OF01CAG22.35.67.G01.1.454.CMB.1.raw
  modified_base (294)..(294): a, c, t, g, unknown or other
  misc_feature (294)..(294): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgacagacaccgtgaaggccattcacatcnccagagacaattccaagtaacactttgtcctgacaaaatcgaacagcctagagagccgaaggacacgggcctatactacgtgtagacgtaacttcgaccgactacgattatttgtagtggtcttgactacgtgggcagggacgccgtgtcactcgtcctcctcacgcctccaccaacgggccctactccggtacccttcccccgtcggccctacccctccctacccgaacgacgtccacccgtcgtcggggccacgaccgg

SEQ ID NO: 39561 - DNA, 267 bp, Homo sapiens
  misc_feature: GYAE6OF01AGNXQ.35.67.G01.1.454.CMB.1.raw
  modified_base (251)..(267): a, c, t, g, unknown or other
  misc_feature (251)..(267): n is a, c, g, or t
tcagtacagatcgtcacgaccggtgctcgatttagagtatacatattgggtttgggggtttggtggtctccactcccgccttgacgaggctgattattattgttgctcatatgtcaggtagtagcactaatggtcttcggaactgggaccaaggtcaccgtcctaggtcagcccaaggccaaccccactgtccactctcgttcccgccctcctcacgatctgtactgagcgggctggccaaggcgcatagnnnnnnnnnnnnnnnnn

SEQ ID NO: 39562 - DNA, 325 bp, Homo sapiens
  misc_feature: GYAE6OF01DJMFU.35.67.G01.1.454.CMB.1.raw
  modified_base (324)..(325): a, c, t, g, unknown or other
  misc_feature (324)..(325): n is a, c, g, or t
tcagtacagatcgtcacgaccggtgctcgatttagagtatacatattgggtttgggaacctatgaacattctgtaggggccactgtcttctccacggtgctcccttcatgcgtgacctggcaactcggcctccctgacaatctctgggctccgggctgaggacgaggctgattattattgttgctcatatgcaggtagtagcactaatgtcttcggaactgggaccaaggtcaccgtcctaggtcagcccaaggccaacccactgtcactctgttccccaccctcctcacgatctgtactgagcgggctggcaaggcgcatagnn

SEQ ID NO: 39563 - DNA, 253 bp, Homo sapiens
  misc_feature: GYAE6OF01BKTWM.35.67.G01.1.454.CMB.1.raw
  modified_base (245)..(253): a, c, t, g, unknown or other
  misc_feature (245)..(253): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctagatcagcccaaggccaaccccactgtcactctgttcccacctcctcacgatctgtactgagcgggctggcaaggcgcatagnnnnnnnnn

SEQ ID NO: 39564 - DNA, 267 bp, Homo sapiens
  misc_feature: GYAE6OF01AEPVB.35.67.G01.1.454.CMB.1.raw
  modified_base (237)..(237): a, c, t, g, unknown or other
  misc_feature (237)..(237): n is a, c, g, or t
  modified_base (243)..(267): a, c, t, g, unknown or other
  misc_feature (243)..(267): n is a, c, g, or t
tcagtacagatcgtcacgaccggtgctcgatttagagtatacatattgggtttggggggtttggtggtctccactcccgccttgacgaggctgactattactgtcagtcttatgatggtagcaagtatgtggtcttcggcggagggaccaagctgaccgtcctaggtcagcccaagactgcccctggtcactctgttcccgcctcctcacgatctgtactgagcgggctggcaggcncatagnnnnnnnnnnnnnnnnnnnnnnnnn

SEQ ID NO: 39565 - DNA, 260 bp, Homo sapiens
  misc_feature: GYAE6OF01BIS3C.35.67.G01.1.454.CMB.1.raw
  modified_base (247)..(260): a, c, t, g, unknown or other
  misc_feature (247)..(260): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaacctgggaccaaggtcaccgtcctaggtcagcccaaggccaaccccactgtcactctgttcccgccctcctcacgatctgtactgagcgggctggcaaggcgcatagnnnnnnnnnnnnnn

SEQ ID NO: 39566 - DNA, 586 bp, Homo sapiens
  misc_feature: GYAE6OF01AXLL3.35.67.G01.1.454.CMB.1.raw
  modified_base (199)..(199): a, c, t, g, unknown or other
  misc_feature (199)..(199): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccnccaggctccaggcaagggactgggagtggttggcagttgtgtggtatgatggaagtaatagatactatgcagacaccgtgaagggccatcaccatctccagagacaattccaaagaactactttgtcctgacaaaatgaaacagcctaggacgacgccgaaggacacggcgaatatattactgtcgacgagaagcgagtgggacgcccgtaaccccggagtacgacgcacggtcggggccgagggcccacccgtcgggtccgccgtctctccgacgccctacccgaccgaacggccctacgtcccggttcccttccccgtccggccctacccctcccgtacccaacgaccgacccgtacccgtcggtacggggccacgcggtcccgg

SEQ ID NO: 39567 - DNA, 699 bp, Homo sapiens
  misc_feature: GYAE6OF01C05S8.35.67.G01.1.454.CMB.1.raw
  modified_base (420)..(420): a, c, t, g, unknown or other
  misc_feature (420)..(420): n is a, c, g, or t
tcagtacagatcgtcacgaccggtgctcgatttagagtatacatatgggttgggggggagggaggagcccagcactagaagtcggcggtgttccatccggtgatcagcactgaacacagaggactcaccatggagttgggctgagctgggttttcctcgttgctctttaagaggtgtccagtgtcaggtgcagtcgtgggtggagtcggtggggggaggcggtggtccaggtccgtggggacgtccctggacgcttcctcctggtagaacgtcgtcgtggtacttccacttcttaactaattaaacgtcgtggctaatcgaccgttacggtccggggtacccaccgtacggtccaccggaggggaccggaagggcggttagggtaggtggtttcggacgtttagttggtggtagttaagngtaagtaggtaacgtaatacgattactagtgacgtaaggaacgaccggtagaacggtcccgtaataccaccgtatcctaaccgaagtaacgacctaacgtaacctaagtaccgtacgtttcgtacctaggaactaagtacgaacgtacgacctggaacgacggacgaacggacgtaaccggctaaacgtttaagtaacgtttacgaggttacgtaacggaaacggtaggtacgtaaacggacggggtaccgtaccccggttaacccggggagttacggg

SEQ ID NO: 39568 - DNA, 250 bp, Homo sapiens
  misc_feature: GYAE6OF01BMNXC.35.67.G01.1.454.CMB.1.raw
  modified_base (246)..(250): a, c, t, g, unknown or other
  misc_feature (246)..(250): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnnn

SEQ ID NO: 39569 - DNA, 526 bp, Homo sapiens
  misc_feature: GYAE6OF01EJPZP.35.67.G01.1.454.CMB.1.raw
  modified_base (241)..(241): a, c, t, g, unknown or other
  misc_feature (241)..(241): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (517)..(517): a, c, t, g, unknown or other
  misc_feature (517)..(517): n is a, c, g, or t
tcagtacagatcgtcacgaccggtgctcgatttagagtatacatattgggtttgggctcaactttcttgtccaccttggtgttgctgagctgggttttcctcgttgctcttttaagaggtgtccagtgtcaggtgcagctggtggagtctgggggagcgtggtccagcctgggaggtccctgagactctcctgtgaagcgtctggattcatcttcaataactatggcatgcactgggtccnccaggctccaggcaaggggactggagtggttggcaggttgtgtggtatggatggaatatagatactatgcagacaccgtgaagggccattccaccatcncaganacaattccaaagtaactctttgtcctgacaaatgaacagcctgagagccgagacacggcgatatattactgtgacgagaagcgagtcgggacgcccgtaccccgatcgagcacgtcgggccgacgggccacccgtggtccgccgtctctcgacgccctaccacgacggcccngtccgtccc

SEQ ID NO: 39570 - DNA, 249 bp, Homo sapiens
  misc_feature: GYAE6OF01A7Y7K.35.67.G01.1.454.CMB.1.raw
  modified_base (246)..(249): a, c, t, g, unknown or other
  misc_feature (246)..(249): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnn

SEQ ID NO: 39571 - DNA, 669 bp, Homo sapiens
  misc_feature: GYAE6OF01B8JHC.35.67.G01.1.454.CMB.1.raw
  modified_base (300)..(300): a, c, t, g, unknown or other
  misc_feature (300)..(300): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcacgtgggtccgccaggctccaggcaaggggactgggagtgggttggctagttgtgtggtatgatggaagtaatagatactatgcagacacgtgaggcatcacatctcaganacaactacaagaactactttgttaccagacaaagtcgaaacagtcctaggacggacgaccggaaggacgacggtataatagttacttacgtggtacggacgaaggaaggacggtaggtacgggacccgtacccggtaaccccggagtacggacgaccgtacgggcggggaccgacgggaccctaccggtccgggtcccgtccgtccgttccgtaccgtaccgtccctacccgaacccggtaccggaccctaccggttcccggttaccccgtccccgtccggtacccctacccccgttacccgtacccgaaacgtacccgacccgtacccggtacgggtaccgggacccgaccggtcccgggtccccggg

SEQ ID NO: 39572 - DNA, 547 bp, Homo sapiens
  misc_feature: GYAE6OF01ATWRV.35.67.G01.1.454.CMB.1.raw
  modified_base (348)..(348): a, c, t, g, unknown or other
  misc_feature (348)..(348): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgaagcgtctggattcatcttcaataactatggcatgcactgggtccgccaggctccgaggcaagggactggagtggttgcagttgtgtggtangatggaagtaatagatactatgcagacacgtgaggcatcacatctcagacgacaattaccaagtaactactttcgtacctagacaaatgaacacgcctagacgacgaccggaggaaccgtacggacgtactaatacgttacgtggtaggccggaagaagcggaagtacggggacgtaccccggtaccccggagtaacgg

SEQ ID NO: 39573 - DNA, 545 bp, Homo sapiens
  misc_feature: GYAE6OF01ECCIR.35.67.G01.1.454.CMB.1.raw
  modified_base (314)..(314): a, c, t, g, unknown or other
  misc_feature (314)..(314): n is a, c, g, or t
  modified_base (370)..(370): a, c, t, g, unknown or other
  misc_feature (370)..(370): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaataatagatactatgcagacacgtgaaggccgattcaccatctccagagacaattccaagaacnctttgtcctgacaaatgaacagcctagagagccgaaggacacggcgatatattacngtgcgagagcgagtcgggacgccgtaaccccggatcgagcacgtcgggccgacgggcacccgtcggtcgccgtcctcgtcacgccctccgaccgacggccctacgtccgtcccttccccgtcggccctacccctccgtcccacgacgccaccgtcgcggggccaccgcggcccgg

SEQ ID NO: 39574 - DNA, 278 bp, Homo sapiens
  misc_feature: GYAE6OF01CEI4J.35.67.G01.1.454.CMB.1.raw
  modified_base (247)..(278): a, c, t, g, unknown or other
  misc_feature (247)..(278): n is a, c, g, or t
tcagtacagatcgtcacgaccggtgctcgatttagagtatacatattggggtttggggggtttggtggtctccactcccgccttgacgaggctgattattattgttgctcatatggcaggtagtagcactaatgtcttcggaatgggaccaaggtcaccgtcctaggtcagcccaaggccaacccatgtcactctgttcccaccctctcacgatctgtacctgagcgggctggacaaggcgcatagnnnnnnnnnnnnnnnnnnnnnnnnnnnnnnnn

SEQ ID NO: 39575 - DNA, 518 bp, Homo sapiens
  misc_feature: GYAE6OF01B8D63.35.67.G01.1.454.CMB.1.raw
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (512)..(512): a, c, t, g, unknown or other
  misc_feature (512)..(512): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggagtccctgagactctcctgtgagcgtctggattcatcttcaataactatggcatgcacgtgggtccnccaggctccgaggcaagggactggagtggttggctagttgtgtggtangagtggaagtaatagatactatgcagacacgtagaagggccgattcacatctaccagacgacaactcaagtaactactttgttctagacaatgaacagacctagagagccgagacgacggcgatatattactagtgcgagagcgagtgggacgcccgtacccggngtacgg

SEQ ID NO: 39576 - DNA, 511 bp, Homo sapiens
  misc_feature: GYAE6OF01EEL88.35.67.G01.1.454.CMB.1.raw
  modified_base (429)..(429): a, c, t, g, unknown or other
  misc_feature (429)..(429): n is a, c, g, or t
  modified_base (506)..(506): a, c, t, g, unknown or other
  misc_feature (506)..(506): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgcaggctccgaggcaagggactggagtggttggcagttgtgtggtatgatggaagtaatagatactagtgcagacaccgtgaggccgattcaccatctcagagacaattccaagaactactttgttcctnacaaatgaacagcctagagacgccgaggacacggcgatatatactgtaggcgagagcgatgggacgccctacccggntacgg

SEQ ID NO: 39577 - DNA, 560 bp, Homo sapiens
  misc_feature: GYAE6OF01A6N5Q.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccgattcaccatctccagagacaattccaagaacactttgtcctgcaaatgaaacagcctgagagccgaggacacggcatatattactgtgcgagaagcgagtgggacgccgtacccccggagtcgagcgacgtcggggccagggccgacccgtcgggtcgccgtctcgttcgacgcctcccaccgaacggcccacgtccggtccgttcccccgtcggcccacccctccctcccaaacgcgacccgtacccgtccgtcgggggccacgcggtcccggg

SEQ ID NO: 39578 - DNA, 246 bp, Homo sapiens
  misc_feature: GYAE6OF01BEYWC.35.67.G01.1.454.CMB.1.raw
  modified_base (246)..(246): a, c, t, g, unknown or other
  misc_feature (246)..(246): n is a, c, g, or t
tcagtacagatcgtcacgaccggtgctcgatttagagtatacatattgggtttggggggtgtggtggtctccactaccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagn

SEQ ID NO: 39579 - DNA, 262 bp, Homo sapiens
  misc_feature: GYAE6OF01DWI3L.35.67.G01.1.454.CMB.1.raw
  modified_base (246)..(262): a, c, t, g, unknown or other
  misc_feature (246)..(262): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaaggccaaccccactgtcactctgttcccgccctcctcacgatctgtactgagcggctggcaaggcgcatagnnnnnnnnnnnnnnnnn

SEQ ID NO: 39580 - DNA, 589 bp, Homo sapiens
  misc_feature: GYAE6OF01AD1NQ.35.67.G01.1.454.CMB.1.raw
  modified_base (402)..(402): a, c, t, g, unknown or other
  misc_feature (402)..(402): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (551)..(551): a, c, t, g, unknown or other
  misc_feature (551)..(551): n is a, c, g, or t
  modified_base (571)..(571): a, c, t, g, unknown or other
  misc_feature (571)..(571): n is a, c, g, or t
tcagtacagatcgtcacgaccggtgctcgatttagagtatacatattgggttttcctcgttgctcttttaagaggtgtccagtgtcaggtgcagctgggtggagtcgtgggggaggcgtggtccagcctgggaggtccctgagactctcctgtgagcgtctggattcatcttcagtagtcactggatgcacgtgggtcctcaagttccgaggggaagggctgggtgtgggtttcacgtattacgagtgatgggactgacacaatctacgcggactccgtggaagggccgattccaccccctcagacacaacgaccaaacgaacacactatactctagacaaaatcgaaacagtcctaggaagacggtccggaaggtaccacgggtctggtactaatttacgngtagacaaggaggtggactacaatctagttggtttagatcgtcgtcggggaccgaagggacctagtcggtctaccgtctctacacgccctaccgacgaaccgggccctagttcccgtcctccccgnggccncccgtgcctccgaggacnccaccgtcgagacgccgacnggccgcccgtgggtaccc

SEQ ID NO: 39581 - DNA, 514 bp, Homo sapiens
  misc_feature: GYAE6OF01CE6AI.35.67.G01.1.454.CMB.1.raw
  modified_base (505)..(505): a, c, t, g, unknown or other
  misc_feature (505)..(505): n is a, c, g, or t
tcagtacagatcgtcacgaccggtgctcgatttagagtatacatattgggtttgggggggtcacaagaggcagcgctctcgggacgtctccaccatggcctgggctctgctgctcctcccactctcctcactcaggacacagggtcctgggcacagtctgcctgactcagcctgcctccgtgtctgggtctcctggacagtcgatcaccatctcctgcactggaaccagcagcgatgttggggttatgaccttgtctcctggtatcaacagcaccccaggcaaacgcccccaaaactcttaaatttataaggacactaagcgaccctcagggatttctaatcgcttctctggctccaagtctggcaactcggcctccctgacaatctctgggctccgggctgaggacgagctgattattattgtgctcatatgcaggtagtagcaacttaatgttcttcggaactgggaccaaggtccacgtctggcagcccaaggcccaacccnctgtctacc

SEQ ID NO: 39582 - DNA, 250 bp, Homo sapiens; identical to SEQ ID NO: 39568
  misc_feature: GYAE6OF01BJVRD.35.67.G01.1.454.CMB.1.raw
  modified_base (246)..(250): a, c, t, g, unknown or other
  misc_feature (246)..(250): n is a, c, g, or t

SEQ ID NO: 39583 - DNA, 550 bp, Homo sapiens
  misc_feature: GYAE6OF01DUPAY.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgcaggctccaggcaaagggctggagtggttggcagttgtgtggtatgatggaagtcataaagactatgcagactccgtgaaggccgattcacatctccagagacaattccaagaacacgctgtatctgacaaatcgaacagcctgagagccgacgacacggctagtgtattactgtcgcgaagaacacgtagagatggactactaatttggacgtcttttgatatcgtgggaccgaagggacaagttggtcaccggtctcttcacgtcctccgaccgaacgggccctaacgtccggttcccttccccccgtggacccctaccccttaccctaccaaacggcgcctaacccgg

SEQ ID NO: 39584 - DNA, 604 bp, Homo sapiens
  misc_feature: GYAE6OF01BF3XG.35.67.G01.1.454.CMB.1.raw
  modified_base (199)..(199): a, c, t, g, unknown or other
  misc_feature (199)..(199): n is a, c, g, or t
  modified_base (354)..(354): a, c, t, g, unknown or other
  misc_feature (354)..(354): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccnccaggctccaggcaagggactggagtggttggcagttgtgtggtatgatggaatatagatactatgcagacacgtgaacggccattcacatctccagagacatccaaagactactttgtccagacaaatcgaacagcctggagacgccgaggacncggcaatatatactggtgacgagaagcgagtcgggacgcccgtacccggatcgacgcgacggtgggccgacgggacctacccgtcggtccggtcccgttcgttccgttccgacgtcccctacccgaaccgacggcccctacggttcccggtccccgttcccccggtacggcccctaccccgttccctacccgaacggacccgacccgtacccggtaccgggtaccggggacctaccggccggtccccggg

SEQ ID NO: 39585 - DNA, 555 bp, Homo sapiens
  misc_feature: GYAE6OF01B17KT.35.67.G01.1.454.CMB.1.raw
  modified_base (227)..(227): a, c, t, g, unknown or other
  misc_feature (227)..(227): n is a, c, g, or t
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
tcagtacagatcgtcacgaccggtgctcgatttagagtatacatattgggtttgggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccngcagcgatggttggggttatgtaccttgtctctggtatcaacagcacccaggaccaaacgccccaaactcttaattataagacactaacgcgaccctcgaggtatttactaatcgcttctctggctaccgaatcgtggcactcggcctccngacaatctcgtggtctccgggngtgacggacgagtctgtattattagttgtgctgaattatgactaggtagtagactaagtattcgtactacggtaactcgggaacctaacgggcctaccgtacgtaggaccgtacgacccgtaacggacccctaaaccccgactccggtactaccc

SEQ ID NO: 39586 - DNA, 528 bp, Homo sapiens
  misc_feature: GYAE6OF01CN7RN.35.67.G01.1.454.CMB.1.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
  modified_base (520)..(520): a, c, t, g, unknown or other
  misc_feature (520)..(520): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccncaggctccaggcaagggactggagtggttggcagttgtgtggtatgatggaagtaatagatactatgcagacacgtgaagggcatcaccanctcaganacaattccaagaactacttttgtcctgactaaatcgaacagcctagagacgccgaggacacgggcaatatattactgtgacgagaagcgagtgggacgccgtacccggatcgagcgacgtcgggcgacggccaccgtggtccgccgtctcgtcacgcccaccgaccgacggccacgtccgtccctcccgtcgccnccctccncacgcgcctccgtcgcgggcncgcgccgg

SEQ ID NO: 39587 - DNA, 522 bp, Homo sapiens
  misc_feature: GYAE6OF01A69C1.35.67.G01.1.454.CMB.1.raw
tcagtacagatcgtcacgaccggtgctcgatttagagtatacatattgggtttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatgttggggtatgaccttgtctcctggtatcaacagcacccaggcaaagcccccaaatcttaatttataaggacactaagcgaccctcagggatttctaatcgcttctctggctcaagtctggcaactcgcctccctgacaatctctgggctccgggctgacggcgaggctgattattactgcagctcatatgcaggcagctaacgtttgagttttcgggacggtaggaccgtaaggttcgaccgtaccgtaagtccacgacccaaggcctcgcccccgtggtcctacccg

SEQ ID NO: 39588 - DNA, 649 bp, Homo sapiens
  misc_feature: GYAE6OF01CQV63.35.67.G01.1.454.CMB.1.raw
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcggtcggtttcgcgtaggcgtctttaagaggtgcagtgcaggtgcagctggtagagtgtggggaggcgtggtcgngcgtggnggccgtganctctcctgtgagcgtcgtggtatctatcctactaataataataggcaatagacgacgttggtccgaccgacggtcctaccgaccggacgaacgggaacgtaggtagggtgggtttcggggtaggtaggttggtggtaggtagtaggtagtaaggtaagtaagtaagtacgtacgtagtacgtacgaacgtacggtaacggtacggtacggtacgtacgtacgtacgtacgtacgtacgtacgtaacgtaacgtaactaacgtaacgtaacgttacgttacgttacgtacgtaacgtaacgtaacgtaacgtacgtacgtacgacggacggacggacgacgacgtacgtaacgtacgtagtacgtcgtacgtacgacgtacgacggaggacggtaccgtacccggtaccg

SEQ ID NO: 39589 - DNA, 640 bp, Homo sapiens
  misc_feature: GYAE6OF01CC9IT.35.67.G01.1.454.CMB.1.raw
  modified_base (224)..(224): a, c, t, g, unknown or other
  misc_feature (224)..(224): n is a, c, g, or t
  modified_base (266)..(266): a, c, t, g, unknown or other
  misc_feature (266)..(266): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctacctccgtgtctgggtctcctggacagtcgatcaccatctcctgcactggaaccngcagcgatgttgggggtatgtaccttgtctctggtatcaacngcaccaggacaaacgccccaaatctaattataagacactaacgcgaccctacgaggtatttctaatcgtcttcgtacgtcggctaccgaagtcgtggactaactcggcctccgtgactaactctcgtcgggtctccgggctggacggtacgacggtcgtagtatttagtttattgttacgtctacgtattactaggacgtaagggttacgtaacgtactaaccttaagttcgttaccgttaaccgggaacgttacgggtaaacccgtaagggttacccgtaaccggttaccgtaacggttcccgaaaccggtacccccgtaaacgggtacccccaaacccccgtagttacccgtcccgtaaaccctttccccgg

SEQ ID NO: 39590 - DNA, 527 bp, Homo sapiens
  misc_feature: GYAE6OF01DPUZE.35.67.G01.1.454.CMB.1.raw
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccgattcaccatctccagagacaattccaagaactactttgtcctgcaaatgaacagcctgagagccgaggacacggcatatattactgtgcgagagcgatgggagccgtacccggatcgagcacgtcgggccacgggcaccgtggtcgccgtctcttcacgcctccaccacggcccacgtccgtccttccccgcggtcccaccctcctccaacgcgaccaccgtcgcggggccncgngcccggg

SEQ ID NO: 39591 - DNA, 528 bp, Homo sapiens
  misc_feature: GYAE6OF01EOZUI.35.67.G01.1.454.CMB.1.raw
  modified_base (422)..(422): a, c, t, g, unknown or other
  misc_feature (422)..(422): n is a, c, g, or t
tcagtacagatcgtcacgaccggtgctcgatttagagtatacatattgggtttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttggggttatgaccttgtctcctggtatcaacagcaccaggcaaacgccccaaatcttaattataaggacactaagcgacctcagggtatttctaatcgacttctctcggctcaagtctggcaactcgcctcctgacaatctcgtggctcgggctagaggacgaggtctgtattattattgttgctnatatcgataggtagtagctaactaagtcgtacttcggaacgtgggaacctaaggtcctacccgtcgtaggtcacgacccgaacggcccaaacccgctcgtctaccg

SEQ ID NO: 39592 - DNA, 553 bp, Homo sapiens
  misc_feature: GYAE6OF01DLC50.35.67.G01.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (366)..(366): a, c, t, g, unknown or other
  misc_feature (366)..(366): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaagggctggagtggtgcagttgtgtggtatgatggaatatagatactatgcagacacgtgaaggccattcacntctccagagacaattccaagaactactttgtccngacaaatgaaacngcctgagagaccgaggacacggcgaatatattacngtagcgagaagcgagtcgggacgaccgtaccccggatcgacgcgacgtcgggaccagggccaccgtggtccgccgtctcgttccacgcctaccaccgacggccctacgtccgtcccttccccgtcggccctacccctccctaccgaacgaccgacctacccgtcgtacggggccacggcggcccggg

SEQ ID NO: 39593 - DNA, 254 bp, Homo sapiens
  misc_feature: GYAE6OF01DRD2H.35.67.G01.1.454.CMB.1.raw
  modified_base (247)..(254): a, c, t, g, unknown or other
  misc_feature (247)..(254): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaacccactgtcactctcgttcccaccctcctcacgatctgtactgagcgggctggcaaggcgcatagnnnnnnnn

SEQ ID NO: 39594 - DNA, 250 bp, Homo sapiens; identical to SEQ ID NO: 39568
  misc_feature: GYAE6OF01CFYCH.35.67.G01.1.454.CMB.1.raw
  modified_base (246)..(250): a, c, t, g, unknown or other
  misc_feature (246)..(250): n is a, c, g, or t

SEQ ID NO: 39595 - DNA, 533 bp, Homo sapiens
  misc_feature: GYAE6OF01D2BHW.35.67.G01.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
  modified_base (530)..(530): a, c, t, g, unknown or other
  misc_feature (530)..(530): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcgtggtttcgcgtaggctctttaagaggtgtcagtgtcaggtgcagctggtgagtcgtgggggagcgtggccagcctgggagtcccngagctctctgngagcgtctggattcattcttacaaataactntggcatgcacgttcgggccgccagggtcctccgaagggctaaaggggtctgggagttgggttggctaggttgtagtggtatgagtaggaagtaatagatatangacagaccncggtagaggcctatcacntacgacaganactaatccaagaactctttnttaccngacaaagtnaacgacgctgaancgaccgtagacncggatatagtacttnagtgacgagacgnggacgtacgggacaccccgccggtancgg

SEQ ID NO: 39596 - DNA, 256 bp, Homo sapiens
  misc_feature: GYAE6OF01A00WY.35.67.G01.1.454.CMB.1.raw
  modified_base (247)..(256): a, c, t, g, unknown or other
  misc_feature (247)..(256): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnnnnnnnn

SEQ ID NO: 39597 - DNA, 578 bp, Homo sapiens
  misc_feature: GYAE6OF01EJ8OH.35.67.G01.1.454.CMB.1.raw
  modified_base (199)..(199): a, c, t, g, unknown or other
  misc_feature (199)..(199): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccccgagactctcctgtgaagcgtctggattcatcttcaataactatggcatgcactgggtccnccaggctccaggcaagggactggagtggttggcagttgtgtggtatgatggaagtaatagatactatgcagacacgtgaaggccatcaccatctccagagacaatccaagaacactctgtctctgcacatagaacagtcgtgggacctggacggacacggctgtctattacgtgtgcgagagataacgtaaatattgtgtactagtagacgtagttcgtcgttacggttctttttacgagttagtacgacgttacgtcggggacctacgggtaacccgtggtacacgtccgtcctccgtacgaccgtccctacccgaacccgaaccgggtccccacgttcccggttacccttacccccgtcgtcccctacccctacccg

SEQ ID NO: 39598 - DNA, 553 bp, Homo sapiens
  misc_feature: GYAE6OF01EV6K8.35.67.G01.1.454.CMB.1.raw
tcagtacagatcgtcacgaccggtgctcgatttagagtatacatattgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccgattcaccatctccagagacaattccaagaacactttgttcctgcaaatgaacagcctgagagccgaggacacggcgatatattactgtgcgagaagcgatggagcctaccccggatgagcacgtggggccagggcaccgtggtcgccgtctcttcagcctccaccaacggcccagtccggtccttccccctcggccaccccttcctcccaacgcgccacctccgtcgggggccaccgacgccggcccgtcgggcctcggccctcggtaccaacgggtaccttaccttcccgacgtacttcgtgtacctggacgcgggcgtggaccgg

SEQ ID NO: 39599 - DNA, 510 bp, Homo sapiens
  misc_feature: GYAE6OF01A6M5J.35.67.G01.1.454.CMB.1.raw
  modified_base (308)..(308): a, c, t, g, unknown or other
  misc_feature (308)..(308): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (460)..(460): a, c, t, g, unknown or other
  misc_feature (460)..(460): n is a, c, g, or t
  modified_base (505)..(505): a, c, t, g, unknown or other
  misc_feature (505)..(505): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggggaggcgtggtccagcctggggacggtccctgagactctcctgtgaagcgtctggattcatcttacaattaactatggcatgcacgtgggtccnccaggcctccgaggccgaagggactgggaggtggttggctaggttgtgtggtatgagtggaagtatagatatatgcagacacgtgaggcatcacatcncaganacatcaanactcttntcnacaatnacngactgagngacgagacgacganatatatcgtgtagcgagagacgtagtacggacgcccgtacccggntacgg

SEQ ID NO: 39600 - DNA, 703 bp, Homo sapiens
  misc_feature: GYAE6OF01DTFLC.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctgagctgggttttcctcgttgctcttttaagaggtgtccagtgtcaggtgcagctgggtggaggtcgtggggggaggcggttggtccaggccgtgggggacggtcccctggacgacctctccgtgtgaagcgtctggatttcattcttacaaattaactagtggcatgctacgtcggggtcccgaccgaggcctaccgaagggaccgaaaggggaatgggtagttgggttacggctaggttgtggtggtaatggtagtagggaaagttaataacggtattacgtagtgacctaaggacctaaccgggttaggaacgggtcccgtacgttaccgaaccgtacgttacctaccgtaaggaacgtaaacgtaactttaaccgaaagtaacccgtacgtttttacgttaccgtacgacgtaaaactcgtaaacacgtaccgtacggaacgacggaccggaacggaaccgacgggacgtaaacgttattaacgttacgtaggtacggtacggaaggaacggcggtaacggtacgggacctaccccggtaccccgggagtaccgg

SEQ ID NO: 39601 - DNA, 249 bp, Homo sapiens; identical to SEQ ID NO: 39570
  misc_feature: GYAE6OF01A63N4.35.67.G01.1.454.CMB.1.raw
  modified_base (246)..(249): a, c, t, g, unknown or other
  misc_feature (246)..(249): n is a, c, g, or t

SEQ ID NO: 39602 - DNA, 547 bp, Homo sapiens
  misc_feature: GYAE6OF01ACITJ.35.67.G01.1.454.CMB.1.raw
  modified_base (340)..(340): a, c, t, g, unknown or other
  misc_feature (340)..(340): n is a, c, g, or t
  modified_base (538)..(538): a, c, t, g, unknown or other
  misc_feature (538)..(538): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaacgggccgattcaccatctccagagacaattccaagactactttgtcctgacaaatcgaacngcctgagacgccgaggacacggcattatattacgtgtgcgagaagcgagtgggacgccgtaccccggataggacgcgacgtcggggccgacgggccaccgtcggtcgccgttactcgttcgacgccctaccgaccgacggccacgtccgtccctccccgtcgccctaccctcctccacgcgcctaccgtcgacgggcncgcggccgg

SEQ ID NO: 39603 - DNA, 290 bp, Homo sapiens
  misc_feature: GYAE6OF01C5HP1.35.67.G01.1.454.CMB.1.raw
  modified_base (253)..(290): a, c, t, g, unknown or other
  misc_feature (253)..(290): n is a, c, g, or t
tcagtacagatcgtcacgaccggtgctcgatttagagtatacatattgggtttgggggggtttggtggtctccactcccgccttgacggaggctgattattattgttgctcatatgccaggtagtagcactaatgtcttcggaactgggaccaaggtccaccgtcctaggtcagcccaaggcccaaccccactgtcactctgttccccgccctcctcacgatctgtactgagcgggctggcaaggcgcatagnnnnnnnnnnnnnnnnnnnnnnnnnnnnnnnnnnnnnn

SEQ ID NO: 39604 - DNA, 548 bp, Homo sapiens
  misc_feature: GYAE6OF01ERRC8.35.67.G01.1.454.CMB.1.raw
  modified_base (194)..(194): a, c, t, g, unknown or other
  misc_feature (194)..(194): n is a, c, g, or t
  modified_base (407)..(407): a, c, t, g, unknown or other
  misc_feature (407)..(407): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (508)..(508): a, c, t, g, unknown or other
  misc_feature (508)..(508): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtncagctggtggagtcgtgggggagcgtggtccaggccgtgggagtccctgagactctcctggtgaagcgtctggattcatctcaataactatggcatgcactgggtccgcaggctccgaggcaagggctggagtggttggctagttgtgtaggtatgagtaggaagtatagtatactatgacagacaccggtgaacggcgatcacatctcaganacaattaccaaagtactactttgtctanacaaangaacncgcctagacgtacgccgaaggacacgggacagtaacttagtacgtagtagacgaaggaacgnggtacgtacgggaaccgtccccgtaccccgggaagtccgg

SEQ ID NO: 39605 - DNA, 253 bp, Homo sapiens
  misc_feature: GYAE6OF01C96XJ.35.67.G01.1.454.CMB.1.raw
  modified_base (246)..(253): a, c, t, g, unknown or other
  misc_feature (246)..(253): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtctaggtcagcccaaggccaaccccactgtcactctcgttcccgccctctcacgatctgtactgacgcgggctggcaaggcgcatagnnnnnnnn

SEQ ID NO: 39606 - DNA, 249 bp, Homo sapiens
  misc_feature: GYAE6OF01EDNS0.35.67.G01.1.454.CMB.1.raw
  modified_base (247)..(249): a, c, t, g, unknown or other
  misc_feature (247)..(249): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnn

SEQ ID NO: 39607 - DNA, 639 bp, Homo sapiens
  misc_feature: GYAE6OF01A7FPD.35.67.G01.1.454.CMB.1.raw
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (411)..(411): a, c, t, g, unknown or other
  misc_feature (411)..(411): n is a, c, g, or t
tcagtacagatcgtcacgaccggtgctcgatttagagtatacatattgggttttcctcgttgctcttttaagaggtgtccagtgtcaggcgcagctggtggagtctggggggaggcgtggtccagcctgggaggtccctgagactctcctgtgaagcgtctggattcatcttcaataactatggcatgcacgtgggtccnccaggctccaggcaagggctggagtggttgcagttgtgtggtatgatggaagtaanagatactatgcagacacgtgaggcatcacatcncagagacattccaagaactactttgtcctagacaaatgaacngctgagacgcgaggacacgganatatattacgtgtacggcgaagaagcggtaagtcggggaccaccccgtaaccccgggntacggaacgccgaacgggtcggggacccgtaggggaccctaccccggtgggtacccgcccgttccttccgttaccacccgtaccctacccgaacccggaaccgggtcccctacgttccccgggttcccttccccccggtcgggtcccctacccccgttccctaacccgaacgaccccgtacccgtacccggtcgggtaccggggaccctaccgggccggtaccccggg

SEQ ID NO: 39608 - DNA, 548 bp, Homo sapiens
  misc_feature: GYAE6OF01CWAHP.35.67.G01.1.454.CMB.1.raw
  modified_base (265)..(265): a, c, t, g, unknown or other
  misc_feature (265)..(265): n is a, c, g, or t
  modified_base (307)..(307): a, c, t, g, unknown or other
  misc_feature (307)..(307): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgcttcttttaagaggtgtccagtgtcaggtgcagctgggtggagtcgtgggggaggcgtggtccagcctggggaggtccctgagactctcctgtgagcgtntggattcatcttacaataactatggcatgcacgtggggtccnccaggctccgaggcaagggctggagtggtgctagttgtgtggtatgatggaagtatagatactatgacagacacggtgaacggcgattcaccatctcaagacgacaataccaaagtactactttcgtactagacaatagaacacgacctagacgacgaccgaggaacgacggcgaattatagttacgtggtacgacggagaagcgtaaggtacgggacgaccccggtaccccggagtacgg

SEQ ID NO: 39609 - DNA, 661 bp, Homo sapiens
  misc_feature: GYAE6OF01B30N7.35.67.G01.1.454.CMB.1.raw
  modified_base (179)..(179): a, c, t, g, unknown or other
  misc_feature (179)..(179): n is a, c, g, or t
  modified_base (231)..(231): a, c, t, g, unknown or other
  misc_feature (231)..(231): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (335)..(335): a, c, t, g, unknown or other
  misc_feature (335)..(335): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagttttgggctgagcggtggtttcgcgtaggcgtcttaagaggtntcagtgtcaggtgcagctggtgacgtgtgggggagcgtggtccagcctgggnggtcctgagactctcctgtagaagcgtctggattcatcttcaattatatgcatgacncgtcgggccnccaggccnccgaggcaagggactgggtagtggttggntaggttgtggtgtatgtagtaggtaagtaagagtatactagtgacgacgtacgtacggtaggaacggtactagtaccacgtacgtacctacggaagacgtaacgtaacgttaaccgaaagtaaccgttaacgttttcgttaccgtagaaccttaagtacgaaaccgtacggtacccgtaggaaccggaacggaaccgggtaaggtacccgaacgggtacgttaacgttaacgtttacgttaacgggtcggacggtaacgggaagtaaacggtacggtaaacgggttacgggaacccggttaccccgggtacccggttaacgacggg

SEQ ID NO: 39610 - DNA, 592 bp, Homo sapiens
  misc_feature: GYAE6OF01D27U0.35.67.G01.1.454.CMB.1.raw
  modified_base (308)..(308): a, c, t, g, unknown or other
  misc_feature (308)..(308): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccaggcctggggagtccctgacgactctccgtgtgaagcgtctggattcaatctacaataactatggcatgcacgttcggggtccncgaggcctccgaggcgaagggctggagtggtgctagttgagtcggtatgatggaataacgtagattacntgcaagcacgngaggccagttcaccgtatccgtacaagacgacgtaattaccgaaacgtaaccttaccgtttacgttaccctaggtaaccgtaaactacggaactacgccgttaaggacgtacgccggtaacgacgtaacgccgataagttactaccgttagacgtacggagacggacggtacgtacggggacctacccggtacccggtgaccgg

SEQ ID NO: 39611 - DNA, 514 bp, Homo sapiens
  misc_feature: GYAE6OF01AN7JN.35.67.G01.1.454.CMB.1.raw
  modified_base (482)..(482): a, c, t, g, unknown or other
  misc_feature (482)..(482): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgaagcgtctggattcatcttcaataactatggcatgcacgtgggtccgccaggcctccgaggcaagggctgggagtggttggctaggttgtgtggtatgatggaagtaatagatactatgcagacacgtgaaggccatcacatctcagagacaattaccaagaactactttgtcctagacaaatgaacagcctagagacgaccgaggacacggcatatattacgtgngacgagacgcgagtcgggacgcccgtacccgg

SEQ ID NO: 39612 - DNA, 802 bp, Homo sapiens
  misc_feature: GYAE6OF01BOSVU.35.67.G01.1.454.CMB.1.raw
tcagtacagatcgtcacgaccggtgctcgatttagagtatacatattgggttttccgtcgttgctcttttaagaggtgtccagtgtcaggtgcagctggtggagtctgggggagcgtggtccagcctgggaggtccctggagactctcctgtgaagtcgtctggattcattcttacaaataactagtggcatgctacgtgggtcccgccgaggcctccgaggcgaagggctggagtggttgctagttgtggtgtatgagtaggaagtatagaatacgtagtcgacgtagacaccggtaggaacgggccgtaacttcaccgtatccgtaccgaaggaacgtaaccgtaaacttaccgaaaagttaaccgtaccgtttttacgtaccctagtaaccgtaaagtacgaaacctagacccgtaggaacgaccggaccggaaacgggaccaaccggggttactaaacgttaatttaacgttaaccgttagggtaacggtaccggtaaaggtaacgggacggtaaggttaccgggggaaccctaccccggtaacccccgggtaagtacggtaaccggaccggtaaccgggtccggggaccgaacgggtacccgtaccccggtacgggtacccgtcccgttaccgttacccggttaccgtaccggtaccccgttaccgaaacccgggtaccggcccgttaccggtcccggttcccgttacccccgtcggtacccctaccccgttccctaacggaacccgtcgacccgtaccggttccggaccggggtaccaccggtacccggccccggg

SEQ ID NO: 39613 - DNA, 254 bp, Homo sapiens
  misc_feature: GYAE6OF01D1716.35.67.G01.1.454.CMB.1.raw
  modified_base (248)..(254): a, c, t, g, unknown or other
  misc_feature (248)..(254): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaccccactgtcactctcgttcccgccctcctcacgatctgtactgagcgggctggcaaggcgcatagnnnnnnn

SEQ ID NO: 39614 - DNA, 257 bp, Homo sapiens
  misc_feature: GYAE6OF01B3ZFG.35.67.G01.1.454.CMB.1.raw
  modified_base (249)..(257): a, c, t, g, unknown or other
  misc_feature (249)..(257): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggcccaaccccactgtcactctcgttcccaccctcctcacgatctgtactgagcgggctggcaaggcgcatagnnnnnnnnn

SEQ ID NO: 39615 - DNA, 257 bp, Homo sapiens
  misc_feature: GYAE6OF01B3HS4.35.67.G01.1.454.CMB.1.raw
  modified_base (248)..(257): a, c, t, g, unknown or other
  misc_feature (248)..(257): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgtcccgccctcctccacgactctgtactgagcgggcgtggcgaggacgcatagnnnnnnnnnn

SEQ ID NO: 39616 - DNA, 715 bp, Homo sapiens
  misc_feature: GYAE6OF01DYAHB.35.67.G01.1.454.CMB.1.raw
  modified_base (176)..(176): a, c, t, g, unknown or other
  misc_feature (176)..(176): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgcttcttttaagnggtgtccagtgtcaggtgcagctggtggagtcgtgggggagcgtggtccagccgtgggaggtccctgacgactctcctgtgagcgtctggattcattcttacaaattaactatggactagtcgccacgttcggggtcccgccgaaggtcctccgaagggccgaaaggggtcttgggagttgggttgctaggtttgtggtaggtatgtaagtggtaaacgtaattacggaattacgtatacggacaaggtaacccgaccggttgggaaacgggtccctaagtttacccaaccgtacttacccgtaccgaaggtaacgaacctaacgttacccaaaaggtaaccttacgttttcgttaccgtagaacctaaacgtcgaaactccggtaccgtaggtaaacgaccggaacccggacggaaccgtaaccgggtacgtaacgttaactttaacgtttaccgtagggttacggtaacggaaacggtaacgaccggtaagggtaccggggaccgttaccccccggtaccccgggtagttaccgggg

SEQ ID NO: 39617 - DNA, 586 bp, Homo sapiens
  misc_feature: GYAE6OF01A95XW.35.67.G01.1.454.CMB.1.raw
  modified_base (385)..(385): a, c, t, g, unknown or other
  misc_feature (385)..(385): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcgtggtttccgcgtaggctctttaagaggtgtccagtgtcaggtgcagctggtggagtctgggggagcgtggtccagcctgggaggtccctgagctctcctgtgaagcgtctggattcattcttacaataactatggacatgctacgtggggtcccgcgaggcctccgagggacaaggggtactgggagtggttggctaggttgtgtggtatgatcggaatcgaataaagcttagngacagactccggtgaacgggcctatccgactactactccaaggactaacctaagttacccaaagaaccgcgcttacgtatcctaagaccgtaaagcgtaaacagcccgtaggaacgccgaaccggtacgaccggacggttcgtagttaggttacttaccgtaggtacgaacggaacgtaaccgaagggtcggaaagtacgg

SEQ ID NO: 39618 - DNA, 744 bp, Homo sapiens
  misc_feature: GYAE6OF01BMHMA.35.67.G01.1.454.CMB.1.raw
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (365)..(365): a, c, t, g, unknown or other
  misc_feature (365)..(365): n is a, c, g, or t
tcagtacagatcgtcacgaccggtgctcgatttagagtatacatattgggttttcctcgttgctcttttaagaggtgtccagtgtcaggtgcagctggtggagtcgtggggggaggcgtggtccagcctgggaggtccctggagactctcctgtgaagcgtctggattcatcttacaataactatggcatgcacgtgggtccgccgaggcctccgagggcaaggggactgggagtgggttgcgtaggttggtgtggtatggataggaatanagactatangacagacacgtagacggcattcacatctaccgagacgactaacttaccaagtaccttactttcgtacctagactaaatacgaacngactagaagacgaccggtaagacgacggagtaactaattattacgaggtgacggaagaggacggtagtcgggaacctaccccggtaccggaagcgacgtaccgacgggtcgggacccgtacgggcccgtacggttcgggcccggtaccgttccgtttacccgtccgacccggtacccctacccgggaaacccgggtacccggtacccgttaacccgggttcccccgggtttccccccgttaaccccccgggtccggtaaccccccgtacccccccttacccggttaacccgaaacccgggtccccgtaccccggttaacccgggtccccggggttacccgggggacccccaaacccgggtccccgggggtacccccggg

SEQ ID NO: 39619 - DNA, 659 bp, Homo sapiens
  misc_feature: GYAE6OF01BBVHE.35.67.G01.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
tcagtacagatcgtcacgaccggtgctcgatttagagtatacatattgggttttcctcgttgctcttttaagaggtgtccagtgtcaggtgcagctggtggagtcgtggggggaggcgtggtccagcctgggaggtccctgagactctcctgtgaagcgtctggattcatcttcaataactatggcatgcacgtgggtcccncaggctccgaggccaagggctgggagtggttgctagttgtgtggtatgagtaggaataatagatactatgcagacacgtgaaggccatcacatcncagagacaattccaaagactactttgtcctagacaaatcgaaacngcctagagagccggaaggacacggcaatatattctgtgacgaagagcgaaggtgggacgtacccgtacccggatacgagcgacggtcgggaccgacgggcctacccggtcgggtccgtccgttaccttccgttacgaccggacccttacccgaacccggtaaccggggtacccctaacggtttcccgggttccccctttaccccccggtccggtacccccgtacccccttaccccggttaacccgaaacccggtaccggtaccccgtacccggttacccgggtacgggggacccctaccgggcccgggtaccccggg

SEQ ID NO: 39620 - DNA, 651 bp, Homo sapiens
  misc_feature: GYAE6OF01CM457.35.67.G01.1.454.CMB.1.raw
  modified_base (262)..(262): a, c, t, g, unknown or other
  misc_feature (262)..(262): n is a, c, g, or t
  modified_base (605)..(605): a, c, t, g, unknown or other
  misc_feature (605)..(605): n is a, c, g, or t
tcagtacagatcgtcacgaccggtgctcgatttagagtatacatattgggtttggggggggagaggagcccagcactagaagtcggcggtgtttccattcggtgatcagcactgaacacagaggactcaccatgggagtttgggctgagcgtggtttcctcgttgctcttttaagaggtgtccagtgtcaggtgcagttggtggagtctgggggaggcgtggtccagcctggggaggtccctgagactctctgtgcagcctntggattcaccttcagtagtcactggatgcactgggtccgtcaagttccgaggggaacgggctgggtgtgggtttcacggttatacgagtgagtgggactgacacaagtctacgcggactcgtgaacgggccgtacttccaccccctcagacgaccaacgcaaagaacactactaatactcgtacgaactaaagtacgaaactagttccgtaaggacgtaacggacccggaagggtaacccgcggttacgttcggtaactttacgtttaacgtggttacgaccgtaaagggtacgggttcgggacccttaaacgtaaactacgttaaggtttcggggtttttanaccgtttacgttaccggggttcggggggtaaccccgtaaaaggggg

SEQ ID NO: 39621 - DNA, 258 bp, Homo sapiens
  misc_feature: GYAE6OF01B4636.35.67.G01.1.454.CMB.1.raw
  modified_base (244)..(244): a, c, t, g, unknown or other
  misc_feature (244)..(244): n is a, c, g, or t
  modified_base (250)..(258): a, c, t, g, unknown or other
  misc_feature (250)..(258): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggcccaacccactgtcactctgttccccgccctcctcacgatctgtactgagcgggctggcaaagggcncaatgnnnnnnnnn

SEQ ID NO: 39622 - DNA, 803 bp, Homo sapiens
  misc_feature: GYAE6OF01ENSDV.35.67.G01.1.454.CMB.1.raw
tcagtacagatcgtcacgaccggtgctcgatttagagtatacatattgggtttggggggagaggagcccagcactagaagtcggcggtgtttccatccggtgatcagcactgaacacagaggactcaccatggagtttgggctgagtcttgggtttcctgttgctcttttaagaggtgtccagtgtcaggtgctagctgggtgagtcggtggggagcgtggtccgagccgtggggacgtccctggacgtacctcgttccgtggtacggaacggtccgttcgtaggtactttaccgactttccttaacgaaattaaccgtagtcggactagtcgactacggttcgggccaccgaggtccctacggacggaccggtaagggtcttagggacgttgggttacgtaccgttaggttggttaggttacggtaagtagggtaacgttaggggtaaaattacgttaagtacgttaacgtacgtggaacccgtaaggtaacccgtacgggtaagggaaccgggtcccttaaacgtccgacccgtttaacgtacccgtaaccgaaggtaacgtaaccctaaccgtttaccgaaaaccggtttacctttaccggttacccgtttacgtaaaccgggaccttaaacggtacgtaacccgtacggtacccgttaacggaacccggtaccggtaacccggaagtaaccggacggtacttaagtaaccgttaacgtccgtacggttacggacgtaaaccgggacggttacgtaacgggtaccggtaacccttcccccgggtaagggtgtaaccgggg

SEQ ID NO: 39623 - DNA, 649 bp, Homo sapiens
  misc_feature: GYAE6OF01CY6IE.35.67.G01.1.454.CMB.1.raw
  modified_base (307)..(307): a, c, t, g, unknown or other
  misc_feature (307)..(307): n is a, c, g, or t
tcagtacagatcgtcacgaccggtgctcgatttagagtatacatattgggtttggggggggagaggagcccagcactagaagtcggcggtgttccatccggtgatcagcactgaacacagaggactcaccatgggagtttgggctgagctgggttttcctcgttgctcttttaagaggtgtccagtgtcaggtgcagctggtggagtcgtggggggaggcgtggtccagcctggggaggtccctgagactctcctgtgagcgtctggattcatcttcaataactatggcatgcacgtcggggtcccnccgaggtcctccgagggcgaaacggggctggggtagtgggttggcgtaggttggtgttggtatggtagtagggaaagttaagtagattaactagtgacagacgaccggtagaacgggcctattccaacctacgtcccctacaacgaaccacttaccaacgtaaacgtaacttcgtttacccgttcacgtaactaagaacgtaacacgtaccgtaggacggaccggaccggtagaaccggacggtagtaacgttagttaacgttggtagtacggaacggtaagggtaacggtaggtacgggtaccgggtacccgtaacccccgggtaccgggtaggtaaccgg

SEQ ID NO: 39624 - DNA, 567 bp, Homo sapiens
  misc_feature: GYAE6OF01EC4GR.35.67.G01.1.454.CMB.1.raw
  modified_base (198)..(198): a, c, t, g, unknown or other
  misc_feature (198)..(198): n is a, c, g, or t
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaagggctggagtggttgcagttgtgtggtatgatggaagtaatagatactatgcagacaccgtgaaggccattcaccatctccagagacaattccaagaactctttgttcctgacaaatgaacagcctgagacgcgagacgacganatatattacgtgtgacgagaagngagtgggacgtcccgtaccccggagtcgacgcgacggcgggaccgacgggccaccgtcggtccgccgtctcgtacgaccgcctaccgaccgacggcccacgttcccggtccctccccgtcgtcccctacccgtccctacccgaacgccgacccgtaccgtacgggtcgggaccaccggcggcccggg

SEQ ID NO: 39625 - DNA, 720 bp, Homo sapiens
  misc_feature: GYAE6OF01CHKPF.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttacaataactatggcatgcacgtgggtcccgcaggctccgaggcaaagggctgggagtggttggcagttgtgtggtatgatggaaataatagatactatgacagacaccggtggaacggccgtattccaaccatcctccaagacgaactaattaccgaaagtaaaccgttacttttcgttacccgtagaacctaaaatacggaaacctagtaccgtaggaagaaccggaccggaaggaaccgaacgggactaaagtaattactttacgtggtagacggaaggaacggacggtaaggtaggggaccgacccgtaaccccggagtacggacgccgaacggtcggggaccacgggcctaccgtcgggtaccgtccggtcctcgtaccgtaccgtccctaccgaacccggaacgggccccgtacggttccccggttaccccgtttcccccggtccggtacccctacccccgtttacccgacccgaaccggtacccgacccgttaccccggtaccgggtacgggggtaaccccaccgggtacggtaccccgggg

SEQ ID NO: 39626 - DNA, 574 bp, Homo sapiens
  misc_feature: GYAE6OF01C9FNR.35.67.G01.1.454.CMB.1.raw
  modified_base (508)..(508): a, c, t, g, unknown or other
  misc_feature (508)..(508): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccaggcaagggactggagtggttggcaggttgtgtggtatgatggaataatagatacatgcagacacgtgaaggccattcacatctaccagagacaattccaagaactactttgtcctagacaaatgaacagcctagagacgacgaggacacggcgaatatattactgtgacgaagagacgagtacgggacgacccgtaaccccggagtcgacgcgacgtcggggaccgagggacccaccgtcggtccgccgttctctcgacgccctaccaccgacggcccacgttcccgtcccgttccccncggccctacccctccgtacccaacgacgaccgtaccgtaccggtggggacccacgccggacccggg

SEQ ID NO: 39627 - DNA, 646 bp, Homo sapiens
  misc_feature: GYAE6OF01ALIYO.35.67.G01.1.454.CMB.1.raw
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (638)..(638): a, c, t, g, unknown or other
  misc_feature (638)..(638): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgacgactctcctgtgaagcgtctggattcattccttacaaattaactatggcatgctacgtcgggtccgccaggcctccgaggcaagggactggagtggtgntagttgngtgtatgataggaatagtagatactagtgacagtaccgaccggtaggaacgggtccgtaactttccaacctatcccgtacgaaggactaacgtaaccttaccgaaacgtaaccttacgttttaccgttccgtagtaaccgtaaacttacggaaaccaccggttcctaaggaacggacggaacccgggaggaaccgtacggacggtaaacttagttaaccgttaccgtagtaccggaggaaacgaagggtaccgtagggttaccgggaacggccccccttaacccgggntaacgggg

SEQ ID NO: 39628 - DNA, 249 bp, Homo sapiens
  misc_feature: GYAE6OF01ARQGD.35.67.G01.1.454.CMB.1.raw
  modified_base (245)..(249): a, c, t, g, unknown or other
  misc_feature (245)..(249): n is a, c, g, or t
tcagtacagatcgtcacgaccggtgctcgatttagagtatacatattgggtttggggggtttggtggtctccactcccgccttgacgaggctgactattactgtcagtcttatgatggtagcaagtatgtggtcttcggcggagggaccaagctgaccgtcctaggtcagcccaagactgccccctggtcactctgttcccgcctcctcacgatctgtactgagcgggctggcaaggcgcatagnnnnn

SEQ ID NO: 39629 - DNA, 649 bp, Homo sapiens
  misc_feature: GYAE6OF01D5G1N.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagctggtggagtcgtgggggagcgtggtccagccgtgggacgtccctgagactctcctgtgaagcgtctggattcattctacaattaactatggcatgcctacgtcgggtccgccgaggcctccgaggaccaagggactgggagttgggtgcgtaggttgtggtggtatgagtaggaagtaatagatactagtgacaagaaccgtaccgggtagaacgggtccgtaagttaccaacctacttaccctaccaataacgaacctaacttaccaaagtaaaccttacttttacgtacctagtaaccgaaatcgaaaccgtacgtaccgtaggaacggaccggaccggaacggaacgaaccgggtacgtaattaagtttaacgttaacgtggtacggacggaacggaaaggcggtaaggtaccggggaaccgaccccgttaaccccggagtaaccggg

SEQ ID NO: 39630 - DNA, 618 bp, Homo sapiens
  misc_feature: GYAE6OF01CNGXL.35.67.G01.1.454.CMB.1.raw
  modified_base (407)..(407): a, c, t, g, unknown or other
  misc_feature (407)..(407): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcggtggtccagccgtgggaggtccctgagctctctgtgaagctctggattccatcttacaataactatggcatgcacgtgggtccgcaggcctcgaggctaagggactggagtggttgcgtagttgtgtggtatgagtaggaataatagatactatgacagtacgaccgtggaaggtccgattcaacctntacctacgagaacgacaacttaccgaaataaccttaccgtttcgttaccctagtaactaaaagtgaaaccgtcgtacccgtaggaacgtaacggaccggtaacgggaaccgaaccgggtaggtaaacttacgttaacgttaacgtggtggaaaccggtaggaaacggttggacggttacgggaccgtaccccgttaacccggagtaccggg

SEQ ID NO: 39631 - DNA, 767 bp, Homo sapiens
  misc_feature: GYAE6OF01B76IT.35.67.G01.1.454.CMB.1.raw
tcagtacagatcgtcacgaccggtgctcgatttagagtatacatattgggtttgggggtcacaagaggcagcgctctcgggacgtctccaccatggcctgggctctgctgctcctcactctcctcactcaggacacgagggtcctgggcacagtctgccctgactcagccctccctccgcgtccgggtctcctggacagtcagtcaccatcctctgcactcggaaccaacagtcgtacggttggtagttaattaacttctgttctctagtacggtaaccaaactaactacccgaggacaacgacccgaaccccctaaactaccagttagttactttttaggacggttactaaggtaaccggtcccggtacccgttaccgggaccggggttcccctaagtccgttccggttccttccgtccgttaccgggccttaaccgtaaacgttccgtaacgaacccgaaccggtacccgggtccccctttacccccgtttaacccggtccgttacccggtcggggttaccctacccggtaggtaccgttaggacggtagtggacggtcttagtatttacgtctgacgagtccatactagcggtacgacggtacgtacgtacgtttacggtttacggttacggtttccggggaacgggttaccggaaaccgtttaccgggtaccggttaacccgtagttaaccgcccgaaccggtacccggaaccggttcccgtacccccggtaccccgttccggtccgttaccccgttaccccg

SEQ ID NO: 39632 - DNA, 695 bp, Homo sapiens
  misc_feature: GYAE6OF01DOMTJ.35.67.G01.1.454.CMB.1.raw
  modified_base (321)..(321): a, c, t, g, unknown or other
  misc_feature (321)..(321): n is a, c, g, or t
  modified_base (458)..(458): a, c, t, g, unknown or other
  misc_feature (458)..(458): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccaggccgtgggacggtccctgagacctctccgtgtagaagcgtctggattcactcttacaaattaactagtggacagttcgcacgttcggggtacccncgacgggctcccgaaggccgaagggtcctgggtagtgggttcggactaggttgtggtaggtatggaagttaggaagtttaaatagtataactagtgacgagtacgtaccggtggaacgggccgtattaccgaacctnttacccgtacgaaggtaacgaaccttaattaacccgaaagtaacccttacgttttccgtacgtacgaacctaaagttccgaaaccacggtccctagggtacgaccgggtacccgggaagaccggaacggtacgtaaatttaagttaacgttacgtagggtacggaacggtaacggaacggacggtaacgggtaacggggtaccccgacccccggttaacccgggtggtaaaccgggg

SEQ ID NO: 39633 - DNA, 800 bp, Homo sapiens
  misc_feature: GYAE6OF01DQ2AK.35.67.G01.1.454.CMB.1.raw
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgcttcttttaagaggtgtccagtgtcaggtgcagcgtggtggagtcgtggggggagcgtggtccagccgtgggagtccctgagactctcctgtgagcgtctggattcattctanaaattacagtgcagtgactacgtcgggccncgaggcctcgaggacgagggctggagtggtcgntagttggtgtagtagngaagtaggaaactaatgaatacgtatcggacaagacgaccggtaggaacgggtcctattacccgaactacgtaccgtaccgaaacggtaacgtaaacctaacgtttaaccccgaaaacgttaaccgtttacccgtttttacgtttaacccccgtaagttaaacccgtaaaaacgttccggtaaaacccgtaccggttaacccgttaaccggggtaaaacgaacccggggtaaacccccggggaaaggggtaaaacccccgggacccggggttaaagtaaaaacgttttaaacccggtttaaaggtttttaaccccggttaagggtaccccggggtaaaagggttaaaacccggggaaacgggtaacgggttaacccggggttaaccggggtaaacccccggtaccccccccggggttaaacccccgggtaggtaaccccggggg

SEQ ID NO: 39634 - DNA, 642 bp, Homo sapiens
  misc_feature: GYAE6OF01DVWJ7.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcttgggttttcctcgttgctctttttaagaggtgtccagtgtcaggtgcagctgggtggaggtcgtgggggaggcgtggtccagccgtggggacgttccctggacgtacctctccgtgtgaacgcgtctggattcattcttacaatactatggcatgcacgtcgggtcccgcaggctccgaggcaagggctgggagtgggttgactaggttgtgtggtatggataggaagtaatagatactatgacaagcgaccggtagaacgggcctattaccgactacgtctaacgaagtacgaaactaacttaaccgaaactaactttacgttttacgttacctacgtaactaaagtacgaaactacggtacgtagaacggtacgaccggtaacggaccgtaaccggacctaaagttaacttacgttacgtggttaaccggaagaacgggtaaacgggacgtaagggtacgggggacccgtcccccggtaaaccccgggg

SEQ ID NO: 39635 - DNA, 248 bp, Homo sapiens
  misc_feature: GYAE6OF01CY29U.35.67.G01.1.454.CMB.1.raw
  modified_base (243)..(248): a, c, t, g, unknown or other
  misc_feature (243)..(248): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgtcccaccctcctcacgatctgtactgagcggctggcaaggcgcatagnnnnnn

SEQ ID NO: 39636 - DNA, 572 bp, Homo sapiens
  misc_feature: GYAE6OF01DTGK1.35.67.G01.1.454.CMB.1.raw
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
tcagtacagatcgtcacgaccggtgctcgatttagagtatacatattgggtttggggggggtcacaagaggcagcgctctcgggacgtctccaccatggcctggctctgctgctcctcactctcctcactcaggacacagggtcctgggcacagtctgccctgactcagcctgcctccgtgtctgggtctcctggacagtcgatcaccatctctgcactggaccngcagcgatggttggggttatgacttgtctctgtatcaacngcaccaggccaaacgccccaaatcatgtatttatgtatgtacagtaactccggcctcgtaggggtttctaatcgtcttctctgctcaagtctcgactacaccggcctcccgtagacccatcgtcgtcgggtcctccgaggtctaggacgaaggtcgtcgtagtaacgtttacttacgtgacacgtacctactaattaactacgaagtccagactacgcctacgtcgttacggtcggttacgggaccgggtacgggaacctaggccgtaccggtacccgtaccgtaacggtccgacggtaacccccgg

SEQ ID NO: 39637 - DNA, 251 bp, Homo sapiens
  misc_feature: GYAE6OF01DGLQS.35.67.G01.1.454.CMB.1.raw
  modified_base (239)..(239): a, c, t, g, unknown or other
  misc_feature (239)..(239): n is a, c, g, or t
  modified_base (245)..(251): a, c, t, g, unknown or other
  misc_feature (245)..(251): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactggaccaaggtccaccgtcctaggtcagcccaaggcccaaccccatgtcactctcgttcccacctctcacgatctgtactgagcggctggacaaggcncaatgnnnnnnn

SEQ ID NO: 39638 - DNA, 535 bp, Homo sapiens
  misc_feature: GYAE6OF01B1NY9.35.67.G01.1.454.CMB.1.raw
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (530)..(530): a, c, t, g, unknown or other
  misc_feature (530)..(530): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggggaggcgtggtccagcctgggaggtccctgagactctcctgtgagcgtctggattcatcttcaataactatggcatgcacgtggggtccnccgaggcctccgaggcaagggactgggagtgggttggctaggttgngtggtatgatggaataatagatactatgacagaccacggtggaacgggccgattcaccatcctacagagacaattaccgaagtactacgtttcgtacctgacaatgaactgacctagagacgcgagacgacggcatattatacgtgtgcgagaagcgagtacgggacgcccgtacccggntacgg

SEQ ID NO: 39639 - DNA, 683 bp, Homo sapiens
  misc_feature: GYAE6OF01C5C58.35.67.G01.1.454.CMB.1.raw
  modified_base (231)..(231): a, c, t, g, unknown or other
  misc_feature (231)..(231): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacgagggtcctgggcacagtctgccctgactcagcctgcctccgtgtcgtgggtctccgtggacagtcgatcacatctcctgcacgtggaaccngcagcgtagttggttggggttatcgtaccttgtctcgtagtactacaacacgccaccgaggaccaaaccgacccctaaatctttaattaacgtaacgactaactaacgccgtaccctgtaaggtactttactaacttcgtcttacgtcgtcggtacctaccgtaagttccgtacggtacctaaccgtccggtaccccttaccgtacgtaacctacttccgtacggtcgggtccgtccggggactacgggacggtacggtacggtgttacgttaattttacgttagtttcgttacgtcttaactagtaacgttggaaccggttagggttaacgtacgtaaccgttaacttaacggttcggttaacgttacggtacgtaccgggtaacgtacggtaccgtaccgtcgtacggtaccgaccgacccgtaacgacccaaccgtctacgtctacccg

SEQ ID NO: 39640 - DNA, 624 bp, Homo sapiens
  misc_feature: GYAE6OF01DEHIE.35.67.G01.1.454.CMB.1.raw
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
  modified_base (402)..(402): a, c, t, g, unknown or other
  misc_feature (402)..(402): n is a, c, g, or t
  modified_base (465)..(465): a, c, t, g, unknown or other
  misc_feature (465)..(465): n is a, c, g, or t
tcagtacagatcgtcacgaccggtgctcgatttagagtatacatattgggtttgggctcaactttcttgtccaccttggtgttgctgagcgtgggttttcctcgttgctcttttaagaggtgtccagtgtcaggtgcagctgggtggagtcgtgggggaggcgtggtccagccgtggggaggtccctgagactctcctgtgcagcgtctggattcaccttnagttagttatggcatgctacgtgggtccnccaggcctccgaggcgaaggggctgggaggtgggtggctagtttatagtggtatgagtggaagtcaataaagctagtgacagtaccgtcggtaggaacgggcctattccactatcctacaagacgtaactaactaccgaaagaaccacggtnttagtactcgtagaactaaagtcgaacgacgccgtagacgacggaccgtaacgacgaccggtntggtagttacttacgtggacgtacggaacgaacgtacggaagagacgtagtaaccttaagtacgtttggactttcgtttagattcggtacgggtcgggaacgtaaggtacacggttcgtacccgtaccgttactaccgtacgcgtccccgtaaccccgg

SEQ ID NO: 39641 - DNA, 491 bp, Homo sapiens
  misc_feature: GYAE6OF01D5N33.35.67.G01.1.454.CMB.1.raw
  modified_base (352)..(352): a, c, t, g, unknown or other
  misc_feature (352)..(352): n is a, c, g, or t
tcagtacagatcgtcacgaccggtgctcgatttagagtatacatattgggtttgggggggtccacaagaggcagcgctctcgggacgtcgtccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatgttgggtatgaccttgtctcctggtatcaacagcacccaggcaaagccccaaatcttaattataaggacactaagcgaccctcaggtatttctaatcgcttctctggctcaatcngtcactcggctccctgacatctctggctcggctgacgacgaggctgattatacgtgcagtctcatatacaaccagcagcactctcgtgttcggcgtacggacaagctgaccgtctagtcagacccaagctcgccctcgg

SEQ ID NO: 39642 - DNA, 754 bp, Homo sapiens
  misc_feature: GYAE6OF01CQJIE.35.67.G01.1.454.CMB.1.raw
  modified_base (236)..(236): a, c, t, g, unknown or other
  misc_feature (236)..(236): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgcctcgtgtcgtcgggtctccgtaggactagtcgactcaccatcctctgcacgtacggaaccngcagcgtagttcgggttaggggtatcggtactcgtctcgtgtacacacagaccaccgagaccaaccgaccctaaattctttaattaacgaacgactacgtaacgaccgtaccgtagtacggtactttacgtaattccgtcttacgtcggtcgtacctacgtaacgttccgtacggaacctaccgttccgaccccttacgtacgaacgttaccgttcgtaccggtcgggtccgtccgggtcgtaacgggacgggaacggttacgggtcttaagggttaacttttatttcgggtttcgttacctacgttaccgttaagttacgtccgtaacggggtaggtttaacgtaccgtaccttaacggtttaacgttacggttaacccggtttaacgggtaaccggtaccggggttaacctaaccggggttcccttacccgggtacgttaacggggacccctaaacgggacccccggttaaacccggacccccttaaccccggaatttccgtacccctttaccccg

SEQ ID NO: 39643 - DNA, 254 bp, Homo sapiens
  misc_feature: GYAE6OF01AH9LD.35.67.G01.1.454.CMB.1.raw
  modified_base (245)..(254): a, c, t, g, unknown or other
  misc_feature (245)..(254): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctctcacgatctgtactgagcgggctggcaaggcgcatagnnnnnnnnnn

SEQ ID NO: 39644 - DNA, 758 bp, Homo sapiens
  misc_feature: GYAE6OF01B7TVL.35.67.G01.1.454.CMB.1.raw
  modified_base (185)..(185): a, c, t, g, unknown or other
  misc_feature (185)..(185): n is a, c, g, or t
  modified_base (205)..(205): a, c, t, g, unknown or other
  misc_feature (205)..(205): n is a, c, g, or t
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
tcagtacagatcgtcacgaccggtgctcgatttagagtatacatagttggggtttgggggggagaggagccagcactagaagtcggcggttgttccatccggtgatcagcactgaacacagaggactcacatggagtttgggctgagtcgttcgggttttcctgttgcctttacgttttaaaggnggttcgtccagtgtcaggtncagtcgtgggtgagtcggtgggggagcgtgccaggtccgtgggacgtcctggacgtctctcgtgtagagtccgtgtggtacttacattcttaacgaaaattaccgtagnggactagtcggctacggttcgggacccncgtaacgggtcctaccggaagggtaccgaaaagggtcgtagggaggttgggttcgattagggttgtcggtaggtagtaggtaatagggtaaataactaaggattaactagaggaaccgtaaggaacccgttacgggagggaacggggtacctaacgttaccgaaccgtaacttccgtaaccgaacgaacgtaaactaacttaaacgaaacgttaaaccttacgtttacgttaccgtaacgaaacgtaaacgtaacgaaccgtaacgtacccgtaagggaaccggaacggaccggaacgggaaccggtaaggtaaccgtaagtaaacgttagttaacggtggtaacgggacggtaaacggaacggaacggtacgggtaacgggaccccggtaacccgtaccccgggagtaacccggg

SEQ ID NO: 39645 - DNA, 273 bp, Homo sapiens
  misc_feature: GYAE6OF01CY1B0.35.67.G01.1.454.CMB.1.raw
  modified_base (186)..(186): a, c, t, g, unknown or other
  misc_feature (186)..(186): n is a, c, g, or t
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (249)..(273): a, c, t, g, unknown or other
  misc_feature (249)..(273): n is a, c, g, or t
tcagtacagatcgtcacgaccggtgctcgatttagagtatacatagttggggtttggggggtttggtggtctccactcccgcttgacgaggctgattattattgttgctcatatggcaggtagtagcactaatgtcttacggaactgggaccaaggtcacgtcctaggcagcccaaggccaacccntcgtcacgtctcgtcccacctcncacgatcgtagactgagcgggtctggacaaggcntanagnnnnnnnnnnnnnnnnnnnnnnnnn

SEQ ID NO: 39646 - DNA, 729 bp, Homo sapiens
  misc_feature: GYAE6OF01DEWDD.35.67.G01.1.454.CMB.1.raw
  modified_base (667)..(667): a, c, t, g, unknown or other
  misc_feature (667)..(667): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctggtggagtcgtgggggagcgtggtccaggccgtggggacgtccctgacgacctctcctggtgaagcgtctggtacttcattcttacaaattaactagtggactagtcgacgtacgtcggggtcccgaccgacggccctccggaagggtaccggaaaggggtacgttggggaagggttcggggtttacggcgttaggttttgggttagggttagggttaagttagggaacggtttaagggtaaaagttaacgtaaggatttaaacgtagttacggacaacggtaccgtaaccgggtagggaaccgggtaccgttacttaccgacccttatccgtaacgaggtaacgaccttaaacttacccgaaagtaacctttcgttttcgtccctaagaactaaacgttcgaaaccgtggacctaggacgtacggacccggaagaccgtacggtgtaaattacggttacttcgngggttaaccgaggaacgtaacggccggtaaggtccggggaaccttcccccggtaaacccggg

SEQ ID NO: 39647 - DNA, 797 bp, Homo sapiens
  misc_feature: GYAE6OF01CZU3J.35.67.G01.1.454.CMB.1.raw
tcagtacagatcgtcacgaccggtgctcgatttagagtatacatattgggtttgggggggagaggagcccagcactagaagtcggcggtgttccatccggtgatcagcactgaacacagaggactcaccatggagtttgggctgagtcgttgggttttcctcgttgtcttacttttaaggaggtgtccagtgtcaggtgcagcgtgggtggaggtcggtgggggaggcgtggtccaggccgtgggacggtccctgacgtacctcctccgtggtagagtcgtcgtaggtattctattcttaacaaattaactagtcggactagtcgcgtacgtcgggtcccgaccgcggtcctaccggacgggacgaaggggtacgttaggggtaaggttcggggttacggtacgttagggttggtttagggttaggttagtagggtaagtaagggtaaacgttaaagtagtaacgttactagtacgaacgaacgtaccggacgggtacgggaacgggtacccgtacgttaccgtaacctacgttaccctaccgaaacgtaacgtaaccttaacgtaacccgtaaacgttaacccttacgttttaccgttaccgtaacgtaaacgttaaacgtacgaaccggtaaccgtcgtaacgggaaccgtacgggtaaccgggaacggaaccggtaaccgggtacgttaaacgttagttaacggttaccgtaagggttacggaaccgaaagggtaacgggaccgtagggtacccgggtaacccgtaaccccgggtaacccgggtagtacccggg

SEQ ID NO: 39648 - DNA, 680 bp, Homo sapiens
  misc_feature: GYAE6OF01EVN5J.35.67.G01.1.454.CMB.1.raw
  modified_base (346)..(346): a, c, t, g, unknown or other
  misc_feature (346)..(346): n is a, c, g, or t
  modified_base (671)..(671): a, c, t, g, unknown or other
  misc_feature (671)..(671): n is a, c, g, or t
tcagtacagatcgtcacgaccggtgctcgatttagagtatacatatttgggtttggggggggagaggagcccagtcactagaagttcggcggtgtttccatccggtgatcagcactgaacacagaggactcaccatgggagtttgggctgagctgggttttcctcgttgctcttttaagagtgtccagtgtcaggtgcagctgggtggagtcgtggggggaggcgtgggtccaggcctgggaggtccctgagactctccgtggtgaagcgtctggattcatctcaatactatgcatgcacgtggtccgcaggctaccgaggcaagggctggagtggtgctagttgngtgtatgagtaggaataagtacgaattacgtagtcggactaacgtaacgtaccggtaggaacgggtacccgtaatttacccgaaccgtaacgtacccgtaaccgaaggtaacgtaaacctaacgttacccgaaacgtaaccgttaaccgttttacgttacccttaacgtaccaaacgttacgaaaccgacgtaccgtaacgggaacgacggacccgggaacggacccgtaaccgggaccgtaacgttaacgttaacgtttaccgtaggtacggacggaacggaaggtccggaaggtacggggaacccgtacccggtaaccccggngtaaccggg

SEQ ID NO: 39649 - DNA, 603 bp, Homo sapiens
  misc_feature: GYAE6OF01D8A8R.35.67.G01.1.454.CMB.1.raw
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggggaggcgtggtccaggcctgggaggtccctgagactctcctgtgagcgtctggattcatcttacaataactatggcatgcctacgtgggtccgccagggcctccgaggccaaggggctggagtggttgcagttgtgtggtatgagtggaataatagatactatgcaagactaccggtgaacgggtccgattaccactactcctaccgagaacgaactaacttaccaaacgtaactactttacgttcctagactaagtacgaacacgacctggtaacgacggaccggaggaccgaacggacgtaacgtaattagttaccgtaggttcggacggaaaggaacggacggtacgtacggggaccgtaccccggtacccccggtaggtacccgg

SEQ ID NO: 39650 - DNA, 669 bp, Homo sapiens
  misc_feature: GYAE6OF01DNOY1.35.67.G01.1.454.CMB.1.raw
  modified_base (326)..(326): a, c, t, g, unknown or other
  misc_feature (326)..(326): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacaggtgacgcctccagggtaggggtcttggggacctctggactgatccttggtcctcccgctcctcaggctcgaccgggcccagcactgactcagtggcatgtgtttctccctctttccgaggttcctgggcacgagtctcgccctgactcacgtccctcgcctccgtgtcgtgggtctccgtggacngtcgatcacctatcctctgcacgtcggaaccagcagcgtagtggttaggggtactcgtaccttgtccttccgtaggtactcaaccgtacgcctaacccgaggacctaaaacccgcccctaaacgttactttaaagttaactaacggaactaacctaacggaccctaacccgtgtaacgggttactttaccgtaactttccgtacctttcgaccggtttacggtacccttaacccgtacggttaccgtaccggaacccgttaacccgtcccggtaccccttccccgtaacgtaacctaaccgtttcctacggttcccgggtacccgttccggggcgtaacgggg

SEQ ID NO: 39651 - DNA, 562 bp, Homo sapiens
  misc_feature: GYAE6OF01BB0YU.35.67.G01.1.454.CMB.1.raw
  modified_base (198)..(198): a, c, t, g, unknown or other
  misc_feature (198)..(198): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaagggactggagtggttggcagttgtgtggtatgatggaagtaatagatactatgcagacaccgtgaagggccattcaccatctccagagacaattccaagaacactttgtccngcaaatgaacngcctgagagccgaaggacacggcgaatatattactgtgacgagaagcgagtgggacgcccgtaccccggatgagcacgtcgggccagggccaccgtggtccgccgtctcgtccacgccctccaccgaacgggccccagtcccggtccttcccccgtcggccctacccctccctacccgaacgtccgacccgtaccccttcggcgggggcctaccgcggtccccggg

SEQ ID NO: 39652 - DNA, 285 bp, Homo sapiens
  misc_feature: GYAE6OF01A676F.35.67.G01.1.454.CMB.1.raw
  modified_base (252)..(285): a, c, t, g, unknown or other
  misc_feature (252)..(285): n is a, c, g, or t
tcagtacagatcgtcacgaccggtgctcgatttagagtatacatattggggtttggggggtttggtggtctccactcccgccttgacgaggcctgattattattgttgctcatatgcaggtagtagcactaatgtcttcggaacgtgggaccaaggtcaccgtcctaggtcagtcccaaggccaaccccactgtcactctgttcccaccctcctcacgagtctgtactgagcgggctggcaaggcgcatagnnnnnnnnnnnnnnnnnnnnnnnnnnnnnnnnnn

SEQ ID NO: 39653 - DNA, 683 bp, Homo sapiens
  misc_feature: GYAE6OF01BZP9F.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcttgggttttcctcgttgctcttttaagaggtgtccagtgtcaggtgcagctggtggagtcgtgggggagcgtggtccagccgtgggacgtccctgagactctctgtgagcgtctggattcattcttacaataactatggcatgctacgtcgggtcccgcgaggcctaccgaggcgaagggtactgggaggtgggttggcgtaggttgtggtggtatggaagtagggtaaactaagtagaattacgtaagtcgacgaacgtaccgtacggtaggaaacgggtcctaacttccaaccctactcctaccgaacgtaacgaaccttaaacgttaccgaaacgtaaccttacgttttacgttacccttacgaaacgtaaacgtacggtaaacctacggtacctaaggaacggaccggaaccggaacggtaccgaaccggtacgtaacgttaacgttaacgttacggttggtaaccggaaggtaacggtaacggtaccggtaagggttacggggaccccgtaccccggtaacccccggg

SEQ ID NO: 39654 - DNA, 694 bp, Homo sapiens
  misc_feature: GYAE6OF01C417K.35.67.G01.1.454.CMB.1.raw
  modified_base (266)..(266): a, c, t, g, unknown or other
  misc_feature (266)..(266): n is a, c, g, or t
  modified_base (685)..(685): a, c, t, g, unknown or other
  misc_feature (685)..(685): n is a, c, g, or t
tcagtacagatcgtcacgaccggtgctcgatttagagtatacatagttggggttggggggagaggagcccagcactagaagtcggcggtgttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctgagactctctgtgagcgtctggtnttcatccttacaagttaactagtgacagtcgctacgtcggggtcccacgacggcctccgaaggcgaaacggggtctggggtagttgggttcggacgtaggttgtaggttaggtagttgaagtaggaacgttaaatagaactaactagtacggactaagaccgtacggtaggacgggtacctacgttaccaaccgcttcccgtaaccgaagaacgtaacctaaccttaaccgaaaacgttaaccgtacttttacggtaccctagtaacctaaaggtacctaaaccggtgtacccgtggaaccggtacgaccgggacggaaccgaacggtacgaacttaacgttacgttaccgtagggttacgacggtaacgggtaagtccggtaaggtacggggttaacccgccccggtaaccccgggtntaaaccggg

SEQ ID NO: 39655 - DNA, 637 bp, Homo sapiens
  misc_feature: GYAE6OF01CQ6PN.35.67.G01.1.454.CMB.1.raw
  modified_base (270)..(270): a, c, t, g, unknown or other
  misc_feature (270)..(270): n is a, c, g, or t
  modified_base (324)..(324): a, c, t, g, unknown or other
  misc_feature (324)..(324): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctgggtggagtcgtggggggaggcgtggtccaggccgtggggacggtccctggagactctcgtgtgagcgtntggattcattcttacaaattaactagtcggctatcgcctacgtggggtaccccncgacggcctaccgaggaccgtaaggggactgggacggttgggttggcgtaggttggtggttaggtatggagtaggaaagttaataggattacgatgacagaccacggtaggaacgggcctataccactacgtccctacgaagtaagaacctaactaccaaacgtaactactttcgttacctacgaacctaaagtacgaacacggtactaggaagacgaccggaggacgaccggacgtaattacgtaagtttcgtagtacggacgaggaacggtcgtaaggtacgggaccgaccccggtccccggagtaacggg

SEQ ID NO: 39656 - DNA, 638 bp, Homo sapiens
  misc_feature: GYAE6OF01B793M.35.67.G01.1.454.CMB.1.raw
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgtagcctctggattcaccttcaatatgtatagcatgacctgggtccgccaggctccgtggggaagggctggagtgggtctcatctattggaagtagtgttgtttatacatattatggagacggcgggtgggggccattcgaccatcctccagacgacaacgcaaagacgcagtattcngacaaatgaacncgctgcgagacgagacacggctgtagtattacgtgtgacgagacgtggagggcgtacggtcccggttcccccgggttagtcggtacgtcggtcgggacacggacgggaccgaccggtccgaccgtcctcctaccgacgtcccgtacccaaccgaaccgggtccccacgttcccggttacccttcccccgtcggtacccctaccccgtacccttacccgaacgtaccgtacctacccgtccggtcggggacccaccggaccggcccggaccccggtcgggtcccgtcggtaccccgg

SEQ ID NO: 39657 - DNA, 621 bp, Homo sapiens
  misc_feature: GYAE6OF01DBAJE.35.67.G01.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
tcagtacagatcgtcacgaccggtgctcgatttagagtatacatattgggtttggggggggtcacaagaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctccngcactggaaccngcagtgacgttggngttataactntgtctctggtaccaacaccaccaggacaaacgccccaaatcatgatttangatgtcagtaatcggcctcgtagggttctaagtcgcttctctggctacagtctggcaacgacggccctccngaccatctcgtgggcctccgaggtctaggaccgtacggacggtctagtaagtttacttaccgtgctaaggtccttactaacttaactaacgtaaacccaggaaccacggtacctaacctttccgttcggtaacggtttccgggaaccggggtaacgggaccaaacggtccgttaccggacccggttccgtaacgggttaccaacggtccccgaaagggcccttaccccggtcccccgttcggtaccccg

SEQ ID NO: 39658 - DNA, 555 bp, Homo sapiens
  misc_feature: GYAE6OF01DLH14.35.67.G01.1.454.CMB.1.raw
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (454)..(454): a, c, t, g, unknown or other
  misc_feature (454)..(454): n is a, c, g, or t
  modified_base (548)..(548): a, c, t, g, unknown or other
  misc_feature (548)..(548): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggggagcgtggtccagccgtgggacggtccctgagacctctcctgtgaacgcgtctggattcattcttcaataactatggcatgctacgtgggtccncgagggcctccgagggccaaaggggctgggagttggtggctgttgngtggatgaatggaaagtanagtatactatgcaagacacggtgaaggccgtattacaccgatctaccagacgactaatccaaagtaactctttcgtcctanactaatagaacagcctaggagacgacgagtacgacggatagtatagtacgtgtcggacgaagagacggtagtacgggaccgcccgtaacccggngtaccgg

SEQ ID NO: 39659 - DNA, 728 bp, Homo sapiens
  misc_feature: GYAE6OF01A95HR.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcacgtggggtccgccaggctccgaggcaagggactggagtggttggctagttgtggtggtatgagtaggaagtaatagatactatgcagacgaccggtagaacggccgatccaccatcctaccgagacgactaacttaccaaagtaacctacttttcgtacctagacaaatcgaaacacgaccgtagaacgacggaccggaaggaccgacggacgtaagttactaacgtttacgtggtacggtacgaaggtaacggacggaggtacggggaaccgtacccggtaaccccggagtacggacgaccgaaccgggtcgggaccgacgggtacccgtacccggtcgggtcccgtcccgttaccgttcccgtaccgacccgtccccgtaacccgtaaccccggaaccggtaccccgtaccggttccccggttcccccgttcccccggtacccggtaccccttacccccgttacccgtacccgaaccggacccgtacccgtaccccggtccgggtacgggggacccaccgggtccgggtcccccggg

SEQ ID NO: 39660 - DNA, 630 bp, Homo sapiens
  misc_feature: GYAE6OF01AU5T6.35.67.G01.1.454.CMB.1.raw
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagcgtggtggagtcgtgggggagcgtggtccagcctgggaggtccctgagctctcctgtgaagcgtntggattcatcttacaataactntggcatgcacgtcgggtccnccaggcctaccgaggacaaggggtactgggagtgggttgctaggttgtgtggtatgagtaggaatatagattacatgacagaccaccggtagaagggccgtaatccaccactcctaccgagaacgacctaaacttaccaaacgaactacgttttcgtaccttagactaaattacgaactacgacctaggaaccggtacggaccggaacgggaaccaaccgggacgtaacttaaagttacctttaacgtcggtacggaacggtaaggaaacgggacggtaacggacgggggtaacccgcccccggttaacccccgggtagtaaccggg

SEQ ID NO: 39661 - DNA, 581 bp, Homo sapiens
  misc_feature: GYAE6OF01AUSEB.35.67.G01.1.454.CMB.1.raw
  modified_base (179)..(179): a, c, t, g, unknown or other
  misc_feature (179)..(179): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcttgggttttcctcgttgcttcttttaagnggtgtccagtgtcaggtgcagctggtggagtcgtgggggagcgtggtccagcctgggagtccctgagctctctgtgagcgtctggattcatcttacaatactatggcatgcacgtcgggtccgccacggctccgaggcgaaggggctgggacgtggttcggctaggttgtgtggtatggataggaagtaatagatactagtgacagacgacgtggaacggcctattcactatctacagacgacaactccaaagtaacctacgtttcgtacctagaactaagtacgaaccgtagtcctaggaagacgaccggaaggaccacgggacgtaagttacttaacgttacgtggtacggacgtaaggaacgtcgggtaaagtccggggacctccccggtaaccccggg

SEQ ID NO: 39662 - DNA, 1066 bp, Homo sapiens
  misc_feature: GYAE6OF01DJ39I.35.67.G01.1.454.CMB.1.raw
  modified_base (188)..(188): a, c, t, g, unknown or other
  misc_feature (188)..(188): n is a, c, g, or t
tcagtacagatcgtcacgaccggtgctcgatttagagtatacatattgggtttggggggggagaggagcccagcactagaagtcggcggtgttccatccggtgatcagcactgaacacagaggactcaccatggtagtttgggctgagcgttgggttttcctcgttgtcttacgttttaaggaggttntccaggttgtcgagggtgccgagcgtggggtaggacggttcggtagggggggaggtccggttgggtcccgagggtcccgggttaagggggaccggttcccctagggaacgtaccttccgttccgtagggtaacggaccggtcggttcgttaggtaactttccgaattccttaactaaaagttaacctaggtcggtacaagttcggaccgttaccggttcggggtaccccgaccgtacgggtcctaacccggacgggacggtaaacgggtacggttaggggtacggttcggggtttcgggaggtttaacgggttttgggttagggggtttaaacggttaaaggtttacgggtaaagggttaaagggggttaaaaaaggtttaaaggtaaccggtttaaactttaaccggttaaaggttacggaaaccggtaaaaccgggttacccgggtaaacccgggtaaacgggggtaacccggggtaccccgttaaaaccttttaccccgaaaaccccggtttccgttaaaccccgttaaacccgtaaaattaaacccgggtaaaaaccccttaaaccgtttaaaccccggtaaaaggtttaaaaccccctttttaaccgggttttttacccgttaaccctttaaaggaaacccgttaaaaacgttaccgggtaaaacccgtacggtccccgttaaagggaaaccgggttaccggtaacccggggaaccggaccgttaacggggacttaaaacggttaacgttaacggttttaacggtaaccggggttaggaaccgggtaaacgggtaaacgggtaaccggttaacggggttaccgggaaacccccgggtaaccccccgttaacccggggtacggttaaaccgggg

SEQ ID NO: 39663 - DNA, 563 bp, Homo sapiens
  misc_feature: GYAE6OF01BHP1D.35.67.G01.1.454.CMB.1.raw
  modified_base (202)..(202): a, c, t, g, unknown or other
  misc_feature (202)..(202): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
  modified_base (537)..(537): a, c, t, g, unknown or other
  misc_feature (537)..(537): n is a, c, g, or t
  modified_base (554)..(554): a, c, t, g, unknown or other
  misc_feature (554)..(554): n is a, c, g, or t
tcagtacagatcgtcacgaccggtgctcgatttagagtatacatattgggttttcctcgttgctctttaagaggtgtccagtgtcaggtgcagctggtggagtctggggggagcgtggtccagcctggggaggtccctgagactctcctgtgaagcgtctggattcatcttcaataactatggcatgcacgtcggggtcccncaggcctccgaggcgaagggctggagtggttgcaggttgtgtggtatgatagggaataatagatactangacagacacggtgaacggcctatcacatcacaganacaacttccaatactactttcgtacctagactaaagtnaaacngcctaggaagcgaccggagacacgganaattatattacgngtacgacgaagaagcgagtcgggacgtcccgacccggatagacgcgacggcgggaccgcggccgccgtcggtccgccgtctcctacgccgtcctccgacgacggccctacgttccgtccctcccgtcgccctacccgtcctacacgcncctaccgtgaccgggcncgcggccgg

SEQ ID NO: 39664 - DNA, 760 bp, Homo sapiens
  misc_feature: GYAE6OF01A5TR8.35.67.G01.1.454.CMB.1.raw
  modified_base (370)..(370): a, c, t, g, unknown or other
  misc_feature (370)..(370): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcgttgggttttcctcgttgcttcttttaagaggtgtccagtgtcaggtgcagctggtggagtcgtgggggaggcgtggtccagccgtgggacgtccctgagactctctgtgagcgttctggacttcgattcttacaattaactatggcatgctacgtcggggtccgccgaggcctaccgaggtacgaagggtcctgggtagttcgggttggacgtaggtttgngggttaggtagtaggtaataggggaaaagttaacgtagagttaactagtcggacgtaaagacccgtaaccggtaggaaccggggtacccgtacgttaccgtaacctacgttacccgtacccgtaagaaccgtaaacctaacctttaacccgtaaaccggtaaaccgtttaaccgttttccgttaaccccgttagtaaccgtaaacgttaccgaaaccgtacccggaccgtacgggtaacggaaccggacccgggaacggaaaccgacccgggtaacgtaacgttaaacgttaacttaacgggttacggtacggtaacggaaacgggtaacgtacgggtaagttaccgggggaaacccctaccccgggttaaccccccgggataaccgggg

SEQ ID NO: 39665 - DNA, 650 bp, Homo sapiens
  misc_feature: GYAE6OF01AHZZN.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcacgtgggtcccgccaggcctccagggccaaggggactggagtggttggcaggttgtgtggtatgatggaagtaatagattactatcgacagacaccggtggaacgggcctattccaccatcctcagagacaattccaaagaacctacttttgtacctgactaaatgaacacgctagagacgccggaggacacgggacattatatactgtagacgaagagcgagtacgggacgacccgtacccggatcggagtcgacggtacgggccgacgggccacccgtgggtacccgtccgttaccgttccgttaccgaccgtccccgtaccgaacccggtaaccggcccctacgttcccggttccccgttcccccgtacgggtcccctaacccccgttcccgtacccgaacgaccgtcccgtaaccccggttcggtaccgggggacctaacccggaccgggtccccggg

SEQ ID NO: 39666 - DNA, 257 bp, Homo sapiens
  misc_feature: GYAE6OF01EN2QG.35.67.G01.1.454.CMB.1.raw
  modified_base (244)..(244): a, c, t, g, unknown or other
  misc_feature (244)..(244): n is a, c, g, or t
  modified_base (250)..(257): a, c, t, g, unknown or other
  misc_feature (250)..(257): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggcccaaccccactgtcactctcgttccccaccctcctcacgatctgtactgagcgggctggcaaggcncatagnnnnnnnn

SEQ ID NO: 39667 - DNA, 840 bp, Homo sapiens
  misc_feature: GYAE6OF01AFUH0.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgctacgtgggtcccgaccaggcctccagggaccgaagggactgggtagtgggttgctaggttgtaggtggtatgtagtaggaagtaataaggactactagtgacagtacgacggtaggaacgggccgtattaccaacctagtacctaccgaagaacgactaaacttacccgaaaagtaaaccttacgtttacgttaccctaggtaactaaaacgtacggtaaaccaccggtaccgtaacggacggaacggtacccggaaggtaaccgaacggggtaccaagttaaattacgttacgtcgggtagacggtaaggaacggtacggtacggtacgggacccgtaacccggttaccccggaaggttacggaaccggacccggtacgggtaccggggacgtaccgggtaccctaccgggtaccgggtcccggttacccgttaccgtccggttacccgtacccggttaccccgtaaccggaaccccggtacccgggtaccccgtacccggtttaccccgggttaccccggttttcccccgaccccggggttacccctaccccccggttaacccgtccccggtaaaccggtaccccggtacccgttaccccggtaccgggttacccggggaacctacccgggtacccgggtccccccgggg

SEQ ID NO: 39668 - DNA, 787 bp, Homo sapiens
  misc_feature: GYAE6OF01CIGGR.35.67.G01.1.454.CMB.1.raw
  modified_base (295)..(295): a, c, t, g, unknown or other
  misc_feature (295)..(295): n is a, c, g, or t
tcagtacagatcgtcacgaccggtgctcgatttagagtatacatattgggtttgggggggagaggagcccagcactagaagtcggcggtgttccatccggtgatcagcactgaacacagaggactcaccatgggagtttgggctgagctgggttttcctcgttgctctttaagaggtgtccagtgtcaggtgcagctggtggagtcgtgggggagcgtgtaccagccgtggggacgtccctgacgtaccttcgtccgtgtacgaagtcgtcgtggatttcatcttacaataactntggactatcgactacgtcgggtccaccgacggtcctacccgagggtactaaaggggtaccttaggggaacgggttcgggtttcggaccgtaggttttcggtggtttaggtacgtagggtaagtagggtaaaacgttaagtaacggtaacgttaccgttaagtcggaaccgtaaagtaccggaaccgggttaaggaacggggtacccttaacgttacccgaaccttaacggtacccttaccggaaagtaaaccggtaacctaacgtttaaccctaaaacgggtaaacccttacgttttacgttacccgtaacgtaaccgtaaaagttaccgaaacgtaccggtaacccgtaggaccggaacggacccggtaacggaaccgacgggtacgtaaagtaaccgtttacgttaccgtagggtacggtaaacggaacggtaaggaccggtaagggttaccgggaacccgtacccccggttaaccccgggagtaccggg

SEQ ID NO: 39669 - DNA, 743 bp, Homo sapiens
  misc_feature: GYAE6OF01BRCUV.35.67.G01.1.454.CMB.1.raw
  modified_base (204)..(204): a, c, t, g, unknown or other
  misc_feature (204)..(204): n is a, c, g, or t
  modified_base (284)..(284): a, c, t, g, unknown or other
  misc_feature (284)..(284): n is a, c, g, or t
tcagtacagatcgtcacgaccggtgctcgatttagagtatacatattgggttttcctcgttgctcttttaagaggtgtccagtgtcaggtgcagctggtggagtcgtggggggaggcgtggtccagcctgggaggtccctgagactctcctgtgaagcgtctggattcattcttacaataactatggcatgcacgtgggtcccnccaggcctccgaggcaagggactggagtggtgctagttgtgtggtatgagtaggaagtaatagatactatgcagacacgnggaacggccatccacactcacagagacaactaccaaatacttactttcgtacctagacaaatagaacagacctaggaacgacggaccggaggaaccgacggacgtaattatattacgtggtacgacggaaggaagcggaggtacggggacccgtaccccgtaccccggaagtacggacgaccggtacgggtccgggacccggtacgggcccgtaccccggttcggggtacccgttccgttcccgttccgttacccgaccggttaccccctaccccggaaccggtaaccccgggccccttacgggttacccccggtttccccttcccccccggtaccgggtcccccctaaccccccggttaccccgtaaccccgtaaacccgggtaccccgtcccccggttaaccccggtacccggggtacccgggggaccccaacccgggtccccgggtacccccgggg

SEQ ID NO: 39670 - DNA, 599 bp, Homo sapiens
  misc_feature: GYAE6OF01ACO3Q.35.67.G01.1.454.CMB.1.raw
  modified_base (312)..(312): a, c, t, g, unknown or other
  misc_feature (312)..(312): n is a, c, g, or t
  modified_base (407)..(407): a, c, t, g, unknown or other
  misc_feature (407)..(407): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagcctctccgtgtgaagcgtctggtattcattcttacaattaactatggcatcgctacgtcgggtccnccgaggcctaccgagggccgaaagggcgtgggagttgggtggcttaggttggtacggtggtatggtagtagggtaaagtataacggtataactangacgaacgaccgacggtaggaaacggcgtaatccacctatcctacgagacgactaacgtaccaagtaccttacgtttacgtcctagactaagcgaactacgactagacgacgacggagtacgacgtactaagtacgtattacgtgtacggacgtaaggcgaacggttaggccggccgtacccggtaacccgg

SEQ ID NO: 39671 - DNA, 502 bp, Homo sapiens
  misc_feature: GYAE6OF01AUES4.35.67.G01.1.454.CMB.1.raw
  modified_base (184)..(184): a, c, t, g, unknown or other
  misc_feature (184)..(184): n is a, c, g, or t
  modified_base (237)..(237): a, c, t, g, unknown or other
  misc_feature (237)..(237): n is a, c, g, or t
  modified_base (242)..(248): a, c, t, g, unknown or other
  misc_feature (242)..(248): n is a, c, g, or t
  modified_base (250)..(250): a, c, t, g, unknown or other
  misc_feature (250)..(250): n is a, c, g, or t
  modified_base (253)..(254): a, c, t, g, unknown or other
  misc_feature (253)..(254): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (287)..(289): a, c, t, g, unknown or other
  misc_feature (287)..(289): n is a, c, g, or t
  modified_base (292)..(294): a, c, t, g, unknown or other
  misc_feature (292)..(294): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (315)..(316): a, c, t, g, unknown or other
  misc_feature (315)..(316): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaagccaacccntgtcactctcgttcccacctctcacgatctgtactgacgcggctggcaaggcncatgnnnnnnnancannctgatgcntagnactangtgcagctggaactannntgnnngctcntcnacgagnagtcgannctnaagcngtactcgtagtctgtaacgctcggtancgttacgtcgtacgtcgtcgtaacgtcgacgtacgtacggtntaccgngtagtacgacgcttagtaccngtcgtaaccgtctaacggtccgtacgacgttacggtcagtacgtacgtacgtacgtacgtacgacgacgtactcgtcgtacg

SEQ ID NO: 39672 - DNA, 553 bp, Homo sapiens
  misc_feature: GYAE6OF01CW0BG.35.67.G01.1.454.CMB.1.raw
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (547)..(547): a, c, t, g, unknown or other
  misc_feature (547)..(547): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagctggtggagtcgtggggggaggcgtggtccaggccgtggggagtccctgagactctcctggtgagcgtctggattcacttcttacaattaactatggacatgcacgtgggtcccgcaggctccgaggcaaggggctggngtggtggntaggttgngtggtatgatggaataagtagatactatgacagaccgacgtgaacgggcacttcacctatcctacagacacactaccaagtactacgtttgttcctgactaatacgaacacgctacgagacgaccggaggacgacggacatattacgtactggagtcgaaggagacgtaggtacggaccggtcccgtaccccggngtacgg

SEQ ID NO: 39673 - DNA, 532 bp, Homo sapiens
  misc_feature: GYAE6OF01EBJSA.35.67.G01.1.454.CMB.1.raw
  modified_base (526)..(526): a, c, t, g, unknown or other
  misc_feature (526)..(526): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggggaggcgtggtccagccgtggggaggtccctgagactctcctgtgagcgtctggattcatcttcaataactatggcatgcacgtggggtccgccgaggcctccgaggcaaggggactgggagtggtggctagttgtgtggtatggatggaagtatagatactatgcagacacgtgacggcatcacatctcagagacaatccaagactactttgtcctagacaatgaacagcctagacgacgccgaggacacggacgatagttattacgtggtagcggaagaaggcgtaggtcgggacgtcccgtaccccggngtacgg

SEQ ID NO: 39674 - DNA, 593 bp, Homo sapiens
  misc_feature: GYAE6OF01A0JYK.35.67.G01.1.454.CMB.1.raw
  modified_base (175)..(175): a, c, t, g, unknown or other
  misc_feature (175)..(175): n is a, c, g, or t
  modified_base (193)..(193): a, c, t, g, unknown or other
  misc_feature (193)..(193): n is a, c, g, or t
  modified_base (485)..(485): a, c, t, g, unknown or other
  misc_feature (485)..(485): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagnggtgtccagtgtcaggtncagctggtggagtcgtgggggagcgtggtccagcctgggagtccctgagctctcctgtgagcgtctggattcattcttacaaattaactatggctagtgcctacgtggggtcccaccgaggcctaccgagggccgaaggggactgggagttggtggctaggttggtgtggtatggagtaggaaattaataggaattacgtatgacgaagaccgaccggtaggaacgggaccgtagttaccacctactacctccgaagacgaactaactaccaaacgaactacctctgtctcngaccatagtacgtacgacgttcgtacgggactacggacggaccgtacggtaccgttcgtacgttatacgttgcgtacgaaggactaagtaacgtaaattgttagtacg

SEQ ID NO: 39675 - DNA, 703 bp, Homo sapiens
  misc_feature: GYAE6OF01EDZT7.35.67.G01.1.454.CMB.1.raw
  modified_base (201)..(201): a, c, t, g, unknown or other
  misc_feature (201)..(201): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcattcttacaataactatggcatgcactgggtcccnccaggcctccgaggacaaggggactgggagttgggttggctagttgtggtggtatgagtaggaaagtaatagatactatgacagacaccgtagaacggccattcaccactcctaccaagacgaactaattaccgaaagtaactacttttgtacctagacaaatcgaacacgctagagacgcgaagacagtggactatattattactgtagacgaagacgtacgaggtacggacgacccgtacccggatacggagtaccgacggtcggggaccgacgggtacccgtaccggttaccgggtccgtacccgttccgttccttaccgtaccgtccccgtaacccgacccggtaacccgggtcccctaaccgggttcccggttacccccgttccccccggtacccggtcccccttaacccccgtttaccccggaaccccgtaaacggacccgtaacccgtaccccggttacccggggtacgggggcccctaacccgggtacccgggg

SEQ ID NO: 39676 - DNA, 272 bp, Homo sapiens
  misc_feature: GYAE6OF01CY46F.35.67.G01.1.454.CMB.1.raw
  modified_base (247)..(272): a, c, t, g, unknown or other
  misc_feature (247)..(272): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctctcacgatctgtactgagcgggctggcaaaggcgcatagnnnnnnnnnnnnnnnnnnnnnnnnnn

SEQ ID NO: 39677 - DNA, 523 bp, Homo sapiens
  misc_feature: GYAE6OF01CC7TB.35.67.G01.1.454.CMB.1.raw
  modified_base (428)..(428): a, c, t, g, unknown or other
  misc_feature (428)..(428): n is a, c, g, or t
  modified_base (443)..(443): a, c, t, g, unknown or other
  misc_feature (443)..(443): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttggggttatgaccttgtctcctggtatcaacagcaccaggacaaacgcccccaaaactccttaatttaactaaggacaactaagcaccctcagggatttctaatcgcttctctggctcaagtctggcaactcgcctcctgaccatctctcgggctccaggcgtgacgacgaggctgatttatactgctagctnactataacaccgtancagcacttctcgtggttcggcggtagggaccaagctcgaccgtccgtacggtcacgacccgaaagccgtccgtacccccg

SEQ ID NO: 39678 - DNA, 849 bp, Homo sapiens
  misc_feature: GYAE6OF01CNXVV.35.67.G01.1.454.CMB.1.raw
  modified_base (279)..(279): a, c, t, g, unknown or other
  misc_feature (279)..(279): n is a, c, g, or t
tcagtacagatcgtcacgaccggtgctcgatttagagtatacatattgggtttgggggggagaggagcccagcactagaagtcggcggtgttccatccggtgatcagcactgaacacagaggactcaccatggagtttgggctgagcgttgggttttcctcgttgcttcgttttaagaggtgtccagtgtcaggtgcaggctggtggagtcgtggggagcgtggtccagccgtggggacgttcccctgacgtaccttcgtcctggtcggaagtccgttntagggtacttcagttcctttacgaaattaaccgtagtcggactagttcgacctacggttcggggtacccacgtacggcctccgaagggaccgaaagggtccgtagggtaacggttcgggttcgacgtttaagttttcgggtagttaggttatggtagtagggtaaattaagtagaacgtttacgtagtacggacctaacggtaccgacggttagggaaccgggtccctaacgttaccgtaacccgtaagttacccgttaccgaaacgtaacggtaacctaacgtttaacccgaaaacgtttaaccttaccgtttttacgtaccccttaggaaaccgtaaacgttaccgaaacccgtccggtaacccgtttacgggaacggttaacccgggtaacccgggtacggtaaacccgtaccggggtacttaaacgtttaacgttaaaccggtttaaccgggtagggtttacgggaaaccccgggttaaaggtaacccgggtaccggttaaaccggggttacccggggaaacccgtttacccccccgggttaacccccgggtaaaggtaacccggg

SEQ ID NO: 39679 - DNA, 731 bp, Homo sapiens
  misc_feature: GYAE6OF01AJQKB.35.67.G01.1.454.CMB.1.raw
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
tcagtacagatcgtcacgaccggtgctcgatttagagtatacatattgggtttgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagtcgtggtccagccgtggggaggtccctgagactctcctgtgagcgtntggtattcatcttcaataactatggcatcgcacgtcggggtcccnccaggcctccgaggcgaacgggctgggaggttgggttggcgtaggtttcggtggtacggttagtaggtacgtaggggtaaaagttaaagttaacggtaattaaccgttaagtcggaaccgtaaacggtacccgtaacccggggtaggggaaaccggggtcccgtaacgtttacccgaacccgtacgttacccgtacccgaaggtaaccggtaacctaaacgtttacccgaaaacggttaaccttaccgttttacggttaccctacggtaacctaaagttacgaaacccgtacgaccgttacggaaggacccgaccgggtaacgggaccgaaccgggtacgtaaacttaacgttacgttacgttggtaggaccggaaggacggacggtaggttacgggaccggtacccccgtacccgggagtaccggg

SEQ ID NO: 39680 - DNA, 914 bp, Homo sapiens
  misc_feature: GYAE6OF01EJXUJ.35.67.G01.1.454.CMB.1.raw
  modified_base (185)..(185): a, c, t, g, unknown or other
  misc_feature (185)..(185): n is a, c, g, or t
  modified_base (907)..(907): a, c, t, g, unknown or other
  misc_feature (907)..(907): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctggagtccgttgggttttcctgttgtctttacgtttaaggnggttcgtccgtaggttcgtcgaggtcgacgtcggtgtggggtaggtacggttcggggtaggggggacggtccggttcggtacccgacgggttcccgggttacggggtaccggttccccgtaaggtaccgtacccttcccgttcggtaggtacggtaaccggtccgttacgtaggttacttactactttaccttaaacgtaaacttacgtaggtacggactacggttccggaacccgttccggggttccggtaccccggtacgtaaccgggtccccgtaaccgggaacgggtaaccggtaaaccgggggttcgttagggggttacgggttttcgggttaccggtaacggtttaaggggttttgggtacgggtttaaggttaacgttaaaggggttaacgggttaaaagggggttaaaactttaagggttaaacgttaacgttttaaccgtaagggtacggtaaacccggtaaacggtaacccggtaaccgggtaaggggtaacccggttacccttaacgtacccgaaccgttaaccgttcccgaaaccggtaacgtaaccgttaaaacccttaaccgtaaaccgtaaacggttaaccctttcgtttacctacggtactaaagaacgtaacgacgtacgacgtagacggtacacggtacacggtacgtattactaagttacgtgtggacgagagtacgacggtcggtaccggaccctcccgtgnggtaccg

SEQ ID NO: 39681 - DNA, 809 bp, Homo sapiens
  misc_feature: GYAE6OF01DKYWY.35.67.G01.1.454.CMB.1.raw
  modified_base (173)..(173): a, c, t, g, unknown or other
  misc_feature (173)..(173): n is a, c, g, or t
  modified_base (198)..(198): a, c, t, g, unknown or other
  misc_feature (198)..(198): n is a, c, g, or t
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (686)..(686): a, c, t, g, unknown or other
  misc_feature (686)..(686): n is a, c, g, or t
  modified_base (701)..(701): a, c, t, g, unknown or other
  misc_feature (701)..(701): n is a, c, g, or t
  modified_base (793)..(793): a, c, t, g, unknown or other
  misc_feature (793)..(793): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctggagtcgtgggttttccgtcgttgcttntttaaggaggttgcctgtgcaggtnctgcggtggggagtggtgggggagtcggtcggtccaggccgtaggggtacgtcccgtgaacgtcttctccgtggtcgcgtacggccttgtagggtacttcctaccgttntaaggttaatttagnggggaactaggttcgaccgaccggggtttgggaacccccgtcccggaagggttcccttaacccggggaacgggtaggaaaccggggggtttcggtaaggggtaccggggtttcggggggaaggttaccttaaaaggggttttataaaggttccgggttaaatgggaagtaacccggggtaataagtaaaaagtaaaaggttctaaggggttccaacggttaacggtaccgttaccgggttaaagggaacccggggtacccttaacggtttccaccccgtttaaggaccctaaccgtaaggaaaccttaacgaaaccccttaagaacggaaaccgtcgtacgtaacgtttcgaactaccgtaaanacgttaacacgacgntaggaacgaccgacgaaccgacgtacgcgttacgttagtaccgttagttcggtaagacgtaaagtaccggtaaggtaaccgaggtttaacgnggttttacctaaacgg

SEQ ID NO: 39682 - DNA, 737 bp, Homo sapiens
  misc_feature: GYAE6OF01E0JTK.35.67.G01.1.454.CMB.1.raw
tcagtacagatcgtcacgaccggtgctcgatttagagtatacatattgggttgggggtcacaagaggcagcgctctcgggacgtctccaccatggcctgggctctgctgctcctcactctcctcactcaggacacgagggtcctgggcacagtctgccctgactcagcctgcctcgtgtctgggtctcctggacagtcgatcaccatctcctgcactcggaaccagcagcgtagttgggtttagggggttatcggtaccttggtccttccgttggtataccaacgacgcccaaccgaggaccaaaaccgacccccctaaaacttacttttaaactttaacgtaaacggtacctaacgtaaacgccgtaacccgtacgtaagggttactttactaacttccgtacttcctacgtcggtacctaccgtaagttccgtacggcctaaccgttcccggtacccttacccgtacgaaccgtaacgttccgtacggtcgggtccgtccgggtacgttagggaacgggacgtacgggtacgtacggttaatttaacgtttacgtttggttcgtacttacgtaagttacgtacgtacggtaagggttagtaacgtacttaacgttagttcgttaccgttacggtaacggtcgggaaaccgtacgggtcccgtacccggttaccgtacggtacccgaacggtacccccgaaacggtacccccaaccccgtcgttccgtcgtacccg

SEQ ID NO: 39683 - DNA, 758 bp, Homo sapiens
  misc_feature: GYAE6OF01BYOJV.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgacgactctctgtgagcgtctggattcatcttacaataactagtggcatgccacgtcgggtccgccgaggccgtaccgagggtaccgaacggggtaccgttgggacggttcgggttgggaccgtaggttttggtggttagggttaatggtaaggttaggggtaaagtttaaagttaacgggtaattaaccgttagttacggacgtaacggtaacccgtaaccgggttaggaaacggggtcccgtaagtttcccgaaccgtacgttaccccttaaccgaaggaaccgtaacctaaacgtttacccgaaaaggtaaacccttaccgtttttaccgtacccgtaacgtaacgtaaactccgtaaaccgtacggtaccctaaggtaacggaccggaccgggaacgggtaaccgaaccgggtacgtaaattaagttaacttaacggtaggttaacggacggtaaaggaacggtacgtaacgggtacgggaccggtaccccccgtaacccgggagtaaccggg

SEQ ID NO: 39684 - DNA, 699 bp, Homo sapiens
  misc_feature: GYAE6OF01DQZI4.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctccgtgtagaagcgtctggattcatcttacaataactatggactatgacgtacgtcggggtcccgcgacggcctaccgagggaccgaaggggactgggtagtgggttggctaggtttgtaggtggttagtggagttagggaaagttaagtaagtattaacgtagtacggactaacggtacgtaaccgggtaggaaaccgggtccgtaactttacccgaacctagttaccaaccgtagaacgtaacctaaacttcccaaaaggttacccttacgttttacgttaccctaacggtaactaaacgttaggaaaccgtacgtaccgtacggaaggtaccggaaccgggtaacggacgtaaaccgggacgttaagtacgtttagttaacggttgtacggacgaaaggtaaccggacggaacgggtcgggaacccgtaccccgggtaaaccccgg

SEQ ID NO: 39685 - DNA, 738 bp, Homo sapiens
  misc_feature: GYAE6OF01AX97M.35.67.G01.1.454.CMB.1.raw
  modified_base (208)..(208): a, c, t, g, unknown or other
  misc_feature (208)..(208): n is a, c, g, or t
  modified_base (721)..(721): a, c, t, g, unknown or other
  misc_feature (721)..(721): n is a, c, g, or t
tcagtacagatcgtcacgaccggtgctcgatttagagtatacatattgggttttcctcgttgctcttttaagaggtgtccagtgtcaggtgcagctgggtggagtcgtggggggaggcgtggtccagccgtgggaggtccctgagactctcctgtgaagcgtctggattcattcttacaaataactatggcatgcacgtcgggtcccnccgaggcctccgagggacaaggggctgggagtgggttgctaggttgtgtggtatggatagggtaaagtaatagacttaacttagcgacaacggactaccggtaggaacgggtaccctattcccaacctacttccgtaccaaggacgtaacctaactttaccgaaacgtaacctttcgttttacggtaccctagtaacctaaacgttacgaacgtacgtacgaggacggtaaccggacgggaacggtaaccgacggacgtaaattagtttactagtcggtaacggacggtaaacgagggtacggtaacggtccgggaaacccgtacccccggaaccgggagtaccggcgaccggtacgggcccgggacgaccgggtcccgtacggtccgggtcccgtcgttacctacgtcccgaccgtacccgacccgtaaccggcggtaccctcggtcccgtcccctaccccgtcgcccctcctaccgtcgacgtccccgtcgtacccggtcgggacgacccnccggtcccggtcccggg

SEQ ID NO: 39686 - DNA, 665 bp, Homo sapiens
  misc_feature: GYAE6OF01EV85Z.35.67.G01.1.454.CMB.1.raw
  modified_base (199)..(199): a, c, t, g, unknown or other
  misc_feature (199)..(199): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccncaggctccaggcaagggctggagtggttggcagttgtgtggtatgatggaagtaatagatactatgcagacacgtagaagggccattacaccatctcagagacaacttccaagtaactacttttcgtctagactaaatcgaaacacgcctaggaacgacggaccggaaggacgacggtacgtatttaactacgtttacgtgttacgacggaaggtaacgacgggaagtacggggaaccgtaccccggtaaccccggtagtacggacgacgtaccggtcggggacccgacggggcccgtacccgtcgggtccgtcccgttactccttaccgacgtcccttacccgaaccggacggcccctacggtcccggttaccccgttccccgtccggtccctaccccgtacccacccaaaccgccgaccccgtaacccgtccgggtaccggggaccacccgggcggtccccggg

SEQ ID NO: 39687 - DNA, 815 bp, Homo sapiens
  misc_feature: GYAE6OF01BT73Y.35.67.G01.1.454.CMB.1.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
tcagtacagatcgtcacgaccggtgctcgatttagagtatacatattggggtttggggggggagaggagcccagcactagaagtcggcggtgtttccatccggtgatcagcactgaacacagaggactcaccatgggtagtttgggctggagtcgttgggtttttcctcggttgtccttagttttaaggnggttgtccgagtgtcgagggtgcaggtcgtgggnggtaggtcgggtggggggacggtcgtggtccaggtccggtggggaccgttcccgtaggacgtaccttctccgtggtaggacggtccgtgttggtacttcatttctaactaaattactagtgactagtcggaccgtacggtcgggtccacgaggtcctacggaggacgagggtactggggtagtgggttggcgttaggtggtaggtggtagtggtaagtaggtaaagttaatagtaacgttagtagtacggaacgtaacggaccgttaaccgggaagggtaacccgggtaccttaaactcccgtaaaccgttcttacccgaacgtataacgtaaacctaaccgtttaaccgaaaacttaccgttactttttccggaacccttagaaacctaaacgtcgtaaacccgtacggtacccgtaagggaaccggaacgggtaaccccggggtaagacccggtaaaccgggtaactttaaactttaacggtttaaccggtacgggttacggaacggtaaccgggaaagggtaccggtaggggaccggggttaaccccgggaacccggtacccccccgggttaacggtagggtaccggg

SEQ ID NO: 39688 - DNA, 811 bp, Homo sapiens
  misc_feature: GYAE6OF01CUVSY.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctgagcgttgggttttcctcgttgcttcttttaagaggtgtccagtgtcaggtgcagcgtgggtggagtcggtgggggaggcgttggtcccaggccgtggggacggtccctggacgaccttctcctggtgaacgtcgtctaggtattcattccttacaaagttaactagtggcaagtcgacctacgtcggggtcccaccgaggcctaccggaggtccgaaagggtcgtagggtacgtgggttcgcgttaggttggtggtaggtagtaggagtaggaaagttaacgtaggtaacttacgtatacggacgaacgaccgtaaccgggttagggaaacgggtcccgtaacttaccgaacctacgttacccgtaacccgaaggtaaccgaaaccgttaaacctaccgtaaaaccgttaaccgtttaccttttaccggttacccgtaagtaaactaaaacgttaccgaaaccgtaacgtcccgttaacggaacgggaccgggaacccgggtaacgggaacccggtaaccgggtaaccgttaaagtttaaccgttaaacggtttaccggtaggttacgggtaaccggtaaaaggtaacggggtaccggtaaaccgggttacggggaaccccggttaacccccccgggttaaaccccgggtaaggttaacccgggg

SEQ ID NO: 39689 - DNA, 765 bp, Homo sapiens
  misc_feature: GYAE6OF01BN6GD.35.67.G01.1.454.CMB.1.raw
  modified_base (273)..(273): a, c, t, g, unknown or other
  misc_feature (273)..(273): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctgagcttgggttttcctcgttgcttcttttaagaggtgtccagtgtcaggtgcagcgtgggtggagtcgtgggggaggcgtcggtcagtccgtgggacggtccctgacgtactctcgtgtcgaagcgtntggtattctattctacaaataactagtcggctatcggctacgtcgggtcccgcgtacggcctccggaggacgaaggggtctaggggtacggttgggttcggacgttaggttggttggtaggttaagtaggtaaggttaggtaaagttaaataggaatttaacgtagtcgacgtaaggaacctcgggtaaagggaacgggtaccgtaacttaccgaaccgtacttacccgtaaccgaagtaaacgtaaccgtaaacgtttaaacccgtaaacgttaaccctttaacggttttacgtacccgttaacggtaaacctaaacgtaccggtaaactaccgggaccgttaacgggaaccggaacgggtaacccggaacggtaaaccggaacgtaacccggttattaaacgttacgttaacggttgggacgtaacggtaaggaacggacggtacgggtacccggaaccggtaacccccggttacccgggagtaaccggg

SEQ ID NO: 39690 - DNA, 822 bp, Homo sapiens
  misc_feature: GYAE6OF01DOV9S.35.67.G01.1.454.CMB.1.raw
  modified_base (223)..(223): a, c, t, g, unknown or other
  misc_feature (223)..(223): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacgagggtcctgggcacagtctgccctgactcagcctgcctcgtgtctgggtctcctggacagtcgatcacatctcctgcacgtgaaccngcagcgtagttgggttagggttactcgtaccttcggtctccgtggtactacaacacgaccaccgacggaccaaaccgacccctaaacgttcttaattagtaacgacaactaacgaccgtaccctagacggtactttacgtaatccgtcttactcgtacgtccttacgtaacgtcgtacggacctaaccgttccggaccccttcccgtacggtaaaccttacgttacccgtttccggttaccgggggtacccgttccgggggtacccgttacggggaacggggtaaccgggtaaccgggtacgttttaacgggtttaacggttttttaacgtttttaacgttttcggttttaccgggttacctttacccgttaaagttttacgttaacgggtaaccggttaacggggttttaacgtaccggtaaccgtttaaacgtttacgggttacgttttaacccgggttaacccggttaacggttacccgggggtaaaccgttaaccgggtacccgttaacccgggttaccggtttaccgggtaaccgtacccggacccgtaaacccgggtaccccaaacccccgtacgttccggtaccttacccgg

SEQ ID NO: 39691 - DNA, 647 bp, Homo sapiens
  misc_feature: GYAE6OF01ASESS.35.67.G01.1.454.CMB.1.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (358)..(358): a, c, t, g, unknown or other
  misc_feature (358)..(358): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagcttgggttttcctcgttgcttcttttaaggaggtgtccagtgtcgaggtgcagcgtgggtggagtcgtgggggaggcgtggtccagccgtgggacgtccctgacgctctcngtgacgcgtctggattcatcttanaatactatggcatgactacgtcgggtccncgcgcgtccgacggacggacggacggtcggtaggtggttggtacgngttgtgtaggtgtagagtagtaagtataggtaatacgtactagactacgactaccggtacgacgggacgtactacgtaccactacctcgtaacgaagtaacgtaactaaccgtaacgtaacctacgtttaccgttacttaccgaacgtaactacgtaaataccgacgtcgaaggtaacggaccggaaccggacggaccgtagtattaacgttacgttacgtccggtaggacgacggtaacggacggtacggtcgggaaccgtaccccggtaccccggtaggtaaccggg

SEQ ID NO: 39692 - DNA, 676 bp, Homo sapiens
  misc_feature: GYAE6OF01C7BNR.35.67.G01.1.454.CMB.1.raw
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (553)..(553): a, c, t, g, unknown or other
  misc_feature (553)..(553): n is a, c, g, or t
  modified_base (636)..(636): a, c, t, g, unknown or other
  misc_feature (636)..(636): n is a, c, g, or t
  modified_base (662)..(662): a, c, t, g, unknown or other
  misc_feature (662)..(662): n is a, c, g, or t
tcagtacagatcgtcacgaccggtgctcgatttagagtatacatattgggttttccttgttgctcttttaagaggtgtccagtgtcaggtgcagctggtggagtcgtggggggaggcgtggtccagccgtgggaggtccctgagactctcctgtgaagcgtctggattcatcttacaataactatggcatgcacgtcggggtcccgccagggcctccgaggacgaagggactgggagttgggttggctaggttgtgtggtatggagtggaaagttaagtagattactatcgacaagaccgacggtaggaacgggccattcaccatctccgaagacgaactaacttaccaagtaacttcgtttcgtacctagaacaaatacgaacacgtccgtagacgacgaccgaaggacgacggngtaatagttacttacgngtacgacggaagacggacgaaggtacgggaccgtaccccgaacccggtagtacggacgaccgtacgggtccgggaccgacgggccctaccggtcggtccgcccgttcttcctaccgtccncccgtacccgaaccgaccggtcccctacgttccccggtcccttccccggcgtacccctacccctccgtaccgaacggtacccncccgtaccggtcgggtaccgggaccnccggcggtccccgg

SEQ ID NO: 39693 - DNA, 255 bp, Homo sapiens
  misc_feature: GYAE6OF01DF6KP.35.67.G01.1.454.CMB.1.raw
  modified_base (251)..(255): a, c, t, g, unknown or other
  misc_feature (251)..(255): n is a, c, g, or t
tcagtacagatcgtcacgaccggtgctcgatttagagtatacatattgggtttggggggtttggtggtctccactcccgccttgacgaggctgatttattattgttgctcatatgcaggtagtagcactaatgtcttcggaacgtgggaccaaggtcaccgtcctaggtcacgcccaaggcccaaccccatgtcactctcgtccccaccctcctcacgatctgtactgaggcggctggacaaggcgcatgnnnnn

SEQ ID NO: 39694 - DNA, 629 bp, Homo sapiens
  misc_feature: GYAE6OF01DKX59.35.67.G01.1.454.CMB.1.raw
  modified_base (264)..(264): a, c, t, g, unknown or other
  misc_feature (264)..(264): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagctgggtggagtcgtgggggagcgtggtccaggccgtgggacgtccctgacgctctcctgtgagcgtntggattcgattcttacaattaactgtggcagtgctacgtcgggtccacgaggctccgaggcgaagggctgggagtggtgacgtaggttgtgtggtatggtagtaggtaataagtagatacgtagtgacaagtaccgacggtggaacggtccgtacttaccgactacgtaccgtacgaagaacgtaactaacgttaccgaaacgtaacgttacgtttcgttactacgtaacgtaacgtacgaactacgtccgtagaacgtacggacggtacggaaccggacgtacgtaacttacgtaacgttacgtggtaggaccggagacggacgtacggtacggtacccgaacccggtaccccggtagtaccgg

SEQ ID NO: 39695 - DNA, 786 bp, Homo sapiens
  misc_feature: GYAE6OF01EXRA6.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagcgtggtggagtcggtggggggaggcggtggtcccaggccgtggggacggttccccgtgagaccttctcctggtgaagcgtctggattcattccttaacaattaactagtggactatgaccgacggttcgggtcccgccgacgggcctaccggacggacgaacgggtcgtagggagggttgggttggacgttaggtttggttggtacggtttagttagggaagttacggggaaaagtttaaagttaacggaaatttaaccgttagtcgaaccgtaacggtaaaccgtaaccgggttaaggggtaaaccggggtccctaacgtttccaacccgttacttacccgttaacccgaaggaaccgtaaacctaaccgtttaaccgaaaacggttaacctttaccggtttttacgttaccctaacggaactaaacgtcggtaaaccacggttaccgaggtaaccggacggtacccggaacgtaaccggacgggtactaaagttacttaacgttccgtagggtaccggacgaaacggaacggtccggtaagggtaccgggtaacccctacccccgggtaaccccggtgtaacccggg

SEQ ID NO: 39696 - DNA, 582 bp, Homo sapiens
  misc_feature: GYAE6OF01BY7UN.35.67.G01.1.454.CMB.1.raw
  modified_base (186)..(186): a, c, t, g, unknown or other
  misc_feature (186)..(186): n is a, c, g, or t
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
  modified_base (575)..(575): a, c, t, g, unknown or other
  misc_feature (575)..(575): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcggtggtttcgcgtagctactttaagaggtgtcagtgtnagtgcagntggtgagcggtggggngngtggccagcgtgggacggtccagatacntcgtgagagtcgtntggattcngtcttagaatactnaggcatcgatcgtggccacncggcncgagggcaacgggcgtagggtcgtggttaggntaggttnttggaggttnagttgaagggtaaataggtaccgagttataggcaacgaacgcttaccggaagggtaacggccgtactacgacctcgtacgaccgatacgaacttaataccgaagtacgttacttgttaccagtacaagttanacacgcgtagacgnggtaccgacgtacgaacgtcgaagttacagttcgtagacgagtacggtaagcggtaacggtacgtagacccccgttagngtaccgg

SEQ ID NO: 39697 - DNA, 660 bp, Homo sapiens
  misc_feature: GYAE6OF01D5TCY.35.67.G01.1.454.CMB.1.raw
  modified_base (515)..(515): a, c, t, g, unknown or other
  misc_feature (515)..(515): n is a, c, g, or t
  modified_base (559)..(559): a, c, t, g, unknown or other
  misc_feature (559)..(559): n is a, c, g, or t
  modified_base (572)..(572): a, c, t, g, unknown or other
  misc_feature (572)..(572): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgtcttcgttttaaggaggtgtccagtgtcgaggtgcagcgtggtggagtcggtggggaggcgtggtccagccgtgggacgtccctgacgactcgtcctgtagaagtcgtcgtgtattcattccttacaattactagtcgactagtcgccgtaccggtcggggtaccccgaccgagggtcccttaccggacgggtacggtaaacggggtccgttggggtacggttgggttggaccgttaggtttggtaggttaggtatagggtaagttacggtaaagttaagtaacgtattaacgtagcgtacgaacgtacgaccgggtaaggaaccggtactacttaccgactacgtaccncgaagtacgtaaccaacgttaccaagtccttacgttcgtacganaataacgcgaacncgagtacgagcgacgacgacacggtagtatatacgtctaggacgagaggacgcgggtacgtcggaacccgtccccgaacggtgtacgg

SEQ ID NO: 39698 - DNA, 658 bp, Homo sapiens
  misc_feature: GYAE6OF01A3GAH.35.67.G01.1.454.CMB.1.raw
  modified_base (404)..(404): a, c, t, g, unknown or other
  misc_feature (404)..(404): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccgaggcaaagggctggagtggttgcagttgtgtggtatgatggaagtaatagatactatgacagacaccgtagaacgggccaattcacatcctcagacgacaacttcccaaagtaactacgtttacgtccctagacctaaagtcgaaacagtcctaggacgagcccgaaaggtacacgggactaatagtacttacgngtacgacgagaacgacggagtacggggacgaccgtaccccggaagtcggagtaccgacggtacgggacccgacgggtcccaccggtcgggtccgacccgttcttccgtctaccgtccgtacccgaacccgaccgggtcccacgttcccggtccccgttacccccgttcggtacccctaccccgttccctaacccgaacggtaccgtacccgtcccggtaccggtaccggggccaccggtaccggtaccccgggg

SEQ ID NO: 39699 - DNA, 900 bp, Homo sapiens
  misc_feature: GYAE6OF01DWEUH.35.67.G01.1.454.CMB.1.raw
  modified_base (177)..(177): a, c, t, g, unknown or other
  misc_feature (177)..(177): n is a, c, g, or t
tcagtacagatcgtcacgaccggtgctcgatttagagtatacatattgggttttcctcgttgctcttttaagaggtgtccagtgtcaggtgcagctggtggagtcgtgggggaggcgtgtccagccgtgggacggtccctgagtactctcctgtgaagcgtctggtattcatcttanaataactatggcatgacacgtcgggtccccgaggcctaccgaggacgaaggggtctgggagtgggttgactaggttgtgtgtagtgagtaggtaaataatagatacgtatgacacgtaaccgacggtaggaaaccgggctaacttaccgaacctacgttaccgtaaccgaaggaacgaaaccgttaacttaacccgtaaaacgtaacctttacgtttacgtttaccgaagaactaaaggtacaaaccgtaggaccgttaggaacggtaccggacgggaaacggtaaccggaacgggtactaaattaacggtttaatttaccgggtggtacggaaccggttaaggaaccggtacggtaacgggtacccgggaacccggttcccccggtaaacccgggtataccggaaccgggtaaccggtccgggtaccggggtaaccccgaggggttacccctaccgggtccgggttccctaacccgttacccgttaccgttacccggacccgttacccccggtaaccccgaacgggttaaccccgggtccccctttaaccgggtccccgttttaacccccgggtccccccggaaacccggtttacccccgtaaaccccccgttaccgtaaaacccggaccccgggtttaacccgaccccccggtttaacgggtttccccgggggaaacccggggtaacccccggtaccggtccccgggggtacccccggggg

SEQ ID NO: 39700 - DNA, 260 bp, Homo sapiens
  misc_feature: GYAE6OF01DXTIK.35.67.G01.1.454.CMB.1.raw
  modified_base (249)..(260): a, c, t, g, unknown or other
  misc_feature (249)..(260): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggcccaaccccactgtcactctcgttcccgccctcctcacgatctgtactgagcggctggacaaggcgcatagnnnnnnnnnnnn

SEQ ID NO: 39701 - DNA, 608 bp, Homo sapiens
  misc_feature: GYAE6OF01BPFWE.35.67.G01.1.454.CMB.1.raw
  modified_base (261)..(261): a, c, t, g, unknown or other
  misc_feature (261)..(261): n is a, c, g, or t
  modified_base (356)..(356): a, c, t, g, unknown or other
  misc_feature (356)..(356): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctgggtggagtcgtgggggaggcgtggtccagccgtgggaggtccctgagctctctgtgagcgtntggattcattcttacaaattaactatggcatgcacgtcgggtccgcgaggcctccgaggacgaagggactgggaggttgggttggctaggttggnggttggtagtggagttgggaatactaataaaggactagtcgcgacgacgtcggtaggaacgggtcctattccactacgttcctacgagtaacaactaacttaccaaaggaaccacgtccgttagttaactcgtagaactaaatcgaaacgtcgcctaggacaccggaccgacgaccgtaggtcgttagtcgttaacgttacgtgggttacggaacgaacgtaaaccgtagggtaaagaggtagtacggtaac

SEQ ID NO: 39702 - DNA, 866 bp, Homo sapiens
  misc_feature: GYAE6OF01CCFFQ.35.67.G01.1.454.CMB.1.raw
  modified_base (177)..(177): a, c, t, g, unknown or other
  misc_feature (177)..(177): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagnggtgtccagtgtcaggtgcagcgtggtggagtcgtgggggaggcgtgggtcccaggtccgtggggacggtccctggacgtaccttccgtccgtggtggaagtccggttcgtagggtactttccgaattccgtttaaccaaagttaaccttagtgggactaacgtgaccgtaccggttcggggtaccccgaccgaacggcctaccggaagggtaccgaaaggggtaccgtgggtaacggttcggggttcgggtacgtagggttttggtaggttagggtaatggtaagtagggtaaaagttaaagtaagtaagttaccgttagtcggtacgaacggtacgaaccggtagggaaccgggtaccgttactaccgaaccctactacctaccgaacggaactaaccgtaaaccttacccgaaacgttaacccgtttaaccgttttcgttaaccccgtaaggtaacctaaacggttacgaaaacccgtacgggttacccgtaagggtaaccgggtaacggacccgggggtaaaccgtaaaccgggtaacccgggtaaaggttaaacgtttaaagtttaaacccgtttacggtttacggggtaaccgggtaaacccggtaaaggggtaaaccggacgggtaaacggggtttacccggggaaccccgggttaacccccccgggttaaacccccggggg

SEQ ID NO: 39703 - DNA, 786 bp, Homo sapiens
  misc_feature: GYAE6OF01D82JD.35.67.G01.1.454.CMB.1.raw
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagcgtggtggagtcgtgggggaggtcgtggtccagccgtgggacgtccctgagacctctcgtgtgagcgtctggattcatctataataactagtcgctagtcgctacgtcgggtcccgaccgacggcctccggacggacgtaagggcgtagggtagtgggttcggcgtaggttgtggtaggtagtgtagtaggaaagttaagtaagtataacgtagtacgacgaagacgtaccggtagggaacggtccctacgttacccgactacgttacccgtaacgaacgaacgtaaaccttaaacgttaacccgtaaaacgtaaccgttttaccgtttttaccgttacccgttaacggtaaacctaaaggtaaccgtaaaccgtaccggtaaccccgttaaggggaaaccgaccgggtaacccgggaacggggtaacccggtaaccgggtaaacccgtttaagttaaaaccgtttacccggtttaaaacgggttcgggttaaaccggtaacccgggaaaaggggtaaccggtacgggttacgggttaacccggggaaccccgttacccccccgggttaaccggtaacggtaccgggg

SEQ ID NO: 39704 - DNA, 598 bp, Homo sapiens
  misc_feature: GYAE6OF01A6LWV.35.67.G01.1.454.CMB.1.raw
  modified_base (236)..(236): a, c, t, g, unknown or other
  misc_feature (236)..(236): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttgcagttgngtggtatgatggaagtaatagatactatgcagacaccgtgaacggccgattcaccatctccagagacaattccaagactactttgtcctgacaaatgaacagcctgagacgcgaggacacgacgatatatagtgtcgacgagaagcgtagtagggacgaccgtaaccccggatacggacgcgacgtcggggacccgacgggaccgtaccgtcggtccgaccgttccgttccgttacaccgtaccctacccgaaccgaaccgggtccctacgttcccgttcccgttccccgtccgggaccctacccccgtccctaccgaacgaccgaccctacccgcggtacgggaccacgtaccggcccggg

SEQ ID NO: 39705 - DNA, 732 bp, Homo sapiens
  misc_feature: GYAE6OF01EQEKL.35.67.G01.1.454.CMB.1.raw
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctggtggagtcgtggggggaggcgtggtccaggccgtggggacgtccctagacgtacctctcctgtacacgtctcgtggtattcagtctaagtcgaccgtcctggactggaaccgtcgggtacccgccgaggcctaccggacggcccggaggggtctgggtaggttcgggttacggtaccgttaaattaaaaacccgaggtccggtagggtaggggtacggaacaaacgaggaccgtacgtcgtacgggaacccggtaaggaaacggtcgtaacggttaccaaccgtatacgtaacgaaaggagtagttacgtaagttaaccgaaacgtaaaccgttccctttaataccgtacgtaactaaagtacgaacgtacgaaccgtaacggaaaaccgacggaaccacgtaacgttacctttaattacgttacctaaccccttaccgtaacgtactaacttacgtacgtaacttaacggtacggttacgggtaccgttacggtccggggtaacgaagggtacctccggtcgtaacccg

SEQ ID NO: 39706 - DNA, 644 bp, Homo sapiens
  misc_feature: GYAE6OF01CB5S1.35.67.G01.1.454.CMB.1.raw
  modified_base (500)..(500): a, c, t, g, unknown or other
  misc_feature (500)..(500): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctgggtggagtcgtgggggaggcgtggtccagccgtggggagtccctgagctctcctgtgagcgtctggattcattccttacaaacttactagtggactagtcgctacgtcgggggtcccgccgagggcctccgaagggccgaaggggccgttggggaggttcgggttacggcttaggtttggtgttggtagtagaggtaggaaagttaactagaatctagtgacagacgacggtaggacggcctatccaaccactactaccgagaacgactaactaccaagtaacctacttttcacttanacgtaagtacgaacgacgtaccgtagacggaacgaccggacggaaccgacggtataagttaagttacgttacgtaggtacggacggtaaggaacggacggtaggtaccggggaacctacccccggtacccgggaaggtaccggg

SEQ ID NO: 39707 - DNA, 260 bp, Homo sapiens
  misc_feature: GYAE6OF01DED87.35.67.G01.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (240)..(250): a, c, t, g, unknown or other
  misc_feature (240)..(250): n is a, c, g, or t
  modified_base (253)..(260): a, c, t, g, unknown or other
  misc_feature (253)..(260): n is a, c, g, or t
tcagtacagatcgtcacgaccggtgctcgatttagagtatacatagttggggtttggggggtttggtggtctccactcccgccttgacgaggctgattattattgttgctcatatgcaggtagtagcactaatgtcttcggaactggaccaaggtcacgtcagtcagcccaaggccaacccatgtcactctgttcccacctctcacgatctgtacngagcgggntggcaaggcgcatagnnnnnnnnnnnccnnnnnnnn

SEQ ID NO: 39708 - DNA, 727 bp, Homo sapiens
  misc_feature: GYAE6OF01CEAV2.35.67.G01.1.454.CMB.1.raw
  modified_base (227)..(227): a, c, t, g, unknown or other
  misc_feature (227)..(227): n is a, c, g, or t
tcagtacagatcgtcacgaccggtgctcgatttagagtatacatattgggtttgggtctgggagaggagcccagcactagaagtcggcggtgtttccatccggtgatcagcatgaacacagaggactcacatggagtttgggctgagcgttcgggtttttcctcgttgcttacttttaagaggttgtccagtgtcgaggtgcagtcgtggtggtagtcggtgggggngcggtggtccaggccgtgggacgtccgtggacgtctcctccgtgtaggagtcgtcgtggtattctattcttacaaattaactagtcggactatcggacgtacggtccgggtacccgaccgacggtcctaccggaggtaccggaagggtcggtacgggtaggttgggttggacgttagggttgttaggttcggtagtggtagtagggtaaataagtaagtattacgtgtacggatacggacgtaccggtaggacggtaccgtactacgtacctaacgtccgacgaacgtaacgtaactaaccgttaaccgaaacgttaacctttaacgtttacgttacctacgtaaacgtaagtaaccgaacgttacgacgtacggaaggaccggaaccgagggtaccacgggtaccttaagttaacgttacgttaagggttcgtacggaacgggaaccggtaaggaccgggttaagggaccccgggtacccggtccccggtaaccccggg

SEQ ID NO: 39709 - DNA, 831 bp, Homo sapiens
  misc_feature: GYAE6OF01DECQ2.35.67.G01.1.454.CMB.1.raw
tcagtacagatcgtcacgaccggtgctcgatttagagtatacatattgggtttgggggggagaggagcccagcactagaagtcggcggtgttccatccggtgatcagcactgaacacagaggactcaccatggagtttgggctgagcttggtttcctcgttgctcttttaagaggtgtccagtgtcaggtgcagcgtgggtggagtcggtgggggaggcgtggtccgagccgtggggacggtccctgacgtacgtctccgtgtacgaaggtccgtcgtggtattccattacttacaaattactagtggactagtgaccgtacgtcgggtccgacacggtcctaccgaggtacgaacggggtactagggtaggtcgggtttacggagttacggttggttggtggttaagtggtaagttaaggggtaaaagttaaagttaaggaacttaccgtagtacggaacgtaagggtaacccgtaaccggggttagggaaacccgggtacccgttaacgttaccccgtaacccgtaacctaccccgtaaccgtaaacgaaccgtaaacccgtaacgtttaacccgaaaacggttaaacctttaccggtttttaccgttaccgtaacggtaaccgtaaacgtaacgtaaaccggtaccgtaaccgtagggaaaccgtaccggaacccgggtaccgggtaaaccggtaacccgggtaaccgtaaacgtttactaaacggtttaaaccgtagggttaacgggaaacggtaacgggaacggtacgggtaacgggtaacggggtaccccgtaaccccggtaacccccgggtaagtaacccgggg

SEQ ID NO: 39710 - DNA, 760 bp, Homo sapiens
  misc_feature: GYAE6OF01APIDO.35.67.G01.1.454.CMB.1.raw
  modified_base (189)..(189): a, c, t, g, unknown or other
  misc_feature (189)..(189): n is a, c, g, or t
  modified_base (232)..(232): a, c, t, g, unknown or other
  misc_feature (232)..(232): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacgagggtcctggcacagtctgccctgactcagtcctgcctcgtgtcgtggttccnggacagtcgactccacctatcctccgtgctaccgtaggaaccngcaggcgtaggttcgggttggggttactcgtaccgttcgtccttccgtaggttactacgaacacgtccaccgacggaccaaaccgacccctaaacttacttaagttacgaacggactaacgtacgacctaccgtacgtagggttaacttacgtaacgttccgtccgttacgtcgtcggtaccttaccgaacggttccgtacggacctaacccggtccgtacccttcccgacgtaccttaaccgttccgttccggtcgggtccggtccgggacgtacggggacggtacggtacgtaccgttaagtacgttttaagtttcgttcgttcggtacctagtactacgtacggtaagtacggttacgtacgtactaacggttcgttaccggttacggttaaccggtaacggtaccgggtaccgtaaaccggtacccgttaccgtacggttaacccgtccgggtaacccgtaaccccggtaacccggtacccgtaaccccgttaccgtaccgttcccgtacccgtttacccccgg

SEQ ID NO: 39711 - DNA, 682 bp, Homo sapiens
  misc_feature: GYAE6OF01AMP5A.35.67.G01.1.454.CMB.1.raw
  modified_base (525)..(525): a, c, t, g, unknown or other
  misc_feature (525)..(525): n is a, c, g, or t
  modified_base (533)..(533): a, c, t, g, unknown or other
  misc_feature (533)..(533): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctcgtgtctgggtctcctggacagtcgatcaccatcctctgcacgtggaaccagcagcgtagttggttggggttatgtacctttgtcctcgttggtactcaacagccacccgaggaccaaaccgacccccaaattactttaaagtttaagaacggaactaactaacggcctaacccgtacgaagggttactttactaacgttccgtcttacctcgtcggtacctacctaacgtctacggacctaaccgtcggtacccctccgtacaacctaacttcctcgtcgggtccgtaccgggcgtaggaacgggacgtacggtccttagtaagtttagtttaacgttggttacgaccttntaaagttntacgggtacgttaagggtaccgtaagtacctaaattacgttggttaccggtacggaacggttccgggaaacgtacgtacccgaccggttcgtaccgggaccaccggaaccccgtaaccggtaaccccaacctcgtacctccgtaacccg

SEQ ID NO: 39712 - DNA, 924 bp, Homo sapiens
  misc_feature: GYAE6OF01BOYQG.35.67.G01.1.454.CMB.1.raw
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (199)..(199): a, c, t, g, unknown or other
  misc_feature (199)..(199): n is a, c, g, or t
tcagtacagatcgtcacgaccggtgctcgatttagagtatacatattggggtttggggggggagaggagcccagcactagaagtcggcggtgtttccatccggtgatcagcactgaacacagaggactcaccatggagtttgggctgagcttgggttttcctcgttgtcttcttttaagnggtntccagtgtcgaggtncagcgtgggtggtaggtcggtggggggaggtcggtggtccaggtcccggtggggacggtcccctaggacgtaccttcctccgttaggtaggaacggtccgttgtaggtacttcctaattccttaactaaaagttaaccgttagtcggtactaacgttcggtaccgtacggttccgggggtaccccgcccggtaacgggccccgttacccggaagggtaccggtaaacgggggaccgttaggggtacggtttagggggtttcggtacgtttagggtttgggttagggttacggttaagttacggtaaagggttaacgggtaaaagtttaaagtaaggttaacttaacgttacgacggtacgtaaaccggtaacggtaacccggggtaagggtaaaccggtacccggttaacgttaaccccaaccgttaacccgttacccgtaaaccggaagaaacccgttaaacgtaaaccttaccggtaaaacgttaaccgtttaccgtttttaacgtaccttaaccggaaactaaacggtaccgtaaacgtaccggtaccgtaacgggaacgaacccggtacgggaaacgggtacggaaacccgggttaggttaaacttaaacggtttaacgttacggtaagggtcggtaaaccggaaagggttaacggtaccggggtacggtaacccgggggtaacccctaaccccggggtaaaccccggtggtaaacccggg

SEQ ID NO: 39713 - DNA, 735 bp, Homo sapiens
  misc_feature: GYAE6OF01B9L0J.35.67.G01.1.454.CMB.1.raw
  modified_base (159)..(159): a, c, t, g, unknown or other
  misc_feature (159)..(159): n is a, c, g, or t
  modified_base (178)..(178): a, c, t, g, unknown or other
  misc_feature (178)..(178): n is a, c, g, or t
  modified_base (369)..(369): a, c, t, g, unknown or other
  misc_feature (369)..(369): n is a, c, g, or t
tcagtacagatcgtcacgaccggtgctcgatttagagtatacatattgggtttgggggggagaggagcccagcactagaagtcggcggtgtttccattcggtgatcagcaactgaacacagaggactcaccatggagtttgggctgagctgggttttcncgttgctctttaagaggtntccagtgtcaggtgcagcgtgggggatcgtgggggagcgtggtccagccgtggggacggtccctgagtacctctcctgtcgcagcgtgtggtacttccacgttcagttagttagtgcatgctacgtgggtccgcgagcctaccgaggcgaaggggtctagggaggtggggtgctaaggttatagtaggttntaggtagtacgggtaagtactaaagtaaacggacttaggtcgaacgtaaggtacccgttaccgggtaagggaaccggggtacccgtaacgtttacccgaacccgtaacggttaccctaacccggaacggtaaacgtaaacgtaaacccgtttaaccgaaaacggtaaacgtaccgtacgtttaggtaaccgtcgttaacggaactaaagtaccgaaacgtcggtacctacggaacggtaccgaccggaaccggtaacgtaccgggtactttgggaagtttaccttaacggttcggttaaccggaccggtaaacggtaaccgtaaacgggttaaggaaggtaacggtcggtaaacgtttaaaccggg

SEQ ID NO: 39714 - DNA, 600 bp, Homo sapiens
  misc_feature: GYAE6OF01CPBQU.35.67.G01.1.454.CMB.1.raw
  modified_base (316)..(316): a, c, t, g, unknown or other
  misc_feature (316)..(316): n is a, c, g, or t
  modified_base (382)..(382): a, c, t, g, unknown or other
  misc_feature (382)..(382): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctgagcttgggttttcctcgttgctcttttaagaggtgtccagtgtcaggtgcagctggtggagtcgtgggggagcgtggtccagccgtgggacggtccctgagactctccgtggtgaagtcgtcgtggtattcatcttacaaattaactagtggcatcgcacgtcgggtccnccgaggcctccgaaggccgaagggactgggaggtggtggctaggttgtgtgtagtgagtggaatanagatactatgcagacacgtgaacggcatcgactactctccagaagcaatccaaagtactactttcgtcagactaaagtacgaacgtacgaccgtagacggtacgacccggaagggaaccgaaccggtacgtaaacttagttaacgtttacgtaggtaggaacgaaggtaacgacggtacggtaccggggaccgtaacccccgtacccgggataccggg

SEQ ID NO: 39715 - DNA, 639 bp, Homo sapiens
  misc_feature: GYAE6OF01CBAR8.35.67.G01.1.454.CMB.1.raw
  modified_base (193)..(193): a, c, t, g, unknown or other
  misc_feature (193)..(193): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtncagctggtggagtcgtgggggagcgtggtccagccgtgggacggtccctgacgactctcctgtgagcgtntggattcatctcaatactangacatgcnctcgggtccncaggcctcgaggcgaagggctggagttggtgctaggttgtggtgtagtgagtaggaataagtagaatacgtagtcgacaacggtaccgaccggttaggaaacgggtcctaagttcaccctagttcctaccgagtaacgaaccaattaccgaaagtaacccgtacttttagtcccttaagaacctaaagtcgaaacctacgtccgtaggaacggacggtaccggaacggacctaccggggtataacgttaaagtaacgttaccgtgggtaacgtacgggaagtaaggacccgtaagggtaccgggaacggttcccccggttaaccccgggagtaccggg

SEQ ID NO: 39716 - DNA, 735 bp, Homo sapiens
  misc_feature: GYAE6OF01BH3R3.35.67.G01.1.454.CMB.1.raw
  modified_base (185)..(185): a, c, t, g, unknown or other
  misc_feature (185)..(185): n is a, c, g, or t
tcagtacagatcgtcacgaccggtgctcgatttagagtatacatattgggtttggggggagaggagcccagcactagaagtcggcggtgtttccatccggtgatcagcactgaacacagagactcacatggagtttgggctgagtcgttgggttttccctcggttgtccttacgtttttaaaggnggttcgttccgagtgtcgaggtgcagtcgtggtggagtcggtgggggaggcgtcggtccagccgtgggacggtccctggacgtacttcgtccgtggtacgaagtcgtcgtaggtacttactaacttcttacaaattaacctagtggactagtcgacctacggttcgggtcccgaccgtacggcctaccggaagggtaccgaaagggtccgttgggaggttagggttcggactttagggtttggtggttaaggtacgtagggtaagtaggtaaagttagtaacgtaattacgatgaacaacgtcgtacggtaaggacggtacctattaccgacgtactcgaaccgaagtaacgtactaactacgaaatacttacgtttcgtaacctagaaccgtaaattcgaaaccgtacggtccgtaagacggtaaccggtaccggaacggtaccgaacggtaacgttacgttaagttaccggttacgtgggtaacggacgtaaggaacggtacggtaacggtaccggaacccgttaaccccgtaccgggtagtaaccgg

SEQ ID NO: 39717 - DNA, 584 bp, Homo sapiens
  misc_feature: GYAE6OF01C2EBY.35.67.G01.1.454.CMB.1.raw
  modified_base (199)..(199): a, c, t, g, unknown or other
  misc_feature (199)..(199): n is a, c, g, or t
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (570)..(570): a, c, t, g, unknown or other
  misc_feature (570)..(570): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttacaataactatggcatgcactgggtccnccaggcctccgaggcaagggactgggagttggttggctaggttgtggtggtatgataggaagtaatagatactatgacagacacgtggaacggcatcacatctcagacacatacaagactcttgtccagacaaatcgaacncgcctaggacgacgaccgaggaccacggctatatattacgngtacgngagaagcgagngggacacccgtacccggagtacgacgcgtacggtcgggaccgaggccctaccggtcgggtccgtccgttcgttcctacgacgtccctaccgacgaccggcctacgttcccggtccctccccgtgcccctacccgtccctaccgacgtcgaccgtaccgtcggacgggacccncggcggtccccggg

SEQ ID NO: 39718 - DNA, 631 bp, Homo sapiens
  misc_feature: GYAE6OF01B991G.35.67.G01.1.454.CMB.1.raw
  modified_base (160)..(160): a, c, t, g, unknown or other
  misc_feature (160)..(160): n is a, c, g, or t
  modified_base (199)..(199): a, c, t, g, unknown or other
  misc_feature (199)..(199): n is a, c, g, or t
  modified_base (315)..(315): a, c, t, g, unknown or other
  misc_feature (315)..(315): n is a, c, g, or t
  modified_base (369)..(369): a, c, t, g, unknown or other
  misc_feature (369)..(369): n is a, c, g, or t
  modified_base (443)..(443): a, c, t, g, unknown or other
  misc_feature (443)..(443): n is a, c, g, or t
  modified_base (537)..(537): a, c, t, g, unknown or other
  misc_feature (537)..(537): n is a, c, g, or t
tcagtacagatcgtcacgaccggtgctcgatttagagtatacatagttgggtttgggggggagaggagcccagcactagaagtcggcggtgtttccatccggtgatcagcactgaacacagagactcaccatggagtttgggctgagcttgggttttccncgttgcttcgttttaagaggtgtaccagtcgtcaggtcncgagcgtggtggagtcggtgggggagcgtcggtccaggcgtgggacgtcccgagacgactctctggagagcgtgtggattcgatctacaatactagtgacatgacacgtgggtccncacggctaccaggacgaagggacgtggtagtggtacgctaggttgtggtgtagngagtacggtaaataagtagattaacgtagtacgacgaagacctacggtagaacggtccgtattaccgacctacnccgtacgaagaacgtactaacgttaccgaaacgtaacccttagtttaccgtacccgagtaaacctaagtacgaacgttcgaccgtagaaccggngaccgtagaccgaggtacaattacgtaagtcgtggtacggcggtaacgtaggccgtaaggccgggacccgtacccctaacccgggtgtaaccgg

SEQ ID NO: 39719 - DNA, 656 bp, Homo sapiens
  misc_feature: GYAE6OF01CN826.35.67.G01.1.454.CMB.1.raw
  modified_base (313)..(313): a, c, t, g, unknown or other
  misc_feature (313)..(313): n is a, c, g, or t
  modified_base (613)..(613): a, c, t, g, unknown or other
  misc_feature (613)..(613): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctgggtggagtcgtgggggagcgtggtccagccgtgggaggtccctggacgtactcgtccgtgtcgaagccgtctggattcatcttcagtagttatggcatgcacttggggtccnccgaggcctccgaggtaccgaaagggggcctagggagtggggtggctaaggtttatagtggtaactggtattacgggaaagtcaagtaaaagactatcggacaaggtacctccggttaggaaacgggtcccgaagtttaccaacccgtatttacccgacccgaaggtaacgaacctaaactttacccgaaaagtaaccgacggtacttacggttaactactcggactaaaaagtcgaaactacgacccgtaggaacggacgacccgacgaacgacggtccttaggtacgttactttacgnggttacggacggtaagaaaccgtacggttaaggaagttaacgg

SEQ ID NO: 39720 - DNA, 616 bp, Homo sapiens
  misc_feature: GYAE6OF01ADUBW.35.67.G01.1.454.CMB.1.raw
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
  modified_base (433)..(433): a, c, t, g, unknown or other
  misc_feature (433)..(433): n is a, c, g, or t
  modified_base (480)..(480): a, c, t, g, unknown or other
  misc_feature (480)..(480): n is a, c, g, or t
  modified_base (555)..(555): a, c, t, g, unknown or other
  misc_feature (555)..(555): n is a, c, g, or t
  modified_base (610)..(610): a, c, t, g, unknown or other
  misc_feature (610)..(610): n is a, c, g, or t
tcagtacagatcgtcacgaccggtgctcgatttagagtatacatattggggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtgcaggtctgggtggaggtcggtggggggaggcgtggtccaggccgtggggacggtccctgacgactctcctggtgagcgtctggattcattcttacaattactgtcgnatgcacgtgggtcccncgaggcctcgaggcgaagggtngggtagtgggttggcttggttggtggtggtatgtagtaggaattacgagtactatatggacagacgtacggtagggacggtcctataccactntccgacagtacgaacacttaccgaacgtaacttctttacgttaccanaaccgtaagtcgaaactcggacctagggacgtacgacggacgacccgacggtactaagttaacgtatttaccggngtacggaccggaaggacggacggtacgggtacggacccgtaccccgggtaccggngtacgg

SEQ ID NO: 39721 - DNA, 700 bp, Homo sapiens
  misc_feature: GYAE6OF01BA0ST.35.67.G01.1.454.CMB.1.raw
  modified_base (287)..(287): a, c, t, g, unknown or other
  misc_feature (287)..(287): n is a, c, g, or t
  modified_base (486)..(486): a, c, t, g, unknown or other
  misc_feature (486)..(486): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagcgtggttttctcgtgctctttaaagttgtcagtgtgagtgcactggtggaggtcgggcggaggtcttacggttaagccgagggacgggtaccctaaagtcctcctcctgtcgctagttttcgtggtactttccctttanaattcgtccgccgtggactgaaccgtgggtcccgcgacggcctaccggaggggaagggtacgtgggtaggttcgggttccgacccgtataaaggttaaaaaggagtaagttcggagtacggggacggtaacaacgaacgtacctaacgtccttcccgtacccgttcgagggactaacgtacgttccgtacccgttaccncgtaagacgtatcgtacctttaccagttacgtagttctaccgttgtacccttaacaaactaagtacgaaacctcggacctacgaaaccgtaaccggacgaaccacgtacgtaccttacgttaatacctacgtaccactcgtaccacctacgcgtgaccctacgttacgaccggaacttacggttaccggtacgggggaccgtcgtccggttccg

SEQ ID NO: 39722 - DNA, 742 bp, Homo sapiens
  misc_feature: GYAE6OF01EAW43.35.67.G01.1.454.CMB.1.raw
  modified_base (180)..(180): a, c, t, g, unknown or other
  misc_feature (180)..(180): n is a, c, g, or t
  modified_base (332)..(332): a, c, t, g, unknown or other
  misc_feature (332)..(332): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcgttgggttttcctcgttgcttcttttaagnggtgtccagtgtcgaggtgcagtctgggtggagtcgtgggggaggcgtggtccaggtccgtggggacgtccctgacgacctctcgtggtacggaagcgttcgtggactttcattcttacaaataatagtggctatcgactacgtcgggcccnccgaggcctcgacgggacaacggggctgggagttcgggtggacgtaggttgtgggttagtagtggaaggtaggtaaaagttaattaggtacttaacgttaagtcggaaccaggaacccgtacggtacgggaaccgggaccggtacttacccgaccctaactccgtaccgaaaggactaaaccgtaaacttaacccgaaagtaaccttccgtttttacgtaccgttagaaccttaaacgcgaacgtacggaacctaggtaaaccgggacgacccgggtaaacgggaccgtaaaccgggtaacgttaaaccgtaagtttaacgttacgggttacggtacgggtaacggtaaacggtaacggaccggggttaaggtacccggggaacccgttaccccccgggtaaaccccggg

SEQ ID NO: 39723 - DNA, 840 bp, Homo sapiens
  misc_feature: GYAE6OF01C4CLJ.35.67.G01.1.454.CMB.1.raw
  modified_base (280)..(280): a, c, t, g, unknown or other
  misc_feature (280)..(280): n is a, c, g, or t
tcagtacagatcgtcacgaccggtgctcgatttagagtatacatattgggtttgggctcaactttcttgtccaccttggtgttgctgagcttgggtttttcctcgttgcttcttttaagaggtgtccagtgtcaggtgcagctggtggagtcgtgggggagcgtggtccagccgtggggacgtccctgagacctctccgtgtagagcgtctggtattccatcttcagtagtcacgtggactgacctacggtcggtcctagtaacgtcggaggggacgggntggtgtggttccagtactacgagtgagtcggactgaacaacgtaacgtccgtaacggccggtacgtcccggtaaggaaccgggtcctaccttaccccgaacccccgtacgaacgtaaccgaacccgaaacgaacccgaaaagaaaccccaactaacgtaacttactacgtacgaaacaaaacgtacgaaacgtacgttacgtagacggacgacccggtaacggaccgtacggtacttagttaccgttaaacgttacgttacggtacggaacgtaagggtaacggtacggtaccttaaacgttaacgttacgttagttttaggtttacgtaccgtttacggtacggggtaaccgggtaacggtaaaccgggtaacgttaaccggttaaccgggtacccgttaacccgttacccgtttaccgttaacccgtaccccggttacccccgtaaaccccggtaaaccccggtaaacccgggttacccccgttaacccggttttccccccgggttacccccgtttaccccccgggtaccgggttcccccgtccccggttaccccggg

SEQ ID NO: 39724 - DNA, 702 bp, Homo sapiens
  misc_feature: GYAE6OF01AG0R0.35.67.G01.1.454.CMB.1.raw
  modified_base (159)..(159): a, c, t, g, unknown or other
  misc_feature (159)..(159): n is a, c, g, or t
  modified_base (174)..(174): a, c, t, g, unknown or other
  misc_feature (174)..(174): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttccncgttgctctttaagnggtgtccagtgtcaggtgcagctggtggagtcgtgggggagcgtggtccaggccgtggggacgtccctgacgactctcctgtgaagcgtctggattcattcttacaattaactagtcggacagtcgactacgtcggggtcccaccgaggcctccgaggacgaaggggctgggagttgggttcggcgtaggtttcggtggtaggtatcggtagtagggtaaagttaataggattaacgtagtggaccaggtaccgacggtagggacggtaccgtacttacgacctatccgtaccaacggacgaacacttaccgaagtaaccttacgtttacgtacctagtaacctaaagtacgaaccgtacgtcccgtaggaaccgacggtacccggaaggacccggtacgggaccgtaaagttaacgttaacgttaccggttgggtaacggtaccgggaaacgggtaacggacggtaaacggggtaccgggggtaacccgtaccccccgggttaaacccccgggtagtaacccggggg

SEQ ID NO: 39725 - DNA, 663 bp, Homo sapiens
  misc_feature: GYAE6OF01CUPYF.35.67.G01.1.454.CMB.1.raw
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (559)..(559): a, c, t, g, unknown or other
  misc_feature (559)..(559): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggtagtttgggctgagtcgtttgggtttttcctcggtttgccttacgttttttaaaggaggttgtcccgtaaggttgtcgagggtgcaggtcgtgggtggagtcggtgggggacgcgttggtccagtccgtgggacgtccngacnctctcgtgagacgtcgtntagtnttcattctaacaataactgtcgctangaccncgtcgggccacggcgtccacgagggacggaacgggtcgtaggtacgggtggtcggagtgttggngttaggtagtaggngtaaggtaaagtaacgtagacttaagagtacgaccgtaacggacgtacggtaggacggtacctactaccgactactccagaacgataaccgtacttaaccgtaaacgttaccttacgtttacgtaccagtaaacgtaacgtcgtaaccncgttaacgacggagaccggacgagacgtaacgagtatagtagttcgagaccgtaagcggttaaggcggtaacggtcccggaacccggttcccgacggtgtacgg

SEQ ID NO: 39726 - DNA, 708 bp, Homo sapiens
  misc_feature: GYAE6OF01AWEGC.35.67.G01.1.454.CMB.1.raw
tcagtacagatcgtcacgaccggtgctcgatttagagtatacatattgggtttggggggggtcacaagaggcagcgctctcgggacgtctccaccatggcctgggctctgctgctcctcactctcctcactcaggacacaggtgacgcctccaggggtacggggtcttggggacctctggactgatccttggtctccgctcctcagctcgaccggggccagcactgactcagtggcagtcgttgtttcctccctctttccgagggtccgtgggcacgcgtctcgcctgactcacgcctcgcctcgtgtctcggtctccgtggacacgtcgactcacctactcctcctgcacgtacggtaacacggcgacgtacgtagttggtttacgggggttactcggtaccgtttgtccttcggtacgggtaactaccgaacgtacgaccccgtaaacccgtaacgggaaccctaaaaccccggaacccccctaaaacgttccgtaacgttacggttaaactttaacgtacggttaacttacggtaaccgtaaggttaccgttacccggtcccggtttaccgtaaggggttttacctaacgttccgtactttccgcgttcgtaccgttcccgaaggttccgtacggaccgtaaacccgttacccgggtaccccttaccccgtcgaaccccgtattcccgtccggttacggtccccg

SEQ ID NO: 39727 - DNA, 812 bp, Homo sapiens
  misc_feature: GYAE6OF01EWHVR.35.67.G01.1.454.CMB.1.raw
tcagtacagatcgtcacgaccggtgctcgatttagagtatacatattggggtttggggggggagaggagcccagcactagaagtcggcggtgtttccatccggtgatcagcactgaacacagaggactcaccagtggagtttgggctggagtcgttgggttttcctcgttgacttacgttttaaggaggttcgtccagttgtacgaggtgcgagtcgtgggtggacgtcgggtggggggacgtccgtaggtacaacggccgtagggacgacgtcccgtgaacgtcctctccgtgtacgtacgtcctgtcggtacttcctaccttacaattagttcgttaatacgactagttccggaccggttcgggtccccggaccgtacgggtccgttccggtaaggggggaacggggtccggtaggggtacggttcgggtacttacgtagtttacgttaggtagggtaacgtttggttagtttagttaactaacgtatttacgtaggtgggtaacggtcggggtaggggtacggggtaccttacgtaccgtacctacgtacctacggtagaaccgtaaccgaacggtaacgaaacggaaccggtactaacggtttaacttaccgtacgtaaactaacgtaacggaaccgtacgtccgtaacgggacgaacgggtaccggaacggtaccgtacggtacgttaggtaaccgttacgttacgggtacggtacggtacggaggtacgggtcggtaccgggtacggtacccgggtttcccggggttaaccccgtttaggtaccgggtccgggtcggtaccggggg

SEQ ID NO: 39728 - DNA, 759 bp, Homo sapiens
  misc_feature: GYAE6OF01DM33M.35.67.G01.1.454.CMB.1.raw
  modified_base (231)..(231): a, c, t, g, unknown or other
  misc_feature (231)..(231): n is a, c, g, or t
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggtagtttgggctgagtcgttcgggttttcctcgttgtcttacgttttaaagaggttgtccagtgtcgaggtgcagtcgtggtggaggtcggtgggggngcgtgtccgagccgtagggacgtccctgacgtctcctcgtgtacgacgtcgtgtgtattctatctacaaatactagtcgactntcgacgtcggttcgggccnccgaggccctcggaggacgaagggcgtagggagttgggttggacgtttaggttgtaggttaggttagaggtaggtaaggtaaacgttaataggtaacttagtatcgaacggaagtaccgtaccgggttagggaaccggtacctagttaccccaacgtacttacccgtaaccgaataaccgtaaccttaacctaaccggtaaaccgttaacccgttttcgttttaacccgtaccgtaacgttaaaccgtaaacgtaccggtaaaccgtcggtaccgtaagggaaccggaccggaaccggggtacgaaacccgagggtaaccttaagttacgtttaaccggttcgtaggtacgggaaaccggtaagccgggttaacgggacgggttaacccgggacccgttaacccccggtaacccggtgtacccggg

SEQ ID NO: 39729 - DNA, 276 bp, Homo sapiens
  misc_feature: GYAE6OF01CHHUJ.35.67.G01.1.454.CMB.1.raw
  modified_base (188)..(188): a, c, t, g, unknown or other
  misc_feature (188)..(188): n is a, c, g, or t
  modified_base (255)..(276): a, c, t, g, unknown or other
  misc_feature (255)..(276): n is a, c, g, or t
tcagtacagatcgtcacgaccggtgctcgatttagagtatacatattggggtttggggggtttggtggtctccactcccgccttgacgaggctgattattattgttgctcatatgcaggtagtagcactaatgtcttacggaactgggaccaaggtcaccgtctaggtcacgcccaaggcccaacccntgcactctcgttccccacctctcactatctgtacgtgacggcggtctggacgaaggcgtacaagtgnnnnnnnnnnnnnnnnnnnnnn

SEQ ID NO: 39730 - DNA, 863 bp, Homo sapiens
  misc_feature: GYAE6OF01CQVGS.35.67.G01.1.454.CMB.1.raw
  modified_base (360)..(360): a, c, t, g, unknown or other
  misc_feature (360)..(360): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagtcgttgggttttcctcgttgtcttcttttaaggaggttgtccagtgtcaggtgcaggcgtgggtggagtcgtgggggagcgtggtccaggccgtgggacgtccctagacgtacttcgtcctggtagaacggtcgtcgtaggtaacttcgacttacttaacaaaattaaccgtagtagggcctaagttccgacgtaaccggttcgggggacccncccggtaacggccctaccgaaggggaaccgtaacggggacgttagggtagggttcggggttcggtaacgttagggtttttgggtcggggtttaagggtaagtttaggggtaaaaccggttaaggggtaaaaaggtttaaaggtaacccgggttaactttaaagttacggaggtaacccggaaaacgggttaccccggtaaaccggggttagggaaccggggtacccttaaacgtttaccccgaaccgtacttacccgttaaccgaaacggtaaccggaaacctttaacgtaacccgaaaggttaaacctttaccttttaaccggtacgtaaccggtaaacttaaacgaccggtaaccgtaccgttaaccggtaagaaccgggaacgtaaccgggaaccggttaccggaagtaccgtaaattaccgttaacgttaggacggttacggtacggaaacggtacggacggtggacggtaacccgaccccgtaccggaggtaacccgg

SEQ ID NO: 39731 - DNA, 626 bp, Homo sapiens
  misc_feature: GYAE6OF01C8RDS.35.67.G01.1.454.CMB.1.raw
  modified_base (177)..(177): a, c, t, g, unknown or other
  misc_feature (177)..(177): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (403)..(403): a, c, t, g, unknown or other
  misc_feature (403)..(403): n is a, c, g, or t
  modified_base (532)..(532): a, c, t, g, unknown or other
  misc_feature (532)..(532): n is a, c, g, or t
  modified_base (578)..(578): a, c, t, g, unknown or other
  misc_feature (578)..(578): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagnggtgtccagtgtcaggtgcagctggtggagtcgtggggagcgtggtcccagcctgggaggtccctgagactctcctgtagaagcgtgtggattcatcttacaataactntggcatgcacgtggtcccncgacggacctccgaggcaagggtctggngtgggttgcgtagttgtgtggtatgtaagtggtaaagtaatacgattacgtagtgacaggactaaccggnggaacggcctattacccgacgtactaccgtaccagtacgaactaaccgttacccaaaggttaaaccttaccgttttagttacccttaacgaactaaaatacggaaactcggtaccgtagaaccgggtanaacccgggtaaggaaccgtacgggaataagtaccgtaaatttccgngttacgaacgagacgtaggagttacggggccgtacccgtaaccccggg

SEQ ID NO: 39732 - DNA, 730 bp, Homo sapiens
  misc_feature: GYAE6OF01CHKCI.35.67.G01.1.454.CMB.1.raw
  modified_base (187)..(187): a, c, t, g, unknown or other
  misc_feature (187)..(187): n is a, c, g, or t
  modified_base (210)..(210): a, c, t, g, unknown or other
  misc_feature (210)..(210): n is a, c, g, or t
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (413)..(413): a, c, t, g, unknown or other
  misc_feature (413)..(413): n is a, c, g, or t
  modified_base (436)..(436): a, c, t, g, unknown or other
  misc_feature (436)..(436): n is a, c, g, or t
  modified_base (474)..(474): a, c, t, g, unknown or other
  misc_feature (474)..(474): n is a, c, g, or t
  modified_base (648)..(648): a, c, t, g, unknown or other
  misc_feature (648)..(648): n is a, c, g, or t
  modified_base (660)..(660): a, c, t, g, unknown or other
  misc_feature (660)..(660): n is a, c, g, or t
  modified_base (722)..(722): a, c, t, g, unknown or other
  misc_feature (722)..(722): n is a, c, g, or t
tcagtacagatcgtcacgaccggtgctcgatttagagtatacatattggggtttgggggggagaggagcccagcactagaagtcggcggtgtttccatccggtgatcagcactgaacacagagactcaccatggtagtttgggctgagtcgttgggttttccctcgttgtccttacgttttaaaggnggttcgtccagttgtcgagggtncgaggtcgtgggtggacggtcgggtggggggacggtcggtcggtcccaggccggttggggaccggttcccnggacgtacctctccgtggtagacgtcggtntaggtattctattcttacaaattactagtggacngtcggactacggtcgggtccncgacggcctaccgaagggcggaaacgggtgtagggtggttgggtcgngttaggtttgtggtaggttaagnggtaaggtaaggtaaagtaaacgttggaattacgttanacggagtaaccgaacggtcgggaacggaacgggtacctacgttaccaccgacttacgaacgaacgtaagtaacctaacgttaacgaaatacccgtttactttccgtacctagaaaccgtaatcgaaacgtcgtaccgaggacgacggaacggcgtaaccgacgtataacgttanaacggtttacgnggaacggtaccggaaaggctacggggtaagggtcccggaacccgtaccccggtaacccgggntacccggg

SEQ ID NO: 39733 - DNA, 660 bp, Homo sapiens
  misc_feature: GYAE6OF01AV4CM.35.67.G01.1.454.CMB.1.raw
  modified_base (160)..(160): a, c, t, g, unknown or other
  misc_feature (160)..(160): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (631)..(631): a, c, t, g, unknown or other
  misc_feature (631)..(631): n is a, c, g, or t
  modified_base (652)..(652): a, c, t, g, unknown or other
  misc_feature (652)..(652): n is a, c, g, or t
tcagtacagatcgtcacgaccggtgctcgatttagagtatacatattgggttttcctcgttgctcttttaagaggtgtccagtgtcaggtgcagctggtggagtctggggggaggcttggcacagcctggggggtccctgagactctcctgtgcagcctntggattcagttttagcacctatggcatgagctggcctcccggccgggctaccgaggggaagggctgggagtcgggtctcaactatgatggtagtgctanaataacactagtggtacncagaccttaccggtaggaacgggtcccggttcaaccctagtacctaccgaagacgaacctaacttaccgaaggtaaccacgtactaacttactaccgtagacaaaagtcgaaactagccgtagaacgtacggaccggaagggaaccctacgggtacctttaagtaacgttacgtgtacggaaccgttaagttcggtaagtttcgggaggtcgttacgggtaaggaggtacggggattacgagactacgggtgggaccgtagggccgaccgtggtcccgaccgccctcctcgacgtccctaccgaccgacggaccctcgttcccgtccctccccgcgccctaccctccaccgacncgtcccaccgtggtcgggccncgtccggg

SEQ ID NO: 39734 - DNA, 671 bp, Homo sapiens
  misc_feature: GYAE6OF01ATDGB.35.67.G01.1.454.CMB.1.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (659)..(659): a, c, t, g, unknown or other
  misc_feature (659)..(659): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctggnggagtcgngggggagcgtggtccagccgtggggacgtcctggacgactcgtctggtagaacgcgtcgtaggtattcattcttacaaataactagtcggcatcgactacggtcgggtacccaccgaggtcctacgagggtaccgaaggggtctgggtaggttgggtggactaggttggtggttaggtagtaggaacgttaagggaaattaagtacggtaattacgttaagcgacgaacgtaaccgtacggtaagggaacgggtccgtaacgttccgaacctacgtaccgtacgaaaggtaacctaaaccgtaacgttacccgaaaagtaccgttaacttttacggtacctacgaaactaaagtacgaagtaccgaccgtaaggaacgacggacgaacgacgtacggaataagttacgtatacgtggacgtacgaagtacggcgaggtccgggacnccccgtaaccgg

SEQ ID NO: 39735 - DNA, 749 bp, Homo sapiens
  misc_feature: GYAE6OF01EGQFF.35.67.G01.1.454.CMB.1.raw
  modified_base (176)..(176): a, c, t, g, unknown or other
  misc_feature (176)..(176): n is a, c, g, or t
  modified_base (676)..(676): a, c, t, g, unknown or other
  misc_feature (676)..(676): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctctttaagngtgtccagtgtcaggtgcagctggtggagtcgtgggggagcgtggtccaggcctgggacgtccctgacgactctccgtgtagaagcgtcgtggacttccattcttacgaataactagtcggacaagttgactacgttcggggtcccgaccgaggtccctaccgagggaccaacggggtctgggagttcgggttaggctaggtttggtcggttaggtatggagtagggaaaacgttaagtagaacttactagtacgacgtaacggaaccgtaccgggtagggaaaccggggtcccgtaacgtttacccgaaccccgtaagttcccgtaaccgtaacggaaacggtaaccctaaacgttaccccgaaaagttaacccttacgtttttcggtacccgtagtaacccgtaaagtaccggtaacaccggttaccgtaggaacggaccggacccggtaagggaacccgtaaccgggacgttaaacttaacgttaagttaacccggngggttaaccggacgaaacggtaaccgtacgggtaacggtacggggtacccctacccccggttaaaccccgggg

SEQ ID NO: 39736 - DNA, 712 bp, Homo sapiens
  misc_feature: GYAE6OF01BF3QC.35.67.G01.1.454.CMB.1.raw
tcagtacagatcgtcacgaccggtgctcgatttagagtatacatattggggtttggggggggtcacaagaggcagcgctctcgggacgtctccaccatggcctgggctctgctgctcctcactctcctcactcaggacacgagggtcctgggcacagtctcgtcctgactcagcctgcctccgtgtcgtgggtctccgtggacagtcgactcaccatcctcctgcacgtacggaaccagcagcgtagttgggttaggggttatcgtaccgttgtacctccgtggtacacaacgacgaccaaccgacggaaccaacccgaccctaaactttacttaaattaacgtaaacggtaacctaacgtaacgaccgtaacccgtacgtacgggttactttactaacgtccgtactttcgtacgtcgtactacgtaacggttcgtacggtaccgtaccgtccggtaccctaccgtacgaacgtacgttccgtacggtccggggttcccgtccgggtacgtacgggaacgggtaacccgtgggttaccttaggtttaacgttttagttatttcgggtttacaccgttacttaatgttacgacgggttaagtacgttacgaacgtttaactaggttccgtacggttacgaacggtcggtaacctaggtccctacgtacggtacgccgtacccgaaccgtaccgacccaacgtcttgcctacc

SEQ ID NO: 39737 - DNA, 796 bp, Homo sapiens
  misc_feature: GYAE6OF01AULNG.35.67.G01.1.454.CMB.1.raw
tcagtacagatcgtcacgaccggtgctcgatttagagtatacatattggggtttggggggggtcacaagaggcagcgctctcgggacgtctccaccatggcctgggctctgctgctcctcactctcctcactcaggacacgaggggtcctgggcacagtctcgccctgactcacgcctgcctccgtgtcgtcggtcctccgtggactgtcgatcacctactcctcctgcacgtcgaaccagcaggcgtagttgggttaggggtatcgtaccttgtcctcgtaggtactacgacgacgccaaccgacgaaccaacccgtaccccctaaattaccttaaacttaagaaccgtacaaccgtaacgccgtaccgtagtacggttacttctaactccgtcttcgtcgtcgtcctaacgtacggtctacggacctaccggtcccgtcccgttacctgactactcggtacgtccggtccggtcgggtacgtacgggacggtacggtacggtacgttacgtttaagtttaacgtttacgtttacgttacggttaccttacgttaacgtaacgggttacgttaacgggttaacgggttaacgttacccgtaaacgtttaactttaaccggttaccgggttaaccggttaaacccggggtaaccggtaaccgggttaaaccccggtacggtacccgggttacccggtaaaccggttcccgggtaaacccggttaacccggaacccccggtaacccggtaaaccccccttaccccggttaacggttcccgtaacccgttaccccggg

SEQ ID NO: 39738 - DNA, 796 bp, Homo sapiens
  misc_feature: GYAE6OF01B6P4D.35.67.G01.1.454.CMB.1.raw
  modified_base (185)..(185): a, c, t, g, unknown or other
  misc_feature (185)..(185): n is a, c, g, or t
  modified_base (785)..(785): a, c, t, g, unknown or other
  misc_feature (785)..(785): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagtcttgggttttcctcgttgcttacgttttaagaggttntccagtgtcaggtgcagctgggtggagtcggtgggggaggcgtggtccaggcccgtggggacgtccctagagaccttctccgtggagaacgtcgtcgtggacttcattccttacaaattaactagtgcagtcgcacggtcgggtcccgacgacggcctaccggaggacgtaaaggggcgttagggtaggttcgggttaggcgttaggtttggtaggttaggttaagtaggtaagttaagggaaaatttaaacggtacgtaagttaccgtaagtgaaaccgtacggaaccgtaacgggtacgggaaaccgggtcccgtaacgttacccaacgtacgtacccgtaccgaaacgtacgtaaacccgtaaccttaacaaaccgttaaactttacccgttttaacggttacccgtaactaaacgtaaacgttaaccgaaaccgtacccggtacgttaaggaacggtaccggaacccggacggtaacccgaagggtaccttaaagttaacggtttaaccgttacggttagggttacggaaacggtacggtaacggaccgggtaacggtacccgggtaaacccggttacccccggttaaacccgggngttaaccgggg

SEQ ID NO: 39739 - DNA, 667 bp, Homo sapiens
  misc_feature: GYAE6OF01C0EYC.35.67.G01.1.454.CMB.1.raw
  modified_base (417)..(417): a, c, t, g, unknown or other
  misc_feature (417)..(417): n is a, c, g, or t
  modified_base (598)..(598): a, c, t, g, unknown or other
  misc_feature (598)..(598): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctgggtggagtcgtggggggaggcgtggtccaggccgtgggacgtccctgagctctctgtgagtcgtctggtattcatcttacaaattaactgtggactagtcgacctacggttcggggtccccgcgacggtcctacccggaagggaccgaaaggggtctgggtaggttgggtggctaggttggtgttggtatgtagtaggaaattaatagattacgtntgacagtaccgacggttagggaacgggtcctacgttaccacctatcccgtacgaagtaacgaacttacttaaccgaaagttaaccttcgttttaccgttctaagaactaaagtcgaaaccgtacgtcgtagacggtacgaccgaggaaccgtaggtaccgtaatttacgtaacgtttacgnggttacggaacggtaagaacggcgtaacgggtacccgggaccctaccccccggtaccgggtagtaccgg

SEQ ID NO: 39740 - DNA, 901 bp, Homo sapiens
  misc_feature: GYAE6OF01C4YKR.35.67.G01.1.454.CMB.1.raw
  modified_base (197)..(197): a, c, t, g, unknown or other
  misc_feature (197)..(197): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcacatggagttggctgagcttgggttttcctcgtttgcttacttttaagaggtgtccagtgtcagggtncgagctggtggagtcggtggggggaggcgtgggtcccaggcccgtggggaccggtccctggacgtaccgttctccgtggtcggaagtccgttcgtggtactttcgtaactttcctttaacaaaactttaaaccgttaagttacgggacctaagttcggtaccccgtaaccggttccgggggtcccccgaccgacggggtaccctaccccggaagggacccggaaaagggggtaccgttggggacggttggggtttacggcgtttaggtttggttggttgggtttaagtaggtaaggttaaagggtaaaagttaaacgttaagtaagtttaacgtaagtcggaaccgaacggtaaccgtaaccgggttaacgggaaaccggggtcccgttaacgttaacccaaccccgttaacttacccgtaacccgaaacggtaaaccggtaaccttaaaaccgtttaaccccgaaaacgttaacccgttttaacccgtttttacgttaacccgttaacgtaaaccgtaaaacgttaacggaaaccgtaacggacccgttaaggaaccggaccgggaacccggaaccgggtaaaccggaaacccggttaaccgtaagtttaaacgttaagtttacggtggttaacgaaccgggaaagtaacgggtacggtaacggtacggggtaacccccggttaccccggtaaacccccgggg

SEQ ID NO: 39741 - DNA, 923 bp, Homo sapiens
  misc_feature: GYAE6OF01CTPIF.35.67.G01.1.454.CMB.1.raw
tcagtacagatcgtcacgaccggtgctcgatttagagtatacatattggggtttggggggggagaggagcccagcactagaagtcggcggtgtttccatccggtgatcagcactgaacacagaggactcaccatgggtagtttgggctgagtcgttcgggttttcctcggttgtcttacgttttaaggagggttcgtcctagtgtcgaggtgcaggtcgtgggtaggtaggtcggtggggggacggcggttcgggtccacggtccgggttaggggaccgggttccctaggtaacggtaccttcccgttaccgtaggtacggacggtccgttacgttaggtacttacgtacttaccttaacgaaacgtttaaccgtagtcggtaaccgtagttaccggacggtaccgggttacccgggggtttaccctaacggtaacgggttaccgggggaaagggggtacggggttcgttaggggtttcgggttacgggttttaaccgacggtttaacggttacgggtaggtaggtacggttacgggtaaccgtacgaacctaacggtaaccgttccgggtaaccggtccggttaaccggtccgggtaacgggtaaccgggtaccccttaacccgttacccccgaaccccggtaacggaacggtaaccgtaaccgtaaaccccggaaccgaaaaccgtaacctaacgtaacgttagtacctaacgttaacggaaaactaacggtaaccgtaacgttacggtaccgaagggaaccggtaacgggacccggtaaaggtcccgtaacggttcttaacggttacgttaacgtacggttaggacgtaacgggtaacgggtgtaaacccttacgaaacgtttacggtgtttaaggttttcgggtaacttaccggtcgggtacgggtaaccgggtaaacg

SEQ ID NO: 39742 - DNA, 570 bp, Homo sapiens
  misc_feature: GYAE6OF01BE0JR.35.67.G01.1.454.CMB.1.raw
  modified_base (241)..(241): a, c, t, g, unknown or other
  misc_feature (241)..(241): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (442)..(442): a, c, t, g, unknown or other
  misc_feature (442)..(442): n is a, c, g, or t
tcagtacagatcgtcacgaccggtgctcgatttagagtatacatattgggtttgggctcaactttcttgtccaccttggtgttgctgagctgggttttcctcgttgctcttttaagaggtgtccagtgtcaggtgcagctggtggagtctgggggagcgtggtccagcctgggaggtccctgagactctcctgtgaagcgtctggattcatcttcaatactatggcatgcacgtgggtccnccaggctccgaggcaagggactggagtggtggctagttgtgtggtatgatggaatatagatactatgcagacacgtgaagggcctattcacatctcagacgacaattccaagaactctttgtccngacaatcgaacngcctgacgacgccgaaggacacggacgtattactattacgtgtcgagacgagcgagtcgggacnccccgtacccgatcgacgcgacggcggggaccacgggcctacccggtgggtccccgtaccgttcctccgttccgaccgtcccgtacccgaccggaaccgggtcccctaggttccccgggttacccccg

SEQ ID NO: 39743 - DNA, 829 bp, Homo sapiens
  misc_feature: GYAE6OF01B166A.35.67.G01.1.454.CMB.1.raw
  modified_base (184)..(184): a, c, t, g, unknown or other
  misc_feature (184)..(184): n is a, c, g, or t
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
  modified_base (377)..(377): a, c, t, g, unknown or other
  misc_feature (377)..(377): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctgagtcttgggttttccctgtttgcttacgtttttaaggnggttcgtccagtgtcgagggtncaggtcgtgggtggaggtcggtggggggagcgtggtccagccgtggggacgtccctgacgctcgtaccgtggtagaacgcgttctggtattcattcctttanaaattaacgtagtcggactagtcgacgtacggttcggggccaccgaggtccaccgagggaccgaagggngtagggtaggtgggttggacgtagggtttgtgggttacggtatagtaggtagggaaaattaagtagaactttacgtaagtcgcgtaaagaccgaaccgggttaggaacgggtccgttaacttcccactaacggtcctaccggaaaggtaacgaactaaacgtttaccaaagttaacccgtttactttaccggtttaccctaagaaaccgtttaaaaacgcgggaaaaacccgtcgtaacccggttacggaaaaccggaccgggttaaaccggggaacgggttaaaccccgaaaccggggtaccgttaaattttaaaacggttaccgtttaaccggtagggttaacccggggtaaacgtaaaccgggggtaacgaaccggggttaacgggtacccggggtaaaacccccgttccccccgggggtaaaccccgtaaggggtttaaaccccgggg

SEQ ID NO: 39744 - DNA, 796 bp, Homo sapiens
  misc_feature: GYAE6OF01EZKIS.35.67.G01.1.454.CMB.1.raw
  modified_base (358)..(358): a, c, t, g, unknown or other
  misc_feature (358)..(358): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctggagcttgggttttcctgttgcttctttaaggaggtgtccagtgtcgaggtgctagcgtgggtggtaggttcgggtgggggggacggtcggtcggtccgacggtccggtggggtaccggtccgtgacgtaccttctccgtggtgaacgtcgtcgtggtattcattccttactaaattaacgtgtggctagtcggcctacgggtcggggtcccnccgtacggtcctaccggaggccgtaaaggggtacgtgggtaggttcgggttacggcgtaggttttgtgggttaggttatggtaacggttagggaaagtttaagagtaacgttataagtcggacgaaagacccgtacgggtaagtaacggggcccttaacgttacccaactactaccgtaaccgaggtaaccgaaactaacgttaaccgaaacgttactttaaccgttttccgtacttaagaacctaacgttacggaaccgcgttaacgggtacggtaaccgggaacggttaccggggaaaccggtaacccgtacggtaaccgtttaactaaggtttaacccgtttcggtagggtaccgtaaccgggtaagaaccgggggtaactacggggttaccccggggaaccccttcccccgggtaaacccgggaggttaccggg

SEQ ID NO: 39745 - DNA, 851 bp, Homo sapiens
  misc_feature: GYAE6OF01EL115.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcaccagtggtagtttgggctgagtcgttgggttttcctcgttgtctttacgtttttaaggaggttcgtccgtagttcgtcgaggtgacaggtcgttggggtagggtacggttcgggtaggggggacggtcggttcgggtacccgacggtcccggttagggggaccggttccccgtaggacgtaccttccgttccgtggtacgacgtccgtacgtaggtacttctaattccttaactaataacgtgtcggactagtcgcctacggtccgggacccgaccgacggccgtaccgagggaccgtaacgggcgttagggtaggttgggtaggtacgttagggttgtgggttaggtataggtaagtaaggtaaatagtaagtacttacgtagacgtacgacgtaaccgtacgggaaggtaaccgggtcctactttaccgacccgttaacctaccgtaaccgtaaacgaccgttaaaccttaaccgttaaacccgtaaacgttaacccgttttacgttttaccgttaccgaagtaaacccgtaaagtaccgaacgtaacgtaccgtagggaacccggtaaccggaccgggtaaacgtaacccggtaaacggtacgttaaacgtttaacggttacggttacggtaagggaccgggttaacggaaacgggtaacccgggttcggtaaaccggggtttaccccggaaccccgggtaacccccgggtaaacggg

SEQ ID NO: 39746 - DNA, 920 bp, Homo sapiens
  misc_feature: GYAE6OF01B1PCZ.35.67.G01.1.454.CMB.1.raw
  modified_base (173)..(173): a, c, t, g, unknown or other
  misc_feature (173)..(173): n is a, c, g, or t
tcagtacagatcgtcacgaccggtgctcgatttagagtatacatattgggttttcctcgttgctcttttaagaggtgtccagtgtcaggtgcagctggtggagtcgtggggggaggcgtggtccagcctgggaggtccctgagactctctgtgagcgtctggattcatcttanaatactagtggcagtgcacgtcgggtcccgccgaggcctccgaaggcgaaacggggtacgtgggaggttgggttggcgtaggtttcggtggtggttatggtagtagggtaaagtaagtaaggtattaacgtagtacgacgaacgaccgaccggtaagggaaccggtccgtaacttaccgaacctacgtacccgtacgaaacggtaacgtaaccttaaacgttaacccgtaaaaacgtaaacccgtttacgtttttaccggttacccgtaaggtaaaacccttaaaaggaccggtaaaacggtaccggtccgttaaagggaaccggtaaccggggaaccgggaaccggaaccggtaccgggaacgttaatttaaacgttaagttttacccgtagggtaacggaaccggtaaaggtaaccgggacgggttaacggtacgggggtaaccccgtaaccccggtaccccggggtaatccgggaacgtacccggtacggggccgggtaacccggacgggtaccccggtacccgtccgggtcccgttacccgttacgttcccgtaccggtacccgaccccgttaaccccgaaacgggtcccggtaccccgttccgggttacccccgttcccccgtttaccccccgggaccgtacccccgttacccccgttacccgaaccggaacctccccgggtaccccgtcccggttaaccgggggcccgggaacccgtacccgggtacccgggtcccccggg

SEQ ID NO: 39747 - DNA, 785 bp, Homo sapiens
  misc_feature: GYAE6OF01EUHUR.35.67.G01.1.454.CMB.1.raw
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (402)..(402): a, c, t, g, unknown or other
  misc_feature (402)..(402): n is a, c, g, or t
  modified_base (503)..(503): a, c, t, g, unknown or other
  misc_feature (503)..(503): n is a, c, g, or t
  modified_base (779)..(779): a, c, t, g, unknown or other
  misc_feature (779)..(779): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagcgtggtttcgtcgtgctctttaagaggtgtcagtgtcaggtncagcgtgggtggacgttcggnggggggagcggtggtccagccgtgggacgttcccngacgtaccttcctccgtagtgaagtccgttcgtggtacttacctattcctttaacgaaacttaacctagtacggtacagttcggccgtacgggttcggggtccccgtcccggaacgggtcctacccgggaacgggaccggaaacggggttaaccgngggtaacggggtttgggtttacgggcgtttaggttttggtagggtacggtaggtacgtaagtttaagggaaagtttaaccggttagtaacttacgttaagngtaacgaacggtaccgaacgggttaagggaaccggggtcccctaagtttaccctaaccgaacccgtttccaaccgaaggtacgtaaaccgttaacttacccgaaaggttaacccttcgttttcgtactaccgttaaagaacgtacgaaccgtaggtcctaaggaccgacgggacgttaacggacgtacggtaagaacttagttaaccgttacgtgggaacggacgagggtaacgaccggttgggtaccgggaaccgtaccccccggtaaccgggtntaccgg

SEQ ID NO: 39748 - DNA, 774 bp, Homo sapiens
  misc_feature: GYAE6OF01DNMXJ.35.67.G01.1.454.CMB.1.raw
tcagtacagatcgtcacgaccggtgctcgatttagagtatacatattggggtttggggggggtcacaagaggcagcgctctcgggacgtctccaccatggcctgggctctgctgctcctcactctcctcactcaggacacgagggtcctgggcacagtctcgtcctgactcacgtccctcccgtccggcgttcccgggtctccgtggacctagtcacgtccacctattcctccgtcgcctaacgtacgaaaccaaacgtattacggtacggtttgggtttaggtttacttaatttcgttcgttacttactagtaccggtaaaccaaacgtaacctaaccgaggacacggaacccctaacccctaaactcctagttacgtttaatttcgaaggtacgaagtaccgccgtccgtacgtacgggtcctagtcgtcgtacttcgtcgtcgtactacgtacgtcacgtaacctaaccggacccttcccgtaccttacccggttctccggttaccgacccttaccgtacgtacggttagggaacggacgttacgggaagttacgttaagtttaacgttttaccgttaacgtcgtaaacggtcttacgtaaccgtaattcgtcggaacgtacggtacctaacggtttacccgtttaacggtttcgtttacgggtaccgggacggttaacggaaacgtttaggtaacccgtaaccgggttactacggtaccgaccgaccggacgttcccgtccccgacgttcccggtcgtaacccttcccgg

SEQ ID NO: 39749 - DNA, 817 bp, Homo sapiens
  misc_feature: GYAE6OF01B7QJM.35.67.G01.1.454.CMB.1.raw
tcagtacagatcgtcacgaccggtgctcgatttagagtatacatattggggtttggggggggagaggagcccagcactagaagtcggcggtgtttccatccggtgatcagcactgaacacagaggactcacatggtagttgggctgagtcgttgggtttcctcgttgtcttacttttaaggaggtgtccagtgtcgaggtcgcgaggtcgtgggtagggtacggtcgggtgggggggaggtcggtcgggtccgacggccggtgggggacggtcccgtaggacgtaccttccgttccgtggtaggaacggtccggttcgtcggttacttcgtacttacttaacaaattaactagtcggactagtcgacgtacggttccgggcccgaccgacggcctaccggaagggacggtaacggggtacgtagggtggttacgggttcggacttgggttgtggtaggtagtaggtaaggtaaggtaaacgttaagtaggtaattaacgtgtagaaccgaacggaccgtaaccgggtagggaacccgggtaccttaagtccccgaaacttacgtacaaccggaaagaactaaaccgtaacttaacccggaaattacccgtttaccggtttctaaccgggtaactaaacgttaaacggtccgaaaggtccggtaaccgtagggaacggacgtaaccgggaacgaaccggaacggtattaaacgttagttaccggtacgtaagggcggaaacggaacgggtaaccggacggttaaccggggaacccgggtaaccccgtaacccccgggtaccgggtagtaaacccgggg

SEQ ID NO: 39750 - DNA, 828 bp, Homo sapiens
  misc_feature: GYAE6OF01DG6U8.35.67.G01.1.454.CMB.1.raw
  modified_base (165)..(165): a, c, t, g, unknown or other
  misc_feature (165)..(165): n is a, c, g, or t
tcagtacagatcgtcacgaccggtgctcgatttagagtatacatattgggttggggggagaggagcccagcactagaagtcggcggtgttccatccggtgatcagcactgaacacagaggactcaccagtggtagtttgggctgacgtccgttcgggtttttccncgtttagtcctttacgttttaaggaggttcgtcctaggttgtaccgtaggtcgacctaggtcgtgggtacggtaggttccgggtaggggggacgccggttcgggtacccacggtcccgttaggggacccgttccctagacgtacccttcgtccgtgtaggaacgtccgttgtacggacttcgtacttccgttacaaattaaccgtagtacggtacagtcgaccgtaccggtccggggtacccgaccgtacgggtaccgtaccggaagggtaccggtaaggggtaccgttggggttaagttcggggttacggtaccggttaggtttcggtagggttacggttaacgtggtaaacggttagggtaaaacgttaagtaacgtaacgttacgtagtacgaccgtaaggacccgtaacggtgggaaccggtcctacgttaaccaccgtaacttacccgacgtaacgtaacgaaccttaacgtaccgaaacgttaaccttcgtttacgttaccgagtaacgtaacgtaccgtaacgtaccgggacgggtacggaacggtacccggacggtaccgtaacggtacctaatacgttagtacgtacggtacgtacggaggaaccgtcgaacgggtaccggtacccgaccccggtaaccgtggaccggtaccgg

SEQ ID NO: 39751 - DNA, 717 bp, Homo sapiens
  misc_feature: GYAE6OF01CWYR7.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggtagtttgggctgagtcgttgggttttcctcgttgcttacgttttaagaggtgtccagtgtcgaggtgcagcgtgggtggacggtcggtggggggaggtcgtcgggtccaggtccgtgggacggtccctaggacgacctcctccgtggtagacgcgtctggtattctatcttaacaattaactagtcggctagtgccgtacggtccggggtacccgcgacggcctacccggaaggaccggaaagggtcgttagggtaggttggtacgggtctagggtttggtacggtggtaagtcggtaaggttaggaaacgtttaagtaacgtagttaacgtagtcgaacgaacgaccggtaaccgggtgggtaaacggcccttattacccaaccgtactcccgtaaccgaagtaaccgtaactaaccgttacaaacgtaccttacgttttaccgtacaacgtaaccaaagttacgaacgttacgaccgtagaacggaccgacggagtaccgaggaacctattaacgttaagttcggagtacggaacgagaggtacgacgggtacgaccccgaaccccggtcggagtaccggg

SEQ ID NO: 39752 - DNA, 776 bp, Homo sapiens
  misc_feature: GYAE6OF01AV2Q8.35.67.G01.1.454.CMB.1.raw
  modified_base (199)..(199): a, c, t, g, unknown or other
  misc_feature (199)..(199): n is a, c, g, or t
  modified_base (537)..(537): a, c, t, g, unknown or other
  misc_feature (537)..(537): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgcctcgtgtcgtggtctccgtggacngtcgatccacatctcctgcacgtagaaccagcagcgtagttgggttggggttatgtaccttggtcctccgtggtactacaacgcgaccacccgaaggacccaaaccgtacccccctaaaattacctttaaatttaacgtaaaggtaaccaacgtaaccgcccgaacccgtcgtaagggttaactttacttaacgtccgtacctttccgtacgttcggtaccttaacccgtaacggttcgtacgggtaccctaaccggttcccggtccccttaccgtacgtaacctaacttccgtcggttaccgggccgttcccggggtcgttacggacgggtaacggnggttaccgttagttaagtttaacgtttagtttcggttacgtaccttataacgttacgtccggtaacggttaagggttaataccggtaacttaacggttaagtttccggttaccgggttaacggtaaccggggttacggtaacccgttaacggtacccgttaacccggttcggttaacggacccgaacgtaccccgaaacccggtcccctaaacccctcggttcctaccccggttacccg

SEQ ID NO: 39753 - DNA, 736 bp, Homo sapiens
  misc_feature: GYAE6OF01C78WI.35.67.G01.1.454.CMB.1.raw
  modified_base (194)..(194): a, c, t, g, unknown or other
  misc_feature (194)..(194): n is a, c, g, or t
  modified_base (316)..(316): a, c, t, g, unknown or other
  misc_feature (316)..(316): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtncgagctggtggagtcgtgggggagcgtggtccagccgtgggacgtccctgacgactctcctggtagaacgcgtcgtggattccattccttacaattaactgtggcatgctacgtcgggtccnccgaggcctccgaggcgaagggtcgtgggtaggttgggttaggcttaggttggtaggttacggtatggtaagttagggtaaattaagtagacttaacgttagagacgtaacgaccgaccgggttaaggaacgggttccccgaagttttcccaaccgtaacgtttacccctaaccggaaacggtaaacgtaaacccgttaaacgttaacccgtaaaacgtaacctttacccgtttttacgtttacccgtataacccgtaaacgtacgtaaccgtacgtaccgttaggaaccgtagggaccccgtaagggacccggaccggtaacgtattaacgttaacggttcgttaggacggtaccgaagggaacgtacgggtaacggtccggggacccgtacccccggaccccgggttagtaacccggg

SEQ ID NO: 39754 - DNA, 686 bp, Homo sapiens
  misc_feature: GYAE6OF01BB4ZX.35.67.G01.1.454.CMB.1.raw
  modified_base (162)..(162): a, c, t, g, unknown or other
  misc_feature (162)..(162): n is a, c, g, or t
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
tcagtacagatcgtcacgaccggtgctcgatttagagtatacatagttgggtttgggtctgggagaggagcccagcactagaacgtcggcggtgtttccatccggtgatcagcactgaacacagaggactcaccatggagtttggctgagcttgggtttccngttgcttcttttaagagtntccagtgtcaggtncagctggtaggagtcggtgggggagtcgttggcccaggtccgtagggacgtccctaggacgtcctcgtcgtggtagacgtcgtctgtattcattacttanaaatactagtcggactattcgacgtacgttccggaccaccgtaggccttccggaggtaccgaaaggtccgtagggtacggttaggtttcggaccgttaggttggtaggttaggtagtaccggtaggttacgggaaagttagtacgtaacttacgtgtagaccaacggtaccgaacgtaggacggtacctacgttacaccgtacaccgtacgtaaggaacgtaaccgttaaacgttaccgaaacgttaaccttacgttttaccgacgtacgtaacctaagtaccaacgtcgaccgtagacgacgacccggaagacccgtagtaacgtaagtacttaggtacgtcggtacgaaggaactacgggacgtaggtacggcccgtacccggtaccgg

SEQ ID NO: 39755 - DNA, 791 bp, Homo sapiens
  misc_feature: GYAE6OF01EC4G3.35.67.G01.1.454.CMB.1.raw
  modified_base (742)..(742): a, c, t, g, unknown or other
  misc_feature (742)..(742): n is a, c, g, or t
tcagtacagatcgtcacgaccggtgctcgatttagagtatacatattgggtttgggggggagaggagcccagcactagaagtcggcggtgtttccattcggtgatcagcactgaacacagaggactcaccatggagtttgggctgagctgggttttcctcgttgctcttttaagagtgtccagtgtcaggtgcagtctggtgcagtcgtgggggcgcgtggtccagccgtgggagtccctgacgtacctccttccgttgtcgaacgtccctacgtggtactttcctacccgttacaaagtaaccttatggcaagttcgcctacgtcgggggtccccgacccgacgggtcccgtacggtaaggggaccgtaacggggggtccgttaggggtacggtacgggggtgggtaccgtaaggttacggtaattacgttaccgttagttttaggaaggttaagggtaaaagttaaaacttaaaaaccgttacgtttaacccggacgtaacggtaaccgttacccggtaacggggtaaaccggggttcccgtactttaaccccgaccctaacgttacccgtacccgaaagtaaccggtaaccctaaacgtttaaccccgaaaacgtaacctacccgtttaccttccggttaccctacgtaccgtaccgaactaacgttacgaaaccgtcgggtttaccggacgggtacctagggaacggaacccgacggtctagttaccttacgtttagnggttccgagaagtaacgtacgtaaaccgttaagttagttcgagtaacgg

SEQ ID NO: 39756 - DNA, 877 bp, Homo sapiens
  misc_feature: GYAE6OF01B1Q3L.35.67.G01.1.454.CMB.1.raw
  modified_base (179)..(179): a, c, t, g, unknown or other
  misc_feature (179)..(179): n is a, c, g, or t
tcagtacagatcgtcacgaccggtgctcgatttagagtatacatattgggttttcctcgttgctcttttaagaggtgtccagtgtcaggtgcagctggtggagtcgtgggggaggcgtggtccagccgtgggacggtccctgagactctcctgtgaagcgtctggacttcattccttanaattaactagtcggtcattggcctacggtcgggtacccgccgaggccctccgaaggcgaaagggctgggagtgggttcggactaggttcgtgggtaggtagtagaggttaaggaaattaagtaagtacgttaactagtgactaacgaaccgacggtaggaacgggcccgtaattcccgaacctacgtcctaccgaagaacgtaacctaacgtaccaaacgtaaccttcgtttaccgtacctaagaactaaacgtacaacgtcgtacgtagaacggtacggaccggacggaaccgacgggtaactacgtttaaacgtacgtttacgtacggtacggaacggtaaacgacggacgggtaacggtacggggtaacccgtaaccccgtaacccgggtacgtacggaccggtaaccggtacgggtacccggggtaccggtaacccgggcccgtaccccgggttacccggttcccggttccccgtttaccggttccccgttaccgaccccggtttaccccaaaccccgtaaccccgggtaaccccggttaccccgttaccgggttacccccggttcccccgttcccccgttacccgggtaacccctccccccggttaacccgacccgaccggaaacccgttcccccggaacccggttcccgggaccggggtacccgtaccccggtaacccggggtacccccggg

SEQ ID NO: 39757 - DNA, 254 bp, Homo sapiens
  misc_feature: GYAE6OF01D9CXM.35.67.G01.1.454.CMB.1.raw
  modified_base (249)..(254): a, c, t, g, unknown or other
  misc_feature (249)..(254): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctagatcagcccaaggcccaaccccactgtcactctcgttcccgccctcctcacgatctgtactgagcgggctggcaaggcgcatagnnnnnn

SEQ ID NO: 39758 - DNA, 745 bp, Homo sapiens
  misc_feature: GYAE6OF01DFOR9.35.67.G01.1.454.CMB.1.raw
tcagtacagatcgtcacgaccggtgctcgatttagagtatacatattgggtttgggctcaactttcttgtccaccttggtgttgctgagctgggttttcctcgttgctcttttaagaggtgtccagtgtcaggtgcagctgggtggagtcgtggggggaggcgtggtccagcctgggaggtccctgagactctcctgtgaagcgtctggattcatcttcaataactatggcatgcactgggtcccgccaggcctccaggcaaggggactggaggtggttaggctaggttgtggtggtatgatggaaagtaatagatactatgcagacgaccggtgaaacgggcctaagttccactatcgtaccagaagacctaagttacccaaagaacctactttttcggtaccctaggtaaccaaaagttaggaacctaacgtcccgtaggaacggacggaccccgggtaaggaaccggaacggtacgtaattaacttacgtttaacgtcggacggtacggtaaacggaaggaccggtagggtacggggaacccggtacccccgtaaaccccccggggtagtacggaacggtaccggtacccgggtacgggggacccccggaacgggggaccccgtaccccggttcggggtacccgttacccggttcccgttaccggttacccgaccgtacccccgtaaccccgtaaacccggaccccggggtacccctaccggttcccccggtttaccccccg

SEQ ID NO: 39759 - DNA, 951 bp, Homo sapiens
  misc_feature: GYAE6OF01A9M7U.35.67.G01.1.454.CMB.1.raw
  modified_base (234)..(234): a, c, t, g, unknown or other
  misc_feature (234)..(234): n is a, c, g, or t
tcagtacagatcgtcacgaccggtgctcgatttagagtatacatatgggggttggggggagagggagcccaggcgactagaagtcggcggtggtttaccatccggtcgatcgacgcgaacccttgaaccacacgtaccggacctcacctatgggagtttgggctgagctaggggtttttccctccgtttgctactttttaagagggttagtacccgaggtcgtaccgtagggtntcgacgtacggtgggttccggaaggttacgggtaacggggggacgggtccggtacggggtaccgacggtacccggttagggggtaccggttcccctaggggaacggttaacctttcccttaccgtttgggtaccggaaaaggtaccgttacggttaggttactttcgtactttaccgtacctaaaagttaaacttaggtacgggacctaacggtcccgaccgtacggttcgggggtccccacgtaccggtcctaccggagggaccggaaagggtacggtagggaacggtttcggttaccggggacttacggtttacggaggttaggtaagttcgtacgtagggtaaacttaacgtaacggtaacttacgtaggtaggacgtaacggacccggtaccgttaacggggaacggtacctaaccttcggaacccggtaccttacggtaccgaaggaagtaaccgtaagttacccaaacgtaaaccgtttactttacgtttacccggtagaaacctaaacggtacgtaaaccgaggtacccgggttagggaaccgttaacgggaccccgggaaaggggtttacccgggacggttaaccgggtaaagttaacccggttttaaacgttacgggtcggggtaccgttaacgggaaaccgtaaccgggtaccgggtaacgggtacggggttaaccccgccccccccggttaaccgggtacggttac

SEQ ID NO: 39760 - DNA, 778 bp, Homo sapiens
  misc_feature: GYAE6OF01A3YDI.35.67.G01.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
tcagtacagatcgtcacgaccggtgctcgatttagagtatacatattgggttttcctcgttgctctttaagagtgtccagtgtcaggtgcagctggtggagtctgggggagcgtggtccagcctgggaggtccctgagactctcctgtgaagcgtctggtattcatcttcaataacgtatgcatgcagtgggtccncaggctccaggcaagggctggagtggttgcngtgtgtgangatgaacgtangatactgtncgtanacgtcgtgagggcctagttaccacctatctccgaagacgtaacgtaactttaccaaaaggtaacctacgttttcggttaccctaggtaacccaaaatttcggaaacctagtaccccgttagaaacggacggtacccggaaacgggtaccgtaccgggtaccgtaagttaacgtacttaaccgtggtacgacggtagtaacggacgtagtacggggtaacctaccccggtaaccccggagttaccggacggtaccgaaccgggtcgggggtaccctaacgggggtacccttaacccgggtaccggggtttccgtaaccccggttacctttccccgttacggtaccccggttaccccgtaccggtaaacccggcccggtaacccccgttagtttccccggttcccccttaaacccccggtcggttacccccggtacccttaccccggtccggtaaaccgcccttacccggtacccgttaccggggcggggtaccctaaccccgggtggtccccccgggg

SEQ ID NO: 39761 - DNA, 904 bp, Homo sapiens
  misc_feature: GYAE6OF01B4VX5.35.67.G01.1.454.CMB.1.raw
  modified_base (651)..(651): a, c, t, g, unknown or other
  misc_feature (651)..(651): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacgcggtcgtggcacagtctccgcctacgacctacgacgtccgtcgtcccgttcggtcgttcggttcggtccttacggtcggacgtacggtacgtactaccaacctcttccgttccgtcgaccgtaaccggtaaccggaaaccgacgacgtacggtacggttagggttttaggggggttttacggggttacttaccggttacccgtttcgttcccgttaccgggttagttactaaccgaaccgtaccgaacccgaacccggaacggtaaacccgaaaccccgtaaaccccctttaaaacgttttaaccttttaaaacgtttaaacggtaaaccggtaacctaaaccggtaacccggtaaccccgtaacccggtaaggttaaaccggttttacttaacgttacgttaccgttcttccgttcggtcctaaccgtacgtacgttcggacgtaacccgtccgtcccgtcctaccgacgtactacgtcgtcgggtcggtccggtcgtagacggtacggngacgttactagttactttagttacgttcgtcgtacttcgttaagtcgtacgtaacgggttacgtagtaaccgtacgtttaacgttacggttacgttaacgggtaacccggtacgggtaccccggttaaacggttaacccggttaccccggttaacccgggttaccgttaaccggggtacccgaacccccgggtaaaccccgtacccgttaaccccccttaaacgggtccctttacgtacccctttacccccgg

SEQ ID NO: 39762 - DNA, 735 bp, Homo sapiens
  misc_feature: GYAE6OF01CCG6E.35.67.G01.1.454.CMB.1.raw
  modified_base (313)..(313): a, c, t, g, unknown or other
  misc_feature (313)..(313): n is a, c, g, or t
  modified_base (407)..(407): a, c, t, g, unknown or other
  misc_feature (407)..(407): n is a, c, g, or t
  modified_base (491)..(491): a, c, t, g, unknown or other
  misc_feature (491)..(491): n is a, c, g, or t
tcagtacagatcgtcacgaccggtgctcgatttagagtatacatattggggtttggggggggtcacaagaggcagcgctctcgggacgtctccaccatggcctgggctctgctgctcctcactctctcactcaaggacacgagggtcctgggcacagtctcgccctgactcacgtcctgcccttcgtcgtcgttcgggtcctccgtggacagtcgactccacctatccgtcctacgcctacgtacggaaccagcaggtacgtagtttcggggtttagggttactcgtaccgttgtccttcgtagtactacacncgaccacgacaccgaaccacccctaattacttaaattagaacgacaacgtaccgccgtacctagtaacgttacttactacgttcgtacttccgngtcgtacctcgtaacgttcgtacgtccgtaaccgtcccgtctaccctaactaacgtccgtccgtcggtcgggtccggtaccggnggtaacggccggtacggacggttctacgttaacttcgtacgtcgacgtctactaactacgtacaaccgtaaccgagaccgtacgaccgttacgttaccgttcgggtttaccgggaccgggaccgggtaaaccgggtaccgtacggtacccggttaccggttaccccgggaccgtttaacggacccggtaacccggtacccggtaaccccggttcccggttacccccgtcccggtttaaccccgg

SEQ ID NO: 39763 - DNA, 787 bp, Homo sapiens
  misc_feature: GYAE6OF01DOGIB.35.67.G01.1.454.CMB.1.raw
  modified_base (255)..(255): a, c, t, g, unknown or other
  misc_feature (255)..(255): n is a, c, g, or t
tcagtacagatcgtcacgaccggtgctcgatttagagtatacatattgggttttcctcgttgctcttttaagaggtgtccagtgtcaggtgcagctggtggagtcgtgggggaggcgtggtccagcctgggaggtccctgagactctcctgtgaagcgtctggattcatcttacaataactatggctagtgctagtcgggtccgccgaggcctcgaggacgaaggcgtggagttggttgcgtagttggtgtggtntgagtggaaagtaatagattacgtatcgacgagaccgtaaccggtaggaaacgggtccgtacttcccgaacacttcccgtaccgaaggtaacaacgtaaccttaaccgaaacgtaaacctaccggactttaggtaacttaccgacgaacctaaaagtaccggaaaccaccggtaccggtaagaacggaaccggcccggaaacgtaccggacgggttctagtttacgtagtttacgtacggttacggaaccggtaacggtaaccgaacggtaaggtaacgtaacggttaacggttacttaacggttaacgtttaacgggttacgttacgttttacgttaacgttaacggttacggtacggggtaaccgtaacgggtaacgttacgggttacggtaccgttaccgttaccgtttccgttaccgacccgtacccgtaacccgaaccggtacccgtacccgttacggttccccggttccccgttccccgtccgtaccccgtacccctcccgtaaccgaccgtcgtcccgtacccgg

SEQ ID NO: 39764 - DNA, 920 bp, Homo sapiens
  misc_feature: GYAE6OF01CZ8WQ.35.67.G01.1.454.CMB.1.raw
  modified_base (468)..(468): a, c, t, g, unknown or other
  misc_feature (468)..(468): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcacatggtagtttggctgagcttgggtttttcctcgtttgcttcttttaaggaggtgtccagttgtcagggtcgcgaggcgttgggtggaggtcggtggggggaggtcggtgggtcccgaggtccggtaggggtcggtcccctaggaacgtccttcgtccgtaggtacggaacggtccgttacggtaggtactttaccaactttcctttaactaaaacggttaaaccttagttcggggacctaagtttcggaaccgtaaccgggtttcgggtaccccgaccggtaccggtaccctaccgggaaacgggtacggaaaaccggggttacgggttaacggggngggtttcggggtttaagggtcgttaagggttttcggggttagggtttacggggtttaagtaggttaaaggttaacggggtaaaaacgttaaaggttaaccgaagtttaaaccgttaaggtcggtaaaccaccggtaaccgtaaccggggtaacgggtaaaccgggtccgttaacgttaccccaaccgtaaccgtttacccgaaccgaaagtaaccgaaaccttaaccgttaaaccgaaaacttaccgttttactttacggttaccgtttaacgaaccgttaaagttaacgaacgtaaccggccgtttaacggaacggaccgggaccggtaaacgggaacccggtaccggtaacggtacgtttaaagttacgttaaccggttggaacggttaacggaaggaaacgggtaccgaaagggtaccccgggtaccgtaaccccggtaaaccccgggg

SEQ ID NO: 39765 - DNA, 796 bp, Homo sapiens
  misc_feature: GYAE6OF01B518Z.35.67.G01.1.454.CMB.1.raw
  modified_base (352)..(352): a, c, t, g, unknown or other
  misc_feature (352)..(352): n is a, c, g, or t
  modified_base (464)..(464): a, c, t, g, unknown or other
  misc_feature (464)..(464): n is a, c, g, or t
  modified_base (579)..(579): a, c, t, g, unknown or other
  misc_feature (579)..(579): n is a, c, g, or t
tcagtacagatcgtcacgaccggtgctcgatttagagtatacatattgggtttgggggggagaggagcccagcactagaagtcggcggtgttccatccggtgatcagcactgaacacagaggactcaccagtgggtagtttgggctgacgtcgttgggttttccctcggttgtccgttacgtttttaaaggaggttcgttcccgaaggtgtacgagggtgaccgaggtcggttggggtagggtagggtcgggtaggggggacgggtccgggtcggtaccgacggtcccggttagggggtaccggtccccgtaggaacgtcccgttccgtccgtaggtagaacggtcgttcgnggtacttccgattccttaacgaaattacgtagtcgctagtcgcacgggtccgggcccacgacggtcctaccggaacggacggaaagggtccgttggggtaggttgttacggngttagggtgttggtaggtattacggaaggttaaggtaaactaggttaagtacgtaagtacgagaccgaagtaacccggcgggtaacgggtaccggtacgttactctaaacccgtntaaccgaccgtaagaacctaacaaccgttaacaaacggtaactttcccgttagcctaagtaaccaagtcgaactccgagtaacggagaacggtaccggtaagtacccggaacgttactaaaagtttcgttaaccgggtatgggaaacgggtccaaaggggtaacgggcctaacgggttacccgggaaaccccgtccccgtaacggggtagacccggg

SEQ ID NO: 39766 - DNA, 851 bp, Homo sapiens
  misc_feature: GYAE6OF01BBW1V.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccagtggtagtttgggctagagtcgttgggttttcctcggttcgctttacgtttttaaaggagggttcgtacctaggttgtcgtaagggtgcaggtcgtgggtgggtagtcggtggggggaggtcggttcggtccaggtccggtagggggaccggttccctaggaacgtccttctccgttggtacgcctaacggtccttagtcggtactttccgtaacctttcaaggtttaccgtctaacggttcggatcgaccgtaccggttggggtacccgtagtaacggttaccggaaggggggtacggggtcttggggttggtttacgggtttactaacggttacggtttaacggaggtaggtaggtacggtaacttcggaaacctaataaccgtccggtacggccggtaactccgggaacgggaacgggtacccgtaccttacccccgaaccccgttagaaggaaaccctaaccgaaaccccggtacgtaaaaccggactaacccgtaattaaagttccgttacaaccggtaaactaaacgttacgaaacccggttagtccgtaaggacgggtaaccgacccgggtagtaaccgttacggtatttacggtacgttacttaacggtcgggtacctaaagggtacgggtacggtaccgaagttaacccgtaagttacggttcgtttttaacgggctttaaacgtcggtttaccggggaggggtaaacccg

SEQ ID NO: 39767 - DNA, 672 bp, Homo sapiens
  misc_feature: GYAE6OF01B4VJ3.35.67.G01.1.454.CMB.1.raw
  modified_base (239)..(239): a, c, t, g, unknown or other
  misc_feature (239)..(239): n is a, c, g, or t
  modified_base (327)..(327): a, c, t, g, unknown or other
  misc_feature (327)..(327): n is a, c, g, or t
tcagtacagatcgtcacgaccggtgctcgatttagagtatacatattggggtttgggggggggtcacaagaggcagcgctctcgggacgtctccaccatggcctgggctctgctattcctcaccctcctcactcagggcacacgggtcctgggcccagtctcgccctgactcagcctgcctccgtgtcgtgggtcctcgtggactagtcgatcaccactcctcctgacacgtggaaccngcagtcggtacgttggtaggttataactattcgtctaccgtcgtaaccacaccaccacgacaacgccccaactacgatagtactttanacgtatcgtactagtaagtccgacctcgtacgggtttactagtcgtcttacgtctcgtctacgtaacttcgtacgacgacctccggccctaccgtactacctctacgtcgtacggccgtcgacgctacggacgacggtacgtcgtagttacttaacgttcgcgtacgtacgtcgtaacgttaactaacgttaacgaaacccgtcgaacgtaaccacgttaccttacgttccgtacgggtccggttacggaccggggaacggtacgtaaccggtcgtaaccggtcccgtacggttaccgacggtaccggacccggtaacggtcccgtccccgtccccggtacccgg

SEQ ID NO: 39768 - DNA, 945 bp, Homo sapiens
  misc_feature: GYAE6OF01EGY4Z.35.67.G01.1.454.CMB.1.raw
  modified_base (135)..(135): a, c, t, g, unknown or other
  misc_feature (135)..(135): n is a, c, g, or t
  modified_base (501)..(501): a, c, t, g, unknown or other
  misc_feature (501)..(501): n is a, c, g, or t
tcagtacagatcgtcacgaccggtgctcgatttagagtatacatattggggtttgggggggagaggagcccagcactagaagtcggcggtgtttccatccggtgatcagcactgaacacagagactcacagtggngttggctgagtcgttgggttttcctcgttgtacttacgttttaaggcggttcgtccgtaggttcgtcgtagggtgcgaggtccggttgggtgggtacggttccgggtagggggggacgggtccggttcgggttacccgacgggtcccggtaggggtaccgggtcccgttaggaccgtccgttccgtccgttaggtcggaacggtccggttggttggtactttcgtaacttcctaacgtaaacttaaccgttagcggactacgtcgacgtaccgtcggggtacccgccgtacggtcccacggacgggtcggaagggtacgtgggtaaggttgggttcggtagttagggttggttcggtaggtttaanagggttaacgggttaaggtaagtttaaacgtaagtacgtactaggacacgaaacgtacggtaccgggaggtaaccggtacccgacgtttaccaaccgtacgttaccccgaagtaacgaaacgtaaaccccgttaacgttaaacccggaaacttaaacccgttttacggttttacccgtttaaaccgaccggttaaaacctaaggtaacccgtaaggtaacccgttacccgggtaaaggtaacccgggtcgggaaaccccggtaaccggggtaacccgtaaaccgggggtacttaaacggggttaaattttttaaacccggtcggtttaaacgggggacggtaaaccgggttaaacggggaaaccgttaccggggaaaccgggggtaccggggtaaaccccccggtaccccgggtttaaaaccccggggttggtaaaccccgggg

SEQ ID NO: 39769 - DNA, 768 bp, Homo sapiens
  misc_feature: GYAE6OF01BW996.35.67.G01.1.454.CMB.1.raw
  modified_base (299)..(299): a, c, t, g, unknown or other
  misc_feature (299)..(299): n is a, c, g, or t
  modified_base (750)..(750): a, c, t, g, unknown or other
  misc_feature (750)..(750): n is a, c, g, or t
tcagtacagatcgtcacgaccggtgctcgatttagagtatacatattgggttttcctcgttgctcttttaagaggtgtccagtgtcaggtgcagctggtggagtcgtggggggaggcgtggtccagcctgggaggtccctgagactctcctgtgaagcgtctggattcatcttcaaataactatggcatgacacgtgggtcccgccaggctcccgaggcgaaaggggactgggagtgggttggctaggttgtgtggtatgagtaggaagtaagtaggtatacgtaatgcgaacgaaccnccggtaggaagggccgtacttcaaccgatacctaccgagaacgacaattacccgaaaagtaaccttacttttgttaccctagaaccaaatagaaaccacgtccgtaagaacggacgacccggaaggaaccggaaccggtacggtaaactttaacgtttaacgttacgttacggtacggacggaaacggaaaggtccggtaaggtacggggtacccgaaccccggttaaccccccgggatacggaccgtacggaccgggtaaccggggcccgtaccggggacccgtacccggtcccgggttacccgggtcccgttaccgttccgttaacccgtcggtaacccccgcctaaccccggaaccggcccccgtaacggttcccggtcccttacccccggcgtcccctaccccgtcccaccggaacgccgaccgtccggtcccggtcggggaacccnccgggaccggtccccggg

SEQ ID NO: 39770 - DNA, 767 bp, Homo sapiens
  misc_feature: GYAE6OF01BAI7Y.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagcgtggtggagtcggtggggaggcgtggtccagccgtgggacgtccctgacgacctcgtcctggtgacgtcgtcgtggtacttcgattccttacaaactaactagtggtacagtcggcctaccggttcggggtcccgcccgaacgggtccctaccggagggtaccggaaggggtaccgtaggggtaagggttgggttcggacgttagggtttggttcggttaggtaagtggtaaggttaagggtaaaagtttaagtaaagtaagttacgtaacgtgtacgtaacggaaccgtaccgggtaacggtaccgggtaacccgtacgttaccaaccgtacctaccgtaccgaaggtaaccgaaacgttaaccgttaaccgaaacgtaaccgttacgttttccgtaacgttacgaaactaagttacgaaacccgtacgtaccgtaacggaacgtaccggaccggtaacggaccgtaaccggagtagttaacgtaagtttaccggtagtacgggaccgtaaggtaacgacgtaacgggtacggtacccgacccccgggtaccccggaaggtacccgg

SEQ ID NO: 39771 - DNA, 792 bp, Homo sapiens
  misc_feature: GYAE6OF01CRH8N.35.67.G01.1.454.CMB.1.raw
  modified_base (185)..(185): a, c, t, g, unknown or other
  misc_feature (185)..(185): n is a, c, g, or t
  modified_base (296)..(296): a, c, t, g, unknown or other
  misc_feature (296)..(296): n is a, c, g, or t
  modified_base (421)..(421): a, c, t, g, unknown or other
  misc_feature (421)..(421): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagtcgttgggttttccctcgttgcttacgttttaaagnggtgtccagtgtcgaggtgcagcgtggtggaggtcggtagggggacgtcggtggtacccgaggccgtaggggacgtccctggacgtacctcgtcgtgtacgaagcgttcgnggtattacacttcttaacaaacttactagtcggactagtcgacgtaccggtcggtcccgaccgacggtcccgtaccggaagggacgaaacggggtacgttacggggtaagggttcgggttacggngttaacggtttggtgggttaaggttataacgggtagttaaaggtaagttaaattaggtaacttaacgttagtacgaacgacgtaccggtaacggtaggaaccgggtaccgttaacttaccgaacctacgtaccgtaaccggaagaaccgtaacctaaacgttaaccgaaagttaacccgtttacgttttacgttaccgtaacgtaaactaaacgttaccggaaacctaccggtaccggtaaggaacgtaccggacggaaccgaaccgtaaccgggtacgaaagtttacgtaacggtttacgtcgggaaccggtagaaacgggtaacgtacgggtacggaaccgggtacccggtacccccgttaaaccgggg

SEQ ID NO: 39772 - DNA, 717 bp, Homo sapiens
  misc_feature: GYAE6OF01EX9I3.35.67.G01.1.454.CMB.1.raw
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (219)..(219): a, c, t, g, unknown or other
  misc_feature (219)..(219): n is a, c, g, or t
  modified_base (345)..(345): a, c, t, g, unknown or other
  misc_feature (345)..(345): n is a, c, g, or t
  modified_base (709)..(709): a, c, t, g, unknown or other
  misc_feature (709)..(709): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccagtggtagttgggctggagtcttgggttttcctgttgtcttcgttttaagnggtntcctagtgtcaggtgcagtcgtggtggagtcggngggggagtcgtggtccaggtccgtggggaccgtcctggaacgtcctcgtccgtggtaggacgtcgtcgtggtacttctatccttacaaattaacctagtcgacagtcgaccgtacgtcgggtaccnccgtacggtccctacggacggtacggaacgggtacggtgggtaggttgggtttaggaccgttagggtttggtacggtaggttaagtacggtaaggtagggtaaaattagtaacgtataacgttagcgaccgtaaaggtaccgtaacgggtacgggtaacggtccctacgttacccaacgttcgtaccctacgaacgtagtaaacctactaaccaacgttaccttacgttagtacagtactaaatcgaaacgcgtagtacgacggtacacggacgaccggtacggactaataaccttacggtcgtaggtacggaacgagggtaacgcggttaacggtaccggaacccggttccccgttaaccggngaaccggg

SEQ ID NO: 39773 - DNA, 648 bp, Homo sapiens
  misc_feature: GYAE6OF01BZ7DO.35.67.G01.1.454.CMB.1.raw
  modified_base (86)..(86): a, c, t, g, unknown or other
  misc_feature (86)..(86): n is a, c, g, or t
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (459)..(459): a, c, t, g, unknown or other
  misc_feature (459)..(459): n is a, c, g, or t
  modified_base (497)..(497): a, c, t, g, unknown or other
  misc_feature (497)..(497): n is a, c, g, or t
tcagtacagatcgtcacgaccggtgctcgatttagagtatacatattgggtttgggggggagaggagcccagcactagaagtcggnggtgtttccatccggtgatcagcactgaacaaagagactcacatggagtttggctgagtcgttcgggttttcctgttgacttacgtttttaagaggttcgtccagtgtacgaggtgcagcgtggtggagtcgtgggggagcgtcgtcagccgttgggacgtccgtagacgtctctacgngttagagtcgtagagtactcacttctacaaatacgtntgctagtacgcaacggtcggtaccncacggcctaccggaggacgttaacggcgtaggtacgttggtacgngtagttgcgtagtagagagtagtaactaagtnacgtanagtcgagtacgacgnggtacgacgctatcgactatcacaagagaactanaactaatacgtactttctactacgtactaactagaacncggtactagacgtaacggacgaacggaacgtacggtaacgtaataacgtttaacggtacgtacggtaacgtaacgggaaaggtaaccggtaacggaaccggttacggggaacccgttaaccccgggtaaccccgttaggaacgtaaccggg

SEQ ID NO: 39774 - DNA, 837 bp, Homo sapiens
  misc_feature: GYAE6OF01CIVGH.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgcttacttttaaggaggtgtccagtgtcgaggtgcagctggtggagtcgtgggggagcgtggtccaggccgtggggacgtccctggacgtaccttctccgtgtacggaagccgttgtggtactttcgaacgtttcctttaacaaaattaaccgttagtcgggacctaagttccggaccgtaccggtttacccggggggtcccacccgtacgggtccccgttacccggaacgggtaaccggtaaacgggggtccttagggggtaaccggtttgggggttccggacgttaagggttttcggttgggtaaggttaacgttaggtaacggttaaggggtaaaacgtttaaagttaaggaatttacctaggtacggacaaacggtacccgaacgggttagggaacgggtacctacgttaccgaccgtacttacccgtaacgtacggaaactacctaaacgtaacccgtaaacgtaaaccgtttaccgttttccgttacgtacgtaacctaaacgtaccgtaaacgtcggtaccgtaggaacggtaccggaccgggaacggtaacccgacggttaacgtacgttaacgttaacgttaacgtacggtacggtacgtaacgggaacggtacggtaacgggtaccgggacccgtaaccccggtaaccccggtggtacccggg

SEQ ID NO: 39775 - DNA, 721 bp, Homo sapiens
  misc_feature: GYAE6OF01BW8CK.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagtcgttcgggtttttcctcgttgcctttacgtttttaagagggttcgtccaggttcgtcgagggtgcagcgttgggtggaggtcggtggggggacgcgtcggtccagtccgtggggacgtcccaggacgtccttcgtccgtgacgacgtcgtcgtggtacttctattcctacaaacgttactagtcggcagtcgacgtaccggtcgggtcccaccgtaggtcctaccggaggtaccggaagggtcgtaggggttaggttcggttaggccttagggtttgtagggttaggtaagttggaagttaaagggaacttaaagtacgtattaacttaggcgaacgaacggtaccggtaacgggtggaaccggtcctaacgttacccaacgtcttacgaacgaagtaactaacctaacgttaacgaaattcctttaacgttcgtacctagtaaacctaagtccgaactcgacgtaggaacgcggtacgaacgccgacggtagtaaactacgtttacgtccgtaggacgtaaggaaccgtagtccggaacggtccggaaccccgttcccgaccggtgaccggg

SEQ ID NO: 39776 - DNA, 984 bp, Homo sapiens
  misc_feature: GYAE6OF01E1HRA.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggctcacatggagttggctgagtcgttggttttcctcgttgtacttacgttttaaaggagggttcgtccgtaagttggtaccgtaagggtcggaccgtaggtcgttgggttagggaacggttccgggttagggggggacggtccggttacgggttcccgaacggtcccgggttacgggggtaaccggttcccccggttaggtaaccggttaccttccggttacccgttagggttacggaacgtccggtttaccggtaggttacttaccgtaactttaccgttaacgtaaaacttaaccgagtacggtcaagtcgtaccgtacggtccgggtacccgccgtaaggtcccgacgtacggaccgagggtacggtggcggttggtacgtactagggttcgtaggttgagtacgtagaaggttaagtaagtacgtaacttacgtagtacgtaacgaacgtaccggtaaccggtagggaaccggtcccgtaacgtaccgccaacgttacccgtaaacgaaacggttaaagaaaccccgttaaaacgttaacccgtaaacgtttaaacccggtttacgtttacccgttaaaccggtaacgttaaccgaaaacggttccggtaaaccgtaccggtaccggttaaacggaccgggtaaccgggttaacccgggtaaaccgggtaaccgggttaaaccccgggtaagttaaaaccccgttaaggttttaaaacccggttaccgggttaaggttaacccgggaaacggtaaacggggtaaacccgggttacgggttaaaaccccgggggtacccggggttaaaccccggttaaccccccggtaaacccggggttaacccgggtaaacccggggg

SEQ ID NO: 39777 - DNA, 816 bp, Homo sapiens
  misc_feature: GYAE6OF01CD67X.35.67.G01.1.454.CMB.1.raw
  modified_base (809)..(809): a, c, t, g, unknown or other
  misc_feature (809)..(809): n is a, c, g, or t
tcagtacagatcgtcacgaccggtgctcgatttagagtatacatattgggtttagggggggagaggagcccgagcactagaagttcggcggtgtttccatccggtgatcagcactgaacacagaggactcaccatggagtttgggctagacgcttagggttttcctcgtttgccttacgtttttaaaggaggtagttccgaagttgtccagggtgcagtcgtgggtggagtcggtagggggagtcgttggtccgaggccgtgggacgtccctgacgactcgtcgtgtgacgtcgttcgtggtacttcgtacgtccttaacgaaacttaacgtacgtcggtactacgtcgaccgtacggttccgggtacccgaccgtacggtacctacccgggtaacggtacccggtaaggggtaccgttcgggtaaggttccgggtttacggacgttagggtttcgtacggttaggtactaggaacgttaagggtaaacgtaacgttaacggtaacgttaacgtaacggttcgaacgaacggtaaacccggtacggtttaacgggaaccgggtccttaacttacccgaaactttcgtaccggtaacgaacgtaccgtaaactaacccgtttaccggaaaacgttacccgtttacgttttccggtaacctagggaaaccttaacgttcggaaaccttaccggccgtaaggaccggacggaccggtacgaaccgtacgggacttaaagttaaccgttcgtttacggagggtagaccgtaaaggtaacgcggtacgtacggggacccctacccgggtaacgngtaccgg

SEQ ID NO: 39778 - DNA, 736 bp, Homo sapiens
  misc_feature: GYAE6OF01CZBHK.35.67.G01.1.454.CMB.1.raw
tcagtacagatcgtcacgaccggtgctcgatttagagtatacatattgggtttggggggggtcacaagaggcagcgctctcgggacgtctccaccatggcctggctctgctgctcctcactctcctcactcaggacacgagggtcctgggcacagtctcgccctgactcagcctgcctcgtgtccgtgggtcctccgtaggactcggtcatccaccacttcctcctagacctacgtacggaacccagcgagacggtagtttgggttagggggttatcgtaccgtttgtccttacgtggtaactacgaacgacgaccgtaaccgtacggtaaccacccgaaaaaaaaaaccccctcttaactttaaagtttaacgaacggtaacctaacgtaacgacccgtaaccccgtacggtaaggttacgtttaacgtacgttacgttccgtttaccgtaccgtacggtaccttacgaacgttccgtacgtaaccctaccgtcccgtcccgttacacgtactaaccttccgacggtcggtccggtaccggcgtaacggacggacggtacgtagtacgtatttagtagttagtcgttactacgtatcgtacggacggttaaggtacgtaacgacgttaatacgttacggtaaccgttaacggtacggtacggtaaccgaaccgtccggtacccgtaggtacgtaccgacgtacccgaaccggacccaccgtactcgtcttacccg

SEQ ID NO: 39779 - DNA, 963 bp, Homo sapiens
  misc_feature: GYAE6OF01CG2SJ.35.67.G01.1.454.CMB.1.raw
  modified_base (880)..(880): a, c, t, g, unknown or other
  misc_feature (880)..(880): n is a, c, g, or t
tcagtacagatcgtcacgaccggtgctcgatttagagtatacatattgggttttcctcgttgctcttttaagaggtgtccagtgtcaggtgcagctggtggagtcgtgggggagcgtcggtccaggcctgggaggtccctgagacctctccgtgtgaagcgtacgtggattcatcttacaattaactagtggactagtcgccgtacgtcggggtccccgacgacgggtccctaccggacgggacaaacgggggtcttgggggaggtttgggtcggtctaggttttggtgggttacggttatgggattaaggggaaagttaagtagtaattacgtagtacgacaaccggtaccgtacccggagggaaacggggtacccttacttaccaaaccgtcgtacccgtaaccaacgggaaactaacccgtaaacttaaccgtaaaacggttaaactttcccgtttacgtttaccggaacgtaacgttaaacgtaacggaaccgtaacgtaccgtaacgggaaccggtacgggaacccggttaaggaaccggtaacccggggtagtaaactttaacgttacgttttaacggcggttaacggacgggaaccggttaacgggacggtacggttaaacgggggaccccgttaccccgtaacccggggtaactacgggaccgttaaccggaccggggtaccgggacccggtaacccggggtcccctaaacccgggttcccgggtttacggtccccgttttacccgttacgttacccggtcccgtaacccggttaccccgaaccggggttacccgaccccgttaccggggttccccccggtttacccttacccccgggaccgggttacccccctacccgggggttaaccccncgggtaaaccgggtccctccccgggttacccgggtaacggggttccgggaaacccctaacccgggggccgtacccccgggggg

SEQ ID NO: 39780 - DNA, 818 bp, Homo sapiens
  misc_feature: GYAE6OF01CLCJV.35.67.G01.1.454.CMB.1.raw
  modified_base (185)..(185): a, c, t, g, unknown or other
  misc_feature (185)..(185): n is a, c, g, or t
tcagtacagatcgtcacgaccggtgctcgatttagagtatacatattgggtttgggtctgggagaggagcccagcactagaagtcggcggtgtttccatccggtgatcagcactagaacacagaggactcacatgggtagtttggctgagtcgttgggttttcctcgttgtcttacgttttaagnggttcgtccgtagtgtcgaggttcgacgtaggtcgttggggtacgggtaggtcggggtaggggggtacggtcggtcgggtacccgaggtcccgggttagggggccggttccccgtaggacgtaccttccgtacgtggtacgaagtccggttagtggtattctattccttaactaaattactaggtcgactagtcgtaccgtaccggttccgggcccaccgagggtcccgtacggaaccggtacggtaacgggtaacggtgggtacgggttcggttaccgggtcgttttaaggggttttcggaggtttagtaggttaaaggtaaggtaaaacgttaaggtaaagtacgtttacgtagacgaacgtaccgggaatacggtaacggggacgttaccgtacgtaccaactcgttaccacgtaaagtacgtaacgtaaactaccgtaaagtaaccgtttcgttacgttaccgtaacgtaacgtaacgtaaacgacgtaacgtacgtaacggaacgaccgggaccgtaacggggaacttacgggacgttaaacttgttaaacgtcggtaaggttccggaaggaaagggtacgtacgggtaacggtaccgggtaccggtaacccccggtacggtaaccgg

SEQ ID NO: 39781 - DNA, 727 bp, Homo sapiens
  misc_feature: GYAE6OF01CLS8K.35.67.G01.1.454.CMB.1.raw
  modified_base (203)..(203): a, c, t, g, unknown or other
  misc_feature (203)..(203): n is a, c, g, or t
tcagtacagatcgtcacgaccggtgctcgatttagagtatacatattgggttttcctcgttgctcttttaagaggtgtccagtgtcaggtgcagctggtggagtcgtggggggaggcgtggtccagcctgggaggtccctgagactctcctgtgaagcgtctggattcatcttcaataactatggcatgcacgtggggtcccnccaggcctccgaggcgaaggggactgggagtggttggctagttgtggtggtatgataggaagtaatagaatactatgacaagaccaccggtaggaacgggccattccaaccgatcctaccaagacgaacctaaacttaccaaagtaacctacgttttacgtccctagaaccaaatacgaaacacgtacctaggaggtaacgacccggaaggaaccgacgggactaagtacttaattacgtgtagacggaagaggacggtagtacgggacgtacccggtaaccccggagacggacgaccgacgggtccgggaccgacgggcccacccggtacgggtcccgtccgtccgttccctaccgccgtacccgtacccgaacccggaccggtacccctaccggttccccggttcccccgtttcccccggtccggtacccccgttaccccgttaccccctacccggaaacggtcccgtacccgtaccccggttccgggaccggggacccaaccgggtcccgggtccccgggg

SEQ ID NO: 39782 - DNA, 694 bp, Homo sapiens
  misc_feature: GYAE6OF01D5N91.35.67.G01.1.454.CMB.1.raw
  modified_base (199)..(199): a, c, t, g, unknown or other
  misc_feature (199)..(199): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagtcttgggttttcctcgttgcttcttttaagaggtgtccagtgtcaggtgcnggcgtgggtggaggtcggtggggggaggcgtggtccaggccgtggggacgtccctgacgctcctctgngaagcgtctggnttcattcttaactaataacgtatggctatgcctacggtcgggtcccgaccgtaggcctaccggagggacgtaaggggcgtgggtaggttgggttggacgtaggttggtggtgttagtgtaagtaagggtaaagttaatagtatactagcgacacgaaccgacgggtaggacgggtacctacgttacactatacccgtacgagaacgtaactaacgtacctaaacgtaccttacgtttacgtccctagtaaccgaagtaccgaactaccggtccgtagggaaccggtacgaacccgggacggtaccggaaccggtagtaacttaagttaacgttacgttagggacggtaaccggaaggtaaccggacggtaacgggtacggaaccccggtaacccccgggtccgaaggtaaccggg

SEQ ID NO: 39783 - DNA, 759 bp, Homo sapiens
  misc_feature: GYAE6OF01BWX2I.35.67.G01.1.454.CMB.1.raw
  modified_base (165)..(165): a, c, t, g, unknown or other
  misc_feature (165)..(165): n is a, c, g, or t
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (322)..(322): a, c, t, g, unknown or other
  misc_feature (322)..(322): n is a, c, g, or t
  modified_base (396)..(396): a, c, t, g, unknown or other
  misc_feature (396)..(396): n is a, c, g, or t
  modified_base (443)..(443): a, c, t, g, unknown or other
  misc_feature (443)..(443): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (505)..(505): a, c, t, g, unknown or other
  misc_feature (505)..(505): n is a, c, g, or t
  modified_base (652)..(652): a, c, t, g, unknown or other
  misc_feature (652)..(652): n is a, c, g, or t
tcagtacagatcgtcacgaccggtgctcgatttagagtatacatagttgggtttgggggggagaggagcccagcactagaagtcggcggtgtttccatccggtgatcagcactgaacacagaggactcaccatgggagtttggctggacgtcgttgggttttccncgttgcttacgttttaagnggtgtccngtgtcagggtcntacggtcgtgggtggagttcgggngggggacgggtcggttcggtacccagggccggttaggggtaccgggtccctaggaacgtcctttccgtaccggttgagggtaacggtcccgttnttacgggtacttccgtaattccttaacgtaaaacgttaactaggtccgctacgttcgacgttcggtaccgggcnccgaggcctaccggaggacgtaagggtacgtggtacggttggtaggngtaggttgtgggtagtagcggagttaaggataagtanacgtacngtacgaacggacgtaccncgggtacgggacgtcgttaactaccgacgtacccgtacgaacgtacggtaacaacgtaacctacgaacgtaacccttgttccggtactaacgaacacgtaacgaacctacggtccgaggtaaccggtacgacggtaaccggaaccgnggttaaactacgtttaacgtacgggttactgggaacgtaaacggggaaccaagggtccggtaacgggtacccgtacccccgggaaccttaaccgggtgaaacccggg

SEQ ID NO: 39784 - DNA, 673 bp, Homo sapiens
  misc_feature: GYAE6OF01C01E9.35.67.G01.1.454.CMB.1.raw
  modified_base (200)..(200): a, c, t, g, unknown or other
  misc_feature (200)..(200): n is a, c, g, or t
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
  modified_base (418)..(418): a, c, t, g, unknown or other
  misc_feature (418)..(418): n is a, c, g, or t
tcagtacagatcgtcacgaccggtgctcgatttagagtatacatattgggttttcctcgttgctcttttaagaggtgtccagtgtcaggtgcagctggtggagtctgggggagcgtggtccagcctgggaggtccctgagactctcctgtgaagcgtctggattcatcttacaataactatggcatgcacgtgggtcccnccgaggcctccgaggacgaaggggctggagttggttgctagttgtgtggtangagtaggaagtaatagatactntgacaagacaccggtggaagggcctattcaccatccgaccaagacgaacaacttaccaaagtaaccttacgttttcgtcctagaacaaagtacgaacacgacctagacggacgacggacgacgacgggataatattacttacgnggtagacggaacgacggacgtaggacgggacgtacccgtacccggatcgacgccgtacggcgggccgacgggccgtacccggtggtccgtccgttcctcgtcgaccgtccacccgaaccgaccggtcccgtacgttccccggtccccgttccccgtaccggtacccctacccccgttacccgaacccgtaaccggaccccgtacccgttacccggtaccgggtcccgggaacccacggtacccggggtccccggg

SEQ ID NO: 39785 - DNA, 254 bp, Homo sapiens
  misc_feature: GYAE6OF01EPX6S.35.67.G01.1.454.CMB.1.raw
  modified_base (246)..(254): a, c, t, g, unknown or other
  misc_feature (246)..(254): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccaccctcctcacgatctgtactgagcgggctggcaaggcgcatagnnnnnnnnn

SEQ ID NO: 39786 - DNA, 695 bp, Homo sapiens
  misc_feature: GYAE6OF01DSP9Y.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcacatggagtttggctgagtcgttgggtttttccctgttgtcttacgttttaaggaggtcgtccagtgtcaggtgcgaggtcgttagggtgggtaggttcggtaggggggacgtcggttcggtccgaggtcccggttaggggacgttccccgtaggacgtaccttccgtcgtaggtacggtacgtcgttcgcggttacttactacttacttacgtaaacttaacgtagtcggtacgagttaccgacgtcgtccgggtcccgaccgtacggtcctaccggagtacgggaaacggtacgttagggtacggtggttcgtagtaggttgtggtagttgtagagtacggtaataagtagtatatgtagactacgacgacgtaggacgtacgtactaccgatacgtacgacacgtacgtaactaacgtaccgaacgttacttacgtttacgtcgtaacgtaacaacgttagaaccgtaccgagtacgacgaccggacgacgacgacgagtaatacgtagtaacgtcgacgtagacggtacgtacgaccgttacggacccgtaaccggtaccgg

SEQ ID NO: 39787 - DNA, 790 bp, Homo sapiens
  misc_feature: GYAE6OF01AQNXX.35.67.G01.1.454.CMB.1.raw
  modified_base (688)..(688): a, c, t, g, unknown or other
  misc_feature (688)..(688): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccagtggtagtttgggctgagcgttgggttttcctcgttgtcttacgtttttaaggaggttgtcctagtgtacgtagggtgcgagtcgtgggtggtacggtcggtggggggaggtccggtcggtccgacggccggtaggggacggttcccgtaggaccgtacttccgtccgttggtacggaacgtcgttcgtaggtacttcctacttacttactaaaattaaccgtagtcggctaagtcggtaccgtaccggtccggggtcccgaccgacgggtccgtacccggaggtaaccgaaggggtaccgtggggtacggttcgggttaggtcgttagggtttggttcggtaggttaagtaggtaacgtaaggtaaaagttaagtagtaacttacgtagtacgacgagaccgtacggacggaacggtcctacgtacgaccttacgtaccaacggtaagaacgttaacgaacgttaaccgaacttaccgtttacgtttccgacgtactaaacgtaagtaacgaactcggtaccgtagaaccggtacgccggaagtaccggacgttanaagttaaccgttggttacgggtagtacgggaacggaacggtaaccgggtcgtaaccgggtccgggtaaacccccgtaccccggacccggttaggaccccggg

SEQ ID NO: 39788 - DNA, 803 bp, Homo sapiens
  misc_feature: GYAE6OF01DAQTN.35.67.G01.1.454.CMB.1.raw
  modified_base (661)..(661): a, c, t, g, unknown or other
  misc_feature (661)..(661): n is a, c, g, or t
tcagtacagatcgtcacgaccggtgctcgatttagagtatacatattgggtttgggggggagaggagcccagcactagaagtcggcggtgttccagtccggtgatcagcactgaacacagaggactcaccatggtagtttgggctgagtcgttgggttttcctgttgtcttacgttttaaggaggttcgtccaggtgtcgagggtgcagtcgtgggtgggtacggtcggtagggggggacggtccgggttcggtacccgacgggtccggttacgggggtaccggttccccgtggtaaccgccctttccgtacgttggacgtaacggtccggttcgtaggtacttacctacttacgttaactaaaacgttacgttagtcggactagtcgaccgttacggtaccgggtcccgaccgacggttcctaccggacggaacggtaaacgggtcggttgggtaagggtttcggggttgaacggtttgggttggttagttaggttaagtggtaaaggtaaggtaaagttaacgtaggtactagtagtcgaacgtacgaacgtaaccgggtagggaaccgttccgacgttaccaaccgtactacccgtaacgaacgaacgtaaaccttacgtaacccgtaaacgtttacctacgtttacgttaacccganaacgtaaacgtcgaactaccggtactaggtaccgacgtacggacgacggtaacccggtataaaccgtttagtagtaccggtgtacggaacggtaggacgtcggaggtaccccgggaccgttccccgaaaccggtgtaccggg

SEQ ID NO: 39789 - DNA, 726 bp, Homo sapiens
  misc_feature: GYAE6OF01DG7E1.35.67.G01.1.454.CMB.1.raw
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (386)..(386): a, c, t, g, unknown or other
  misc_feature (386)..(386): n is a, c, g, or t
  modified_base (480)..(480): a, c, t, g, unknown or other
  misc_feature (480)..(480): n is a, c, g, or t
tcagtacagatcgtcacgaccggtgctcgatttagagtatacatattgggtttgggagaggagcccagcactagaagtcggcggtgtttccatccggtgatcagcactgaacacagaggactcacatggagttgggctgagtcgttgggttttcctcggttgtcttactttaaggaggtcgtccagtgtcaggtgcagcgtgggtggagtcgggtgggggggaggcggttcgggacccaaggtccgttggggacggtcccgtagacgtactcctccgtagtagaagcgttcngtacttcnttcgttaacaaataccgtagtggacagtcgactacgggttcgggccaccgagggtccctacggaagggaccgaagggtcgtagggnggttgggttgacgtgggttgtcgtaggtatgaagtaggtaaagtaatacgataactgtcgaacagaaccgcggaggacggtacgtacgtcaacnctacgacgtaacaacggtaacaacgttaaccaaacgtaacgtttaccttacggtttacctaacgtaataaacgtaacgaaacgtacgaccggtaacgaacgggtaccgaaccgggaacgtaaaccggacgggtaacgtaaattaacgttaacgttacgtacggttacggaacggtaaacggaacgggttacgaaccggggtaaccgggtaacccggtccccccgggttaaaccgggtccggtaagg

SEQ ID NO: 39790 - DNA, 830 bp, Homo sapiens
  misc_feature: GYAE6OF01DPDMY.35.67.G01.1.454.CMB.1.raw
tcagtacagatcgtcacgaccggtgctcgatttagagtatacatattgggttttcctcgttgctcttttaagaggtgtccagtgtcaggtgcagctggtgagtcgtgggggagcgtggtccaggccgtgggacggtccctgagtacctctcctggtagaacgcgttcgtggtacttcattcttacaaaataactagtcggactagtacgccgtacgtccgggtcccgaccgacggtcctacgacgggacgaacgggtagtggggtaggttcggttcggtacgttggttggtacgttagggtagtaggtaaggttaaacgggtaaagttaattagaattacgtaagtacggaacgtacggaaccgtacggtacggtaacgggacctaacttacccaagtactaccgtaaccgaagaacgtaactaacgtaaccgtaaaacgtaactttccgttacgttacaacggtaactaaagtacgaacgtaccgtcggtacgaacgacggacggaacggtaccgaacggtaactaacgttagtaacgtttacggaggtacggaacgtaaggaacggtcgtaacgggaccgggtacccgtaaccccgggttaaccgacggttaacggaccgtaaccggtacgggccgggtaaccgtacgggcccgttaccggtcgggtaccctccgttaccgttcccgtacccgaaccgtacccgtaccaaccccggtaggacccctccggttaacccgtcccccgtaaccgccgtaacccctacctaccggtaacgaccggtaccctaccgtccggtccggaacggtcccgacccggcggttccccgg

SEQ ID NO: 39791 - DNA, 1010 bp, Homo sapiens
  misc_feature: GYAE6OF01CJAOU.35.67.G01.1.454.CMB.1.raw
tcagtacagatcgtcacgaccggtgctcgatttagagtatacatattggggtttgggggggagaggagcccagcactagaagtcggcggtgtttccatccggtgatcagcactgaacacagaggactcaccatggagtttgggctgagtcttgggttttcctcggttcgcttacgttttaaggaggttcgtcctaggtgtcgagggtcgcgagtcgtgggtgggacggtcggtggggggacggtcggtcggtcccgacggtcccggtcgggggtacggttaccccgtaggtaccgtaccttccgtccgtacggtacggtaacggtccggtttaccgtaggttaactttacgtaactttcctttaaactaaaactttaacgtacgtacgggtactacgtcggtaccgtaccgggttccggggtaccccgcccggtaaccggtcccggtaacccggaagggaaccggtaaacgggggtacggttaggggttacgggttggggttacggtacggtttaggtttaggggttacggttaggttagtaaggtaagggtaaggttaaaacgttaaagtacgtaacttaaccggtagttacgaaccgtaacggtaccggtaaccgggtacggggtaacccgggtacccgttacttaaccccccgtaaacgttacccgttaccccgtaaacggtaacgtaaacgtaaacccgtttaaaccgtaaccgttaaaaaccggtttacccgttttaccgttttaacccggttaccaaacggttaaccggtaaacttaaccgggaaactcccgggtaaacggtacgggaaaaccgggacccggtaaaccgggtaaccgggaacccggtaacggttccttaaaaaaggtttacccgtttaaggttttacccgggaacggttaacgggaaaccgggttaaaacggacccgggttagggtaaacccggggtaacccgggggaaaccccccggttccccccggttaaacccggtaagggtaacccgggg

SEQ ID NO: 39792 - DNA, 846 bp, Homo sapiens
  misc_feature: GYAE6OF01B3N3O.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttggctgagctgggttttcctcgttgcttcttttaagaggtgtccagtgtcaggtgcagcgtggtggagtcgtggggggaggcgtggtccaggccgtggggacgtccctgagactcgtcctgtgagcgtctggtattctatcttacaaattaactatggcatcgccacgtcgggtccgccgacggcctaccggagggacgaaaggggtaccgtagggtacggttcgggttacggccgttacgggtttgggtacggttaggtacgttaggtaaggttaaggtaaagttaaagtaagtaacgttaacgtactaggaccgaaacggtaaccgtaaccgggtaacggggaaccgggtacccgtaacgtttacccgaaccttacgttacccgttaaaccgaacggtaaacggaaacccttaaacttaaaccccgaaaaccggttaaaccgttttaacccgttttttccggtttaaccccttaaggtaaaccgttaaaacgttaaccggtaaacccgtcggtaaccccgtaaagggaaccggtaacccggaacccggggtaacgggaaccggtaaccgggtaactaaacggtttaaagtttaccggtttaaccgtaggttacgggtaaacggtaaacgggaaacgggttccgggtaacggtacccgggggaaccccgttaaccccccgggttaaccccgggaagttaacccgggg

SEQ ID NO: 39793 - DNA, 701 bp, Homo sapiens
  misc_feature: GYAE6OF01C5KQ1.35.67.G01.1.454.CMB.1.raw
  modified_base (158)..(158): a, c, t, g, unknown or other
  misc_feature (158)..(158): n is a, c, g, or t
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
  modified_base (672)..(672): a, c, t, g, unknown or other
  misc_feature (672)..(672): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcacatggagtttggctgagctggttttccngttgctcttttaagngtgtcagtgtcaggtncagctaggtggagtcgtgggggagcgtggtccagccgtggggacgtccctagacgacgtctacgtgtacgaagccgttcgtaggtacttcgattcctttacgaaaattaactacgtaggctaagttcgacctaacgttcgggtcccacgacggtcctaccgaggtccgaaaagggtctagggagttcgggttcgcttaggttgttggtggtatggagttaaggaagtaaactacgtagttaacgtagttaggccaaaggtaccctaaccgggtaggaaccggggtaccgtaactttaccaacccgtacgttaccgtaacccaaggaaccgtaacctaaacgttaacccgaaacgttaacttaccgtttcgttaccgtacgtaaccaaagttcgaaacgtacgacgttaacgaggacgtaccggacgaaccggacggtacgtagtaacgttaattcgaggtaccgtaggtaagaaccggtacgnggtaaccgggccgtaccccgtaacccggg

SEQ ID NO: 39794 - DNA, 1056 bp, Homo sapiens
  misc_feature: GYAE6OF01D7QMI.35.67.G01.1.454.CMB.1.raw
tcagtacagatcgtcacgaccggtgctcgatttagagtatacatattggggtttgggtctggggagaggacgcccagcactagaagtcgggcggtgtttccagtccggtgatcagcactgaacacgaggaggtacctcaccgtagttggggtagtttgggctggacgtcgtttcgggttttcctcggttcgtctttagttttaaaggcggttcgtaccgtaggttcgttccggagggttcgcgtagggttcggttagggggtgggtaggttccggggtaggggggggtacgttccgggttaccgggtaccggacggtcccgggttagggggtacccggttcccgtagggtaacctccggtttccgtaccgggttaggttaacgggtacggttccgttacgggttacgtttaccgtttacctacgtttaacccgttttaaacgaaactttaaacggttacggtaccggtaacgttaacgttaccggggtacccgttaaccccggggttccggggtaaccccggtaccggtaaccgggttaccccgtaccggggtaaaccgggacgggttaacggggttaacgggttggggtttaaccgggtggggtttacgggtacggtttacgggttttcggggttagggttaagggtttaaccggggttaaaggttaaggggttaaacggttaaaaacgggtttaacgtaacgttttaaaccgggttaacttacgggttaaccggtaaccggtaaccgggtaaccgggtacccggggttaaggggttaacccgggtacccggtttaacttaacccgtaccgttaaccgttaaccggtaccggtaacggtaacccggtaacctttaaaccggtaacccttaacggtacctttaccggtttagtaaccgttagaacgttaactaccgacgtacgtaacggacggtaccggaccgtaaggacccggacgtaccggtaagtaaccgtttaagttccggtaacgtcgggaacgttaacggaacggtacggtacgtaagggtaccccgggttaaccgcccggtaaaccggg

SEQ ID NO: 39795 - DNA, 764 bp, Homo sapiens
  misc_feature: GYAE6OF01CVU9I.35.67.G01.1.454.CMB.1.raw
  modified_base (594)..(594): a, c, t, g, unknown or other
  misc_feature (594)..(594): n is a, c, g, or t
  modified_base (639)..(639): a, c, t, g, unknown or other
  misc_feature (639)..(639): n is a, c, g, or t
  modified_base (665)..(665): a, c, t, g, unknown or other
  misc_feature (665)..(665): n is a, c, g, or t
  modified_base (746)..(746): a, c, t, g, unknown or other
  misc_feature (746)..(746): n is a, c, g, or t
tcagtacagatcgtcacgaccggtgctcgatttagagtatacatatttgggtttgggggggggtcacaagaggcagcgctctcgggacgtctccaccatggcctggctctgctgctcctcactctcctcactcaggacacgagggtcctgggcacagtctcgccctgactcacgcctcggcctccggtcgttcgtcgggtcctccgtggactacgtcgactccacctacttcctacctcgacacgtacggaacagcgaggtacgtaggtttggggtttacggggttactacgttaccgttttcgtccgtttccggttacggttaacctaaccgaaaccgaccggtaacccaccccggtaaccggaaacccgtaaaccccgtaaaccccccttaaaaacgttttaaccgtttttaaaaacgtttaaacgttaaaaccgggtaaacctaaaccggtaaacccgggtaccccgtaaccccttaacgggtaaccggttttaactttaccgttaaacgttccggtttacctttcccgtacggttaccggccttaaccggacgttccggtacgtaccgtaccgtccgtaccctaccgtanaactacttccggtcggtccgtccggtcgacggtgaacggcggtgnttcgtaatttcgttatggtctcttanagtagtgtacggtagtcgactctagtatcgtaagtcgacgtacgaccgtacgatgtacgtcgacgcaaccgacccggaacnccacccttagcgttaccc

SEQ ID NO: 39796 - DNA, 904 bp, Homo sapiens
  misc_feature: GYAE6OF01BMDU1.35.67.G01.1.454.CMB.1.raw
tcagtacagatcgtcacgaccggtgctcgatttagagtatacatattgggtttgggggggagaggagcccagcactagagtcggcggtgtttccatccggtgatcagcactgaacacagaggacctcacctagtggtagtttgggctggagtccgtttagggttttcctcgtttagtctttacgtttttaaacggacggttcggtaccctagggttcgttaccgagggttcgacgtaagtcgttgggtcggtagggtcggtggggggacgtcggtcggtaccaggtcccggtcggggtacgtccccgtaggacctaccgttcccgtccggttaggtacggaacgttccgtacggttacgggtacttttaccaaccgttttccttaaacctaaagttaaaccgttactttacgggacctaacgtccggtacccgttacccggggttgggggtaccccccgtaaccgtccggggacccttaacccggggaacggggtaacccgggtaacggggtaggtttggggaaacgggtttcggggtttcgggaagttttccggggttgttggggggttaaaccgttaaggtgggttaaaccgggttaaaggttaaaaggaccgttttaaaggtacctttaccggtaaggtacccccgtaaggtaacggtaaacccggtaccgggtaaagggttaccggtaccctttacgacccgtacgttaacctacccgacggtaactaactaaccgtaacgtacgtaactaacgtttccttaacggttcagtaccaaggaactacgtacgcgtagaccgtagaccggagccgacgtagtaactgttacgtagtacgaacggtacgaacggtacggtaggaccggtacgggtaaccccgtcccggtccgggtagtaccggg

SEQ ID NO: 39797 - DNA, 700 bp, Homo sapiens
  misc_feature: GYAE6OF01AUGPS.35.67.G01.1.454.CMB.1.raw
  modified_base (159)..(159): a, c, t, g, unknown or other
  misc_feature (159)..(159): n is a, c, g, or t
  modified_base (173)..(173): a, c, t, g, unknown or other
  misc_feature (173)..(173): n is a, c, g, or t
  modified_base (322)..(322): a, c, t, g, unknown or other
  misc_feature (322)..(322): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcgtggttttccncgtgctctttaagnggtgtcagtgtcaggtgcagctggtcggagtcgtggggagtcgtggtccagccgtgggacgtccctgacgactcctcctgtgaacgcgtactggacttccattccttacaaagttaactgtggacagttgacctaacggtcgggtaccnccaggtccaccgagggtacgaaagggtctgggtagtcgggtaacgtctaggttgtcggtagtataggaagttcgggaaaataagacgtaacttacgtgtagggacctaacgggtacaacccgggtagggtaacgggtaccgtacttaccgaacgtaacttcccgtaacgagtaacgtaacctaacgtacctaaacgtaccttaaccgtttcgttaaccgagtaaccctaaagtgaacctacggtacctagggaccgtaacggaccggtacgtaaccggacgacgtaaacgttaacgttaacgtacgttacggaacggcggtaaaggaccgtacggttaacggacggggtacccgtccccgtaacccgggtataccggg

SEQ ID NO: 39798 - DNA, 795 bp, Homo sapiens
  misc_feature: GYAE6OF01A7R3O.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggtagtttgggctgagcttgggttttcctcggttgcttcttttaaggaggttcgtccaggtgtcgaggtcgcaggctgggtggtacgtcggtaggggggacgtcgtcgggtccagtccgtggggacggtccctggacgtaccttccgtccgtggtacgaagtccgttcgtaggtacttactactttaccttacctaaaagtttaaccgtagtcggtacctagtcgccggttaccggtttccggggccccgtaccgtaacgggtacctacccggaacgggtaccggtaaacgggtaccggttaggggtaacggtttcggggtttacggaccggtttaggtttcgggtacggttaggttaacgtagggtaggttaaaggaaagtttaacgtaagtacgtaactagtaccgtaacgacggtaaccgtaaccgggttagggaaccgggtacctaaccgttacctaccgacgttaccctacgaaacgtataaccgtaacgttaaccaacgtaaccgttcgtttaccgtcgtaacgtaacgtaacgtacgaacctacgacgtaacgaccggtacgaccgggacgacggtaccgtagtaatacggttactcggtagacggtcgaagtacggcggtaacgtcgggtaacccacccccggtggtacgtaccg

SEQ ID NO: 39799 - DNA, 852 bp, Homo sapiens
  misc_feature: GYAE6OF01EM8UK.35.67.G01.1.454.CMB.1.raw
tcagtacagatcgtcacgaccggtgctcgattttttagagtatacatattggggtttggggggggtcacaagaggcagcgctctcgggacgtctccaccatggcctgggctctgctgctcctcactctacctcactcaggacacgtagggtcctgggcacgagtctcgcctgactcacgcctgcctcgtgtcgtcggtctccgtggacagtccgatcacctattcctccgtagcctaacgttacgggaaccacgcgaacggtcggtaggttggggtttacggggttattacgtccgtttcgtccgtccggttaggtaactacaaaccgtacgaccccgaaccgaacggtaacccaaaaccccgtaaccccttaaacttttaacggtttaaacgtttaaacgtaaacgggaacctaaccgtaacgcccgtaacccgtaggtaacggttaacttacgtaactccgttcttccgtactcgggtaccttaaccgtacggtcgtaccgtaccggtaaccgcccgttacccgtacccgttaacgaaccttaccgttccggtcgggttccgggtcccggtaacgggacccgttaggggtaaaccgggacgtacgggttacttaaggtttaacttttggttttaacgtttcggttactactaacgtttgttaacgggtaccgaaggtttaagggttaacctagtaaaccgtttacggttaggtttaaacccggtccgtttaaaacgggaccggttacccggaaaccggtcggtttaacccgaacccggttactacgggtaacctaaccccgaacccgaaacccgttaaccccgaactttcgggtaccctccgttaacccg

SEQ ID NO: 39800 - DNA, 813 bp, Homo sapiens
  misc_feature: GYAE6OF01ELSW6.35.67.G01.1.454.CMB.1.raw
tcagtacagatcgtcacgaccggtgctcgatttagagtatacatattgggtttggggggggagaggagcccagcactagaagtcgggcggtgtttccatccggtgatcagcactgaacacagagactcacatggtagttgggctggagtcgttcggggttttcctcgttgtctttcgttttaaggaggtcgtccgaggttgtcgagggtcgctaggtcgttagggtgggtaggttcgggtggggggacggtcggtcggtccgacggtccggtgggggtaccgtcccgtggaccgtaccgttccgttcgtaggtggaacggtccgttcgttaggtacttacgtatttaccttaactaaattaaccgtgtaggtactaggtcgaccggtacggttccgggcccgaccggtaacggtcccgtaccggaagggtaccggtaacggggtcggttaggggtaacgggttgggtttcggtaggtttaggtttgggttacggtaggtttaacgtagggttaagttaaaggggttaaaactttaaagtaaggttaaacttagttaaacggtcgtaaacgaccggtaaacggttaaccgggtacgggtaccgggtaccttaactacccgtactacgtacccgacgaaacgtacgaacttaactaaccgtaacgtaccgtttcgttcgttacgaactacgtaaagtcgacctaaggccgtagaaccggacgaccgaggactacggtatacgttaagtacgtacggtgtacgaaggacggtacgacggtacgggaccgtaacccggtacccggacgtcggaacgg

SEQ ID NO: 39801 - DNA, 801 bp, Homo sapiens
  misc_feature: GYAE6OF01BFFQD.35.67.G01.1.454.CMB.1.raw
  modified_base (384)..(384): a, c, t, g, unknown or other
  misc_feature (384)..(384): n is a, c, g, or t
tcagtacagatcgtcacgaccggtgctcgatttagagtatacatattggggtttgggtctgggagaggagcccgagcactagaagtcggcggtgtttccatccggtgatcagcactgaacacaggagactcaccatggtagtttggctgagcgttgggtttcctcgttgcttacttttaaggagtcgtccgtagtgtccgtaggtgctaggtcgtgggtacggtaggttacgggtcgggggacggtcggttcgggtcccaggtccggtaggggtacgtcccgtagacgtcctctacgtgtaggagtccgttcgtggtacttccgattcgttactaaacgtacttacgtggactagtccggtaccggtaccgtcggggttacccncggacggtcctaccggagggtaaccggacggggtacttaggggtacgttgggttacgtcggttaaggtttcgggtaggtttagggattagggaaggtaagggttaaaacttagtaacgtaacgtttaaactcggttaccgaagttaaccggacgtacgggtacggtacggtaccgtacgtacacccgtactccgtacgtacgacgtacctaacgttaacgaaacccttaacgttactttaccggttaacctacggtaaactacgaaccgtaacgtaccgtacggttaggaaccgggtacccgggacggtaacgggtaccggtaacgtacctaacggttacgttaaccgttcggtacggtaggaacgaacgggtaaggccgggtaacggtcccgggaacccggttccccggtaacggg

SEQ ID NO: 39802 - DNA, 690 bp, Homo sapiens
  misc_feature: GYAE6OF01CDE15.35.67.G01.1.454.CMB.1.raw
  modified_base (180)..(180): a, c, t, g, unknown or other
  misc_feature (180)..(180): n is a, c, g, or t
  modified_base (200)..(200): a, c, t, g, unknown or other
  misc_feature (200)..(200): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (372)..(373): a, c, t, g, unknown or other
  misc_feature (372)..(373): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
  modified_base (443)..(443): a, c, t, g, unknown or other
  misc_feature (443)..(443): n is a, c, g, or t
  modified_base (511)..(511): a, c, t, g, unknown or other
  misc_feature (511)..(511): n is a, c, g, or t
tcagtacagatcgtcacgaccggtgctcgatttagagtatacatattggggtttggggggggagaggagcccagcactagaagtcggcggtgtttccatccggtgatcagcactgaacacagagactcaccatggagtttgggctgagcgttgggttttcctcgttgtcttcttttaagnggtcgtcctagtgtcaggtncagtgtcgggtggagtcggtggggggagtcgtcggtccacgccggttggggacggttcccgtgaacgtacttccgtcctggtacgaacgtcggttcgtggtacttctattccttacaaattaactgtagctgtcgctacggtcggtccncgtgtccncggacgacgaagggnnggtgtcggttgcgtgtgtgtgtgngtagtagtaagtatatataatntgacgagaccgtggacggaacggngtaacctcgactcgtccaccgagtaacaactaacgtaaccaacggttaacctacgtttcgtacgtaanaaacctaatacgaacgacgtacgtaggtaacggccggtaaccgggtaagaacccggtaagggtaaccgttaaacgttagttaaccgttaacgtacgggttaaggacgggtaaaggtacccgaacgggttaacgggtccgggaacccccggaccccggttaaacccggtggtaaccccgg

SEQ ID NO: 39803 - DNA, 628 bp, Homo sapiens
  misc_feature: GYAE6OF01AD5ZA.35.67.G01.1.454.CMB.1.raw
  modified_base (179)..(179): a, c, t, g, unknown or other
  misc_feature (179)..(179): n is a, c, g, or t
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
  modified_base (501)..(501): a, c, t, g, unknown or other
  misc_feature (501)..(501): n is a, c, g, or t
  modified_base (518)..(518): a, c, t, g, unknown or other
  misc_feature (518)..(518): n is a, c, g, or t
  modified_base (543)..(543): a, c, t, g, unknown or other
  misc_feature (543)..(543): n is a, c, g, or t
  modified_base (574)..(574): a, c, t, g, unknown or other
  misc_feature (574)..(574): n is a, c, g, or t
tcagtacagatcgtcacgaccggtgctcgatttagagtatacatattgggtttgggagaggagcccagcactagaagtcgcggtgtttccatccggtgatcagcactgaacacagaggactcaccatggacgtttgggctggagtcgttggttttcctcgttgtcttacgttttaaggngttgtccgagttcgtcgtaggtgctagcgtggtacggtagtcggtggggattcgtcggtccagccgtgggacgtcctgagtctcgtctgtgacgtctcgtagtctcgatcctaagaatagtcgtganactggcctacggttcggaccncgtacgtcncggaggacgaggtcgtcggtagtgttaagcgttagtcgtaaggttgatgtaaagnggttaaagtagatagtactgngtaacgacgttacgaccggtaggaccggtagtctaccgattacgatacccggaatacggtaactctaacggaataccttagttcgtcanacacgttgaacctacgntacgaactcggaacgacgtaaccgngtacgtacttacgttacgtcgagttacccgngaacgggtaccgtacggaggtttacccggacccaaccggtaccggtaagtcggg

SEQ ID NO: 39804 - DNA, 673 bp, Homo sapiens
  misc_feature: GYAE6OF01ER99W.35.67.G01.1.454.CMB.1.raw
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (314)..(314): a, c, t, g, unknown or other
  misc_feature (314)..(314): n is a, c, g, or t
  modified_base (456)..(456): a, c, t, g, unknown or other
  misc_feature (456)..(456): n is a, c, g, or t
  modified_base (506)..(506): a, c, t, g, unknown or other
  misc_feature (506)..(506): n is a, c, g, or t
  modified_base (543)..(543): a, c, t, g, unknown or other
  misc_feature (543)..(543): n is a, c, g, or t
  modified_base (603)..(603): a, c, t, g, unknown or other
  misc_feature (603)..(603): n is a, c, g, or t
  modified_base (664)..(664): a, c, t, g, unknown or other
  misc_feature (664)..(664): n is a, c, g, or t
tcagtacagatcgtcacgaccggtgctcgatttagagtatacatattgggtttggggggggtcacaagaggcagcgctctcgggacgtctccaccatggcctgggctctgctgctcctcactcctcctcactcgaggacacgaggtccgtaggcactagtctcgcctgtactcacgcctgcctccgtgtcgtcggtctccgtggacaggtacactccacccgtatccttaccgcgccgttacgacgaaccancgagngtaggttgggtttacggggttatacgtacgttcgtaccttccgagttacacacgacnccacgacgaccgaaaccaccctaattacttaagttacgaaacacctacgacgtaccgaccctagtacggttacttaccaactcgtacttcgtacgcgtactacgtacggtacgtcgaacctacgtcccgtacctacccgtanaaacctcttcggtaccgtcgggtaccgtcgggactaaggacgtaaccggngtttaccaggtttaactttagtagttcgttcacttanacgtaagcgtaacgggttaatcgtaacacgtttacgagttaccgttacggcggtaaccgngtaaccgtaacggtccgagtacgacggacccgtacgaacccgttaccgaacccctgtaccnggtctaccg

SEQ ID NO: 39805 - DNA, 685 bp, Homo sapiens
  misc_feature: GYAE6OF01BVEKO.35.67.G01.1.454.CMB.1.raw
  modified_base (498)..(498): a, c, t, g, unknown or other
  misc_feature (498)..(498): n is a, c, g, or t
tcagtacagatcgtcacgaccggtgctcgatttagagtatacatatttgggtttgggtctgggagaggagcccagcactagaagtcggcggtgtttccatccggtgatcagcactgaacacagaggactcaccatggagtttgggctgagcttgggtttttcctcgttcgtcttacttttaagaggtgtccagttgtcaggtgcagcttgggtgggagtcggtggggggaggtcggtggtccgacggcccgtgggggacggtcccgtggacgtaccttcgttcccgtggtacggtaacggtcgttccgtaggtactttcgattcttactaaataactagtggctatcggcacggttcgggtccgccgacggtcctccgaggacgaaggtacggtcggtaggtcggttcggacgttaggttggtacggtgttagtagtaggtaggtaaagtaagtagatagtagagacacgacgtacgaggacggtaccgtactacacnctacaccgagacaactaacgtaaccgaaacgtaccttacgtttctaccgtacgaactaacgtacgaacgtacgtacctagacggacgaccggaacggaacgaccggtaacgtagtacgttatacggttcgaacgtacggaacgtacggtacggtaggacccggtaaccggtacccccgtaacccggg

SEQ ID NO: 39806 - DNA, 718 bp, Homo sapiens
  misc_feature: GYAE6OF01AQKZF.35.67.G01.1.454.CMB.1.raw
  modified_base (260)..(260): a, c, t, g, unknown or other
  misc_feature (260)..(260): n is a, c, g, or t
  modified_base (326)..(326): a, c, t, g, unknown or other
  misc_feature (326)..(326): n is a, c, g, or t
tcagtacagatcgtcacgaccggtgctcgatttagagtatacatattgggtttgggggggggtcacaagaggcagcgctctcgggacgtctccaccatggcctgggctctgctgctcctcactctcctcactcaggacacgagggtcctgggcacagtctcgccctgactcacgcctcgcctccggtgtcgtcgggtcctccgtggacagtcgatcaccactctcctcgcacgtcggaaccagcaggtgtacggttggtnctgaattactatcgtctcctacgtaccaacaccaccagaccaaccgcccaactgatagtattagtntatcgtactacgtacgtcgcccgtggtacggtttactacgtcgttcttgtcctcgtaccttacaacgttcggtaccgacgaaccgtccccggtacccttacccggtaagaccctacgtttccgtcgggttacccgggtccctccggtacgcgggttaacccgaccggtaacgggtacggttacttacggtttaacgtttaacgtaccggcctaaccgtcgttaacccgttctaaaccgttaaccgtaacccgaaacgtaccggtacccaagttccctaaccggttccgggttaccgtcccggggttccggggaaccggtaccggaaacccgtccggtaacggtaccccggttacgttaccgggtacccgtacgaccccggtaaccggtaccg

SEQ ID NO: 39807 - DNA, 630 bp, Homo sapiens
  misc_feature: GYAE6OF01ER6T6.35.67.G01.1.454.CMB.1.raw
  modified_base (183)..(183): a, c, t, g, unknown or other
  misc_feature (183)..(183): n is a, c, g, or t
  modified_base (202)..(202): a, c, t, g, unknown or other
  misc_feature (202)..(202): n is a, c, g, or t
  modified_base (440)..(440): a, c, t, g, unknown or other
  misc_feature (440)..(440): n is a, c, g, or t
  modified_base (485)..(485): a, c, t, g, unknown or other
  misc_feature (485)..(485): n is a, c, g, or t
  modified_base (498)..(498): a, c, t, g, unknown or other
  misc_feature (498)..(498): n is a, c, g, or t
  modified_base (524)..(524): a, c, t, g, unknown or other
  misc_feature (524)..(524): n is a, c, g, or t
  modified_base (621)..(621): a, c, t, g, unknown or other
  misc_feature (621)..(621): n is a, c, g, or t
tcagtacagatcgtcacgaccggtgctcgatttagagtatacatattggggtttgggggggagaggagcccagcactagaagtcggcggtgtttccatccggtgatcagaacactgaacacagaggactcaccatgggagtttgggctggagcttgggttttcctcgttgcctagttttaagnggtgtccagtgtcaggtgnagctgggtggagtcgtgggggagcgtggtccagccgtgggacgtccctgacgtcctctcgtggtagaacggtcgtcgtggaactttcattacttacaaataactatcggactatcgcctacggttcgggacccacgaagggtcctaccggaggacgtaaacgggcttgggaacgttgggttgaacgtggttggtagtaggtaagtgtaagttacgggaaaataactagtaatacgtangacaagacgtaccggaggaagggactacgtcacgactcgacaganactaagtacaaanactacttacgtactacgacaaagtanaacacgctacgagacgaccgaggacacggataacgtattacgtacgtaggtagacggaagtacgacggtaagtcgggaacctacccggtaaccccgngtaaccggg

SEQ ID NO: 39808 - DNA, 776 bp, Homo sapiens
  misc_feature: GYAE6OF01EQ9I4.35.67.G01.1.454.CMB.1.raw
  modified_base (180)..(180): a, c, t, g, unknown or other
  misc_feature (180)..(180): n is a, c, g, or t
  modified_base (199)..(199): a, c, t, g, unknown or other
  misc_feature (199)..(199): n is a, c, g, or t
  modified_base (761)..(761): a, c, t, g, unknown or other
  misc_feature (761)..(761): n is a, c, g, or t
tcagtacagatcgtcacgaccggtgctcgatttagagtatacatattgggtttgggtctgggagaggagcccagcactagaagtcggcggtgttccatccggtgatcagcactgaacacagaggactcaccatggagtttgggctgagtcttgggttttcctcgttgcttcttttaaagnggtgtccagttgtcaggtncgagcgtgggtggagtcggtggggggagtcggtggtaccagtccgtgggacggtcccctagacgacttctcctggtacgacgtcgttacgtggtaacttcctaatttccttaacgaaatttaaacctaggttcggacctaagtttcgacctaacgggtccgggttacccgacctaggggtccctaaccggagggtaccggaaaagggtccgttagggtggttcgggttaggtcgtaggtttcggtaggtggttaattggaaggttcgggtaaaagtaagtcgtaacttacgttaactacgaaccgtacgaaccgtaccggtaacggtaaacgggtccctaacgtttcccgaaacccgttactccgtaaccgaacggttacgtaacctaaacctttaaccgaagttaacccgtttaccgttttaacgttcccgaataaccgtaagtaacgtaaccgaacgtacggttaagacggtaaccggaacggacggaccgacggggaatacgtttagtacttacgggtgtacggacgaaacggtcgaacggtacgggtaccgggacccnccggtaaaccccggg

SEQ ID NO: 39809 - DNA, 832 bp, Homo sapiens
  misc_feature: GYAE6OF01AELED.35.67.G01.1.454.CMB.1.raw
  modified_base (146)..(146): a, c, t, g, unknown or other
  misc_feature (146)..(146): n is a, c, g, or t
  modified_base (185)..(185): a, c, t, g, unknown or other
  misc_feature (185)..(185): n is a, c, g, or t
  modified_base (476)..(476): a, c, t, g, unknown or other
  misc_feature (476)..(476): n is a, c, g, or t
tcagtacagatcgtcacgaccggtgctcgatttagagtatacatattgggtttgggggggagaggagcccagcactagaagtcggcggtgttccagtccggtgatcagcactgaacacagaggactcaccatgggatttgggctgngtcttggggttttcctggttgcgtttacgttttaaaggnggttcgtcctaggttcggttactaggggttcacaggtcctggggtacgcggtaggttcggtgggggggaccgtcgtggtttccgaagtcccggttaggggaggtttccccaggaccgacgtcctccgtggtacaacgtcctggtgtacttctcctacgtaacgtaacgtactcggtatagtccgactacggtcggtaccgcgccggaccggttaccgacgggtaccgaacgggggtccgttaaggggtagggtcgggttccggtaggacggttaacggagtttaaccggtntttaaggggtttacgtaaaggttaaggggtaaattaaaacgtaaaggtaacgtttacccggaacggtaaccgtttaaccggcgggttaacccgggtaacgggggttaccttaacgttaccaacccgtaccggtttaaccttacccgtaaacggaacgaacctaacgttaaccaaaccggtaactaaccgtacttacgaccctttggactacgactaacgagtacccgtagttccgaacgttccggaggtaaacgacggtacgttacgttacttacgttaaccggtttagtaccgggttacttacgggaaagttacgtaaaccggttaaggtaaacgtcggtttaagtcccggtaag

SEQ ID NO: 39810 - DNA, 677 bp, Homo sapiens
  misc_feature: GYAE6OF01BNU8M.35.67.G01.1.454.CMB.1.raw
  modified_base (381)..(381): a, c, t, g, unknown or other
  misc_feature (381)..(381): n is a, c, g, or t
  modified_base (663)..(663): a, c, t, g, unknown or other
  misc_feature (663)..(663): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgacgactctcctgtgaagcgtctggatttcattcttacaataactatggcatgcacgtcgggtccgccagggcctccgaggcgaagggctgggagtggttgcgaggttgtgtgtatgagtaggaagtaatagatactatgcgaacgaccaccgtaggaacggggacctacttccacctaattccgtaccgagaacggtaactaacgttaccgaaacgtaaaccttacttttacgttaccgtanaactaaacgtacgaaaccagtacctagacggacgaccggaaggaccacgggagtaatagttaactaccgttggacgacggaggaacgacggtagtacggggacgtaccccgtacccggaagtcggacgaccggtacggtccgggccgacgggccctaacccggttcggccgtacccgtctccgttacgacgtccctacccgaccgacggccctacgtcccgtcccttccccgtcgccctaccccgtctaccgaccgtcgacccgtcgtcgggtcgggacccngcccggtacccggg

SEQ ID NO: 39811 - DNA, 920 bp, Homo sapiens
  misc_feature: GYAE6OF01BMRVZ.35.67.G01.1.454.CMB.1.raw
  modified_base (63)..(63): a, c, t, g, unknown or other
  misc_feature (63)..(63): n is a, c, g, or t
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (834)..(834): a, c, t, g, unknown or other
  misc_feature (834)..(834): n is a, c, g, or t
tcagtacagatcgtcacgaccggtgctcgatttagagtatacatattggggttgggggggganaggacgcccagcactagaagtcggcggtgtttccagtccggtgatcagcactgaacacagagacctcacagtgggtagttggctgacgtcgtttcggtttcctgttagtctttacgtttaaggnggttcgtactaggtggtacngggtcgcgtacggtcggtgggtaggtaccggtcgggggtgggggacggtcggtcggtccgacgggtccgggttcggggtacctcccggtagaaccgttcccgttaccttcgggtaggtaacggtcggtccgttcgttaggtacctttacttacttaaccgttttagaaaactttaaccgtggacggtaactacggtttcggaccgttacccggggttaccgggggtacccccaaccgggtaccgggtccggtaaacccggggaggggtaaaccgggtaggggttaccgggtacgggtaagggttttcggggttgggtaaacttttggggggtttacttggggtttaagtacggttaacgggtaaaagggttaaccggaaagttttaaaggtacccggttaaattaccgggtagtaaacccgtaaggggtaaccccgtaacgggtaaccggggaaccgggtaccggttacgtaaaccgttccgaaccccgtaccgttacgaaccgttaaggaaacctaaccgttacgtaaccgtaacttaccggttactttccggacttacgaaacttacggaacacggttacgcgttacggaacggtccgaagtcggacgtaacggtataccgttanacggttacgtaggacggtacggtacggaccggtacggttaccgggaacccgggtaaccccggttacggtaaccgggtcgacccggg

SEQ ID NO: 39812 - DNA, 702 bp, Homo sapiens
  misc_feature: GYAE6OF01D9FUG.35.67.G01.1.454.CMB.1.raw
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
tcagtacagatcgtcacgaccggtgctcgatttagagtatacatattgggtttggggggggagagggagcccagcactaggaagtcggcggtgtttccatccggtgatcagcactgaacacagaggactcacatggagtttgggctgagcgttgggttttcctcgttgcttactttttaaggaggtgtcctaggtgtcgaggtgcagcgtgggtggagtcggtggggggnggcgtggtccaggccgtgggacggttcccngacgcctctcgtgtaggagtccgtntggtattccgattcttaactaattaacctgtgggacctagttcgaccgtaacggtccggggaccccgtcgacggtcccttaccggaacgggtacggtaaacggggtacgttggggtaacggttggggtttcggagttaagggttttggtacgggttaggttagtaggtaggtaaggtaactaaggtagtacttacgtatcgacaggtaccgacggtacgggacggtcctactacactactccacgagacaactactacgaactacttagtttcncgtanactaanacgacacgacgtagaacggacgccggacgacggtacgtactaagttacgtaacttacggtcggtaaggccgtaaggaaccggtacgggtacggtaacgggaacccgttccccggtaacccggaggtaccggg

SEQ ID NO: 39813 - DNA, 619 bp, Homo sapiens
  misc_feature: GYAE6OF01A5YDM.35.67.G01.1.454.CMB.1.raw
  modified_base (140)..(140): a, c, t, g, unknown or other
  misc_feature (140)..(140): n is a, c, g, or t
  modified_base (215)..(215): a, c, t, g, unknown or other
  misc_feature (215)..(215): n is a, c, g, or t
  modified_base (388)..(388): a, c, t, g, unknown or other
  misc_feature (388)..(388): n is a, c, g, or t
  modified_base (507)..(507): a, c, t, g, unknown or other
  misc_feature (507)..(507): n is a, c, g, or t
  modified_base (519)..(519): a, c, t, g, unknown or other
  misc_feature (519)..(519): n is a, c, g, or t
tcagtacagatcgtcacgaccggtgctcgatttagagtatacatattggggggaggcgtggtccagcctgggaggtccctgagactctcctgtgaagcgtctggattcatcttcaataactatggcatgcactgggtccnccaggcctccaggcaagggactggagtgggttggctaggttgtggtggtatgtatggtaataatagatactatgnagacaccggtaggaacggccgattccaaccattccaccagagacaacttaccaacgtaactacgtttcgttccctagtaccaaaagttacgaactacgccgtacgagacggccgtacggacgacgagatatattacgtgtgacgagaagcgagcggacgacccgtacccggtnagacgtacgacggtcggggaccgtcggccgtaccggtcggtcccgtccgttcctcgtccacgtaccctcccgaaccgtaccggccctacgtcccgttccctccccggtcgcccgtcccncctacacgaccncgtccgcgcggacacgcggccgtcggcgtccgtcgtccgtcgtacgaaccgtcttaccgactacgtctcgtacgtcgtcggacggtccggacggtgacgg

SEQ ID NO: 39814 - DNA, 243 bp, Homo sapiens
  misc_feature: GYAE6OF02HDCDX.35.67.G01.1.454.CMB.1.raw
  modified_base (240)..(243): a, c, t, g, unknown or other
  misc_feature (240)..(243): n is a, c, g, or t
tcagtacagatcgtcacgaccggtgctcgatttagagtatacatattgggttgggttggtggtctccactcccgccttgacgaggctgattattattgttgctcatatgcaggtagtagcactaatgtcttcggaactgggaccaaggtcaccgtcctaggtcagcccaaggccaacccactgtcactctgttcccgcctcctcacgatctgtactgagcgggctggcaaggcgcatagnnnn

SEQ ID NO: 39815 - DNA, 243 bp, Homo sapiens
  misc_feature: GYAE6OF02HHJS4.35.67.G01.1.454.CMB.1.raw
  modified_base (240)..(243): a, c, t, g, unknown or other
  misc_feature (240)..(243): n is a, c, g, or t
tcagtacagatcgtcacgaccggtgctcgatttagagtatacatattgggttgggttggtggtctccactcccgccttgacgaggctgattattattgttgctcatatgcaggtagtagcactaatgtcttcggaactgggaccaaggtcaccgtcctaggtcagcccaaggccaacccactgtcactctgttcccacctcctcacgatctgtactgagcgggctggcaaggcgcatagnnnn

SEQ ID NO: 39816 - DNA, 246 bp, Homo sapiens
  misc_feature: GYAE6OF02HS4YD.35.67.G01.1.454.CMB.1.raw
  modified_base (243)..(246): a, c, t, g, unknown or other
  misc_feature (243)..(246): n is a, c, g, or t
tcagtacagatcgtcacgaccggtgctcgatttagagtatacatattgggtttgggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccgccctcctcacgatctgtactgagcgggctggcaaggcgcatagnnnn

SEQ ID NO: 39817 - DNA, 249 bp, Homo sapiens; identical to SEQ ID NO: 39570
  misc_feature: GYAE6OF02G8RO1.35.67.G01.1.454.CMB.1.raw
  modified_base (246)..(249): a, c, t, g, unknown or other
  misc_feature (246)..(249): n is a, c, g, or t

SEQ ID NO: 39818 - DNA, 248 bp, Homo sapiens
  misc_feature: GYAE6OF02HAIRC.35.67.G01.1.454.CMB.1.raw
  modified_base (241)..(248): a, c, t, g, unknown or other
  misc_feature (241)..(248): n is a, c, g, or t
tcagtacagatcgtcacgaccggtgctcgatttagagtatacatattgggttgggtttggtggtctccactccgccttgacgaggctgattattattgttgctcatatgcaggtagtagcactaatgtcttcggaactgggaccaaggtcaccgtcctaggtcagcccaaggccaacccactgtcactctgttcccgccctcctcacgatctgtactgagcgggctggcaaggcgcatagnnnnnnnn

SEQ ID NO: 39819 - DNA, 269 bp, Homo sapiens
  misc_feature: GYAE6OF02I81YR.35.67.G01.1.454.CMB.1.raw
  modified_base (246)..(246): a, c, t, g, unknown or other
  misc_feature (246)..(246): n is a, c, g, or t
  modified_base (248)..(269): a, c, t, g, unknown or other
  misc_feature (248)..(269): n is a, c, g, or t
tcagtacagatcgtcacgaccggtgctcgatttagagtatacatattgggtttgggggtgtggtggtctccactcccgccttgacgaggctgactattactgtcagtcttatgactggtagcaagtatgtggtcttcggcggagggaccaagctgaccgtcctaggtcagcccaagactgccccctcggtcactctgttcccgcctcctcacgatctgtactgagcgggctggcaaggcgcatagnannnnnnnnnnnnnnnnnnnnnn

SEQ ID NO: 39820 - DNA, 249 bp, Homo sapiens
  misc_feature: GYAE6OF02JCC60.35.67.G01.1.454.CMB.1.raw
  modified_base (245)..(249): a, c, t, g, unknown or other
  misc_feature (245)..(249): n is a, c, g, or t
tcagtacagatcgtcacgaccggtgctcgatttagagtatacatattgggtttggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnnn

SEQ ID NO: 39821 - DNA, 189 bp, Homo sapiens
  misc_feature: GYAE6OF02G6E2D.35.67.G01.1.454.CMB.1.raw
  modified_base (170)..(189): a, c, t, g, unknown or other
  misc_feature (170)..(189): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcgggctggcaaggcgcatagnnnnnnnnnnnnnnnnnnnn

SEQ ID NO: 39822 - DNA, 247 bp, Homo sapiens
  misc_feature: GYAE6OF02HO3QR.35.67.G01.1.454.CMB.1.raw
  modified_base (244)..(247): a, c, t, g, unknown or other
  misc_feature (244)..(247): n is a, c, g, or t
tcagtacagatcgtcacgaccggtgctcgatttagagtatacatattgggtttggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccaccctcctcacgatctgtactgagcgggctggcaaggcgcatagnnnn

SEQ ID NO: 39823 - DNA, 245 bp, Homo sapiens
  misc_feature: GYAE6OF02IHR9C.35.67.G01.1.454.CMB.1.raw
  modified_base (244)..(245): a, c, t, g, unknown or other
  misc_feature (244)..(245): n is a, c, g, or t
tcagtacagatcgtcacgaccggtgctcgatttagagtatacatattgggtttggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccgccctcctcacgatctgtactgagcgggctggcaaggcgcatagnn

SEQ ID NO: 39824 - DNA, 246 bp, Homo sapiens; identical to SEQ ID NO: 39527
  misc_feature: GYAE6OF02HOF4X.35.67.G01.1.454.CMB.1.raw
  modified_base (245)..(246): a, c, t, g, unknown or other
  misc_feature (245)..(246): n is a, c, g, or t

SEQ ID NO: 39825 - DNA, 248 bp, Homo sapiens
  misc_feature: GYAE6OF02H39DN.35.67.G01.1.454.CMB.1.raw
  modified_base (245)..(248): a, c, t, g, unknown or other
  misc_feature (245)..(248): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccacctcctcacgatctgtactgagcgggctggcaaggcgcatagnnnn

SEQ ID NO: 39826 - DNA, 267 bp, Homo sapiens
  misc_feature: GYAE6OF02F8ZLS.35.67.G01.1.454.CMB.1.raw
  modified_base (246)..(267): a, c, t, g, unknown or other
  misc_feature (246)..(267): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaacccactgtcactctgttcccaccctcctcacgatctgtactgagcgggctggcgaaggcgcatagnnnnnnnnnnnnnnnnnnnnnn

SEQ ID NO: 39827 - DNA, 260 bp, Homo sapiens
  misc_feature: GYAE6OF02GL05U.35.67.G01.1.454.CMB.1.raw
  modified_base (245)..(260): a, c, t, g, unknown or other
  misc_feature (245)..(260): n is a, c, g, or t
tcagtacagatcgtcacgaccggtgctcgatttagagtatacatattgggtttggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnnnnnnnnnnnnnn

SEQ ID NO: 39828 - DNA, 248 bp, Homo sapiens; identical to SEQ ID NO: 39518
  misc_feature: GYAE6OF02GD4SN.35.67.G01.1.454.CMB.1.raw
  modified_base (246)..(248): a, c, t, g, unknown or other
  misc_feature (246)..(248): n is a, c, g, or t

SEQ ID NO: 39829 - DNA, 254 bp, Homo sapiens
  misc_feature: GYAE6OF02JBRUB.35.67.G01.1.454.CMB.1.raw
  modified_base (246)..(254): a, c, t, g, unknown or other
  misc_feature (246)..(254): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnnnnnnn

SEQ ID NO: 39830 - DNA, 249 bp, Homo sapiens
  misc_feature: GYAE6OF02H8TGZ.35.67.G01.1.454.CMB.1.raw
  modified_base (246)..(249): a, c, t, g, unknown or other
  misc_feature (246)..(249): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnn

SEQ ID NO: 39831 - DNA, 250 bp, Homo sapiens; identical to SEQ ID NO: 39568
  misc_feature: GYAE6OF02I1D7A.35.67.G01.1.454.CMB.1.raw
  modified_base (246)..(250): a, c, t, g, unknown or other
  misc_feature (246)..(250): n is a, c, g, or t

SEQ ID NO: 39832 - DNA, 249 bp, Homo sapiens; identical to SEQ ID NO: 39830
  misc_feature: GYAE6OF02F8BWP.35.67.G01.1.454.CMB.1.raw
  modified_base (246)..(249): a, c, t, g, unknown or other
  misc_feature (246)..(249): n is a, c, g, or t

SEQ ID NO: 39833 - DNA, 247 bp, Homo sapiens; identical to SEQ ID NO: 39529
  misc_feature: GYAE6OF02IMHCP.35.67.G01.1.454.CMB.1.raw
  modified_base (245)..(247): a, c, t, g, unknown or other
  misc_feature (245)..(247): n is a, c, g, or t

SEQ ID NO: 39834 - DNA, 566 bp, Homo sapiens
  misc_feature: GYAE6OF02GBU4S.35.67.G01.1.454.CMB.1.raw
  modified_base (551)..(551): a, c, t, g, unknown or other
  misc_feature (551)..(551): n is a, c, g, or t
tcagtacagatcgtcacgaccggtgctcgatttagagtatacatattgggtttggggggagaggagcccagcactagaagtcggcggtgtttccatccggtgatcagcactgaacacagaggactcaccatggagtttgggctgagcggtggtttcgcgtaggctctttaagaggtgtcagtgtcaggtgcagctggtggagtcgtgggggaggcgtggtccagccgtggggacggtccctgagactctcctgtgaagcgtctggattcaaaaaaacctttgcacctatggcatgagcgtgggtcccgccgggctccgaggggaggggcgtggaggtgggtctcaatagttgatggtagtgctcaataacacatggtacgcgagactccggtggacggggccggttcacctatcctccagagacaactccaaggaacacgctagtacttactaacaaagtggaactagtgtagagacgaccggaggaaccacggccttaatattacgtgtacgacgtaaagttacgaacgaggttgcgtacggcgaacggnggtacgggatagtgg

SEQ ID NO: 39835 - DNA, 251 bp, Homo sapiens
  misc_feature: GYAE6OF02JV9V3.35.67.G01.1.454.CMB.1.raw
  modified_base (246)..(251): a, c, t, g, unknown or other
  misc_feature (246)..(251): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnnnn

SEQ ID NO: 39836 - DNA, 251 bp, Homo sapiens
  misc_feature: GYAE6OF02H475G.35.67.G01.1.454.CMB.1.raw
  modified_base (246)..(251): a, c, t, g, unknown or other
  misc_feature (246)..(251): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnnnn

SEQ ID NO: 39837 - DNA, 249 bp, Homo sapiens; identical to SEQ ID NO: 39830
  misc_feature: GYAE6OF02GL9G8.35.67.G01.1.454.CMB.1.raw
  modified_base (246)..(249): a, c, t, g, unknown or other
  misc_feature (246)..(249): n is a, c, g, or t

SEQ ID NO: 39838 - DNA, 249 bp, Homo sapiens
  misc_feature: GYAE6OF02ISZI8.35.67.G01.1.454.CMB.1.raw
  modified_base (246)..(249): a, c, t, g, unknown or other
  misc_feature (246)..(249): n is a, c, g, or t
tcagtacagatcgtcacgaccggtgctcgatttagagtatacatattgggtttgggggtttggtggtctccactcccgccttgacgaggctgattattattgttgctcatattcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnn

SEQ ID NO: 39839 - DNA, 490 bp, Homo sapiens
  misc_feature: GYAE6OF02I7WWL.35.67.G01.1.454.CMB.1.raw
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagtacagatcgtcacgaccggtgctcgatttagagtatacatattgggggaggcgtggtccagcctgggaggtccctgagactctcctgtgaagcgtctggattctccttcaagaactatggcatgcactgggtccgccaggctccaggcaaggggctggagtgggtggcagtgatatcatttgatggaagtaataaacattacgcagactccgtgaagggccgattcaccatctccagagacaattccaagaacactctgtctctgcacatgaacagtctgggacctgaggacacggctgtctattactgtgcgagagatacgaaatattgtgctagtagcagttgctacggtcttttttcattagtgactacgtggggccagggaccctggtcatcgtctctcngcctccnccaggcccatcgtctcccctgcncctcnccancncncctcngggcacgngcgcctggctgctgcaggctctcacg

SEQ ID NO: 39840 - DNA, 512 bp, Homo sapiens
  misc_feature: GYAE6OF02HE171.35.67.G01.1.454.CMB.1.raw
  modified_base (504)..(504): a, c, t, g, unknown or other
  misc_feature (504)..(504): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttgggggttatgaccttgtctcctggtatcaacagcacccaggcaaagcccccaaactcttaattataaggacactaagcgaccctcagggatttctaatcgcttctctgctcaagtctggcaactcgcctcctgacaatctcgtgggctccgggctggaggacgaggctgatttattattgttgctcattatgctaggtagtagcacttaatgtcttcggaactgggaccaaggtcaccgtctaggtcagccaaggcccaacccnctgtctac

SEQ ID NO: 39841 - DNA, 569 bp, Homo sapiens
  misc_feature: GYAE6OF02IJKCC.35.67.G01.1.454.CMB.1.raw
  modified_base (178)..(178): a, c, t, g, unknown or other
  misc_feature (178)..(178): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcggtgtttcgcgtaggctcttaagaggtntcagtgtcaggtgcagctggtggagtcgtggggagcgtggtccagcctgggagtcctgagctctctgtgaagcgtctggattcattctcaataatgtggcatgcnctggtcgcgaggccncgngcgaggacgtgngtggtgngtgtgtgtgtagtgtagtagtaagtaagtagtatatagtgacgacgacgacgtaggaacggacgtacgtacgtacgttacgtttacggtacgtacgtacgtacggttacgtacgtacgtacgtacgtacgtacgtaacgtacgaacgacgtacgtacgtacgtacgtacggacgacgacgacgtactacgttacgttacgtacgtacgacgtacgtagtacgtacggtaggtggtcggtcgtaggtcgg

SEQ ID NO: 39842 - DNA, 248 bp, Homo sapiens; identical to SEQ ID NO: 39533
  misc_feature: GYAE6OF02GTANE.35.67.G01.1.454.CMB.1.raw
  modified_base (246)..(248): a, c, t, g, unknown or other
  misc_feature (246)..(248): n is a, c, g, or t

SEQ ID NO: 39843 - DNA, 543 bp, Homo sapiens
  misc_feature: GYAE6OF02GZ9Z1.35.67.G01.1.454.CMB.1.raw
  modified_base (304)..(304): a, c, t, g, unknown or other
  misc_feature (304)..(304): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttgggggttatgaccttgtctcctggtatcaacagcacccaggcaacgccccaaactcttaattanaaggacactaagcgaccctcagggtatttctaatcgcttctctgctcagtctggcactcgcctcctgacatctcgtcgggctccgggctggaggacgaggctgtattattgttgttgctctatatgacgtaggtagtagctacgttaatgtcgttacggaacttcgggacctaacgggtcctaccgttaccgtacggtccacggacccgaacggccccaaccccgtacgtcgtctaccg

SEQ ID NO: 39844 - DNA, 250 bp, Homo sapiens
  misc_feature: GYAE6OF02G8HFL.35.67.G01.1.454.CMB.1.raw
  modified_base (246)..(250): a, c, t, g, unknown or other
  misc_feature (246)..(250): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnnn

SEQ ID NO: 39845 - DNA, 517 bp, Homo sapiens
  misc_feature: GYAE6OF02H7GJB.35.67.G01.1.454.CMB.1.raw
  modified_base (394)..(394): a, c, t, g, unknown or other
  misc_feature (394)..(394): n is a, c, g, or t
  modified_base (506)..(506): a, c, t, g, unknown or other
  misc_feature (506)..(506): n is a, c, g, or t
tcagtacagatcgtcacgaccggtgctcgatttagagtatacatattgggtttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttgggggttatgaccttgtctcctggtatcaacagcaccaggcaacgcccccaaactcttaattataagacactaagcgacctcaggatttcaatcgcttctctgctcagtctgcaactcggcctcctgacatctcgtcggctcgggctgagacgaggntgtattatttattgttgctcatatgactaggtagtagactaactaatgtacttacggaactcgggacctaaggtccaccgttcacggttcacgcccgaacggcccaaccccntccgtctaccg

SEQ ID NO: 39846 - DNA, 514 bp, Homo sapiens
  misc_feature: GYAE6OF02IU0WP.35.67.G01.1.454.CMB.1.raw
  modified_base (338)..(338): a, c, t, g, unknown or other
  misc_feature (338)..(338): n is a, c, g, or t
tcagtacagatcgtcacgaccggtgctcgatttagagtatacatattgggtttggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgaagcgtctggattcatcttcaataactatggcatgcactgggtccgccaggcctccgaggcaagggctggagtggttggcagttgngtggtatgatggaataatagatactatgcagacacgtgaggccgatcacatctacagagaacaattaccaagtaactactttacgttcctagacaaatgaacagacctgagagccgaggacgacgcgatatattatagtgacgagaagcgagtgggacgacccgtacccggatacg

SEQ ID NO: 39847 - DNA, 251 bp, Homo sapiens; identical to SEQ ID NO: 39835
  misc_feature: GYAE6OF02F6CMH.35.67.G01.1.454.CMB.1.raw
  modified_base (246)..(251): a, c, t, g, unknown or other
  misc_feature (246)..(251): n is a, c, g, or t

SEQ ID NO: 39848 - DNA, 167 bp, Homo sapiens
  misc_feature: GYAE6OF02G9X50.35.67.G01.1.454.CMB.1.raw
  modified_base (164)..(167): a, c, t, g, unknown or other
  misc_feature (164)..(167): n is a, c, g, or t
tcagtacagatcgtcacgaccggtgctcgatttagagtatacatattgggtttgggggtttggtggtctccactcccgccttgacggggctgctatctgcccctcggtcactctgttcccgcctcctcacgatctgtactgagcgggctggcaaggcgcatagnnnn

SEQ ID NO: 39849 - DNA, 249 bp, Homo sapiens; identical to SEQ ID NO: 39830
  misc_feature: GYAE6OF02HWFWQ.35.67.G01.1.454.CMB.1.raw
  modified_base (246)..(249): a, c, t, g, unknown or other
  misc_feature (246)..(249): n is a, c, g, or t

SEQ ID NO: 39850 - DNA, 665 bp, Homo sapiens
  misc_feature: GYAE6OF02HG7SM.35.67.G01.1.454.CMB.1.raw
  modified_base (456)..(456): a, c, t, g, unknown or other
  misc_feature (456)..(456): n is a, c, g, or t
tcagtacagatcgtcacgaccggtgctcgatttagagtatacatattgggttttcctcgttgtcggtctttaagaggtgtccagtgtcaggtggcagctggtggaggtcctggggggaggcgtggtccagcctcgggaggtccctgacgactctcctgtgaagcggtctgggacttcatcttcaataactatggcatcgcactgggtccgccacggcgtccagggccaagggtactggagttggttcggcaggttcgtggtacggtatgagtggaaagtaattaggaattactaatgcagtacaccgtagaagggccacttcaccatccaccagagacaatttccgaagaacactttgttcctggcctaaaagtggaactagccttagacgagtccggaggtaccaacgggcaagtactaattaccgtcgttcgcgagtaacgcgagtcggggacnccgtaccccggatcggaaggccgaacgtcggggaccagggcctaaccgtgggtccgccgttcctccgtttacgacgtccgtaccaaccgtaacggcccctagttcccggttacctttcccccgtacggtcccgtaaccccgttccgtacccgaaacggtaccgtaccgtacccgtccggtacgggggaccctaccggacggtaccccgg

SEQ ID NO: 39851 - DNA, 352 bp, Homo sapiens
  misc_feature: GYAE6OF02HL4AH.35.67.G01.1.454.CMB.1.raw
  modified_base (260)..(261): a, c, t, g, unknown or other
  misc_feature (260)..(261): n is a, c, g, or t
  modified_base (263)..(266): a, c, t, g, unknown or other
  misc_feature (263)..(266): n is a, c, g, or t
  modified_base (270)..(271): a, c, t, g, unknown or other
  misc_feature (270)..(271): n is a, c, g, or t
  modified_base (273)..(273): a, c, t, g, unknown or other
  misc_feature (273)..(273): n is a, c, g, or t
  modified_base (276)..(278): a, c, t, g, unknown or other
  misc_feature (276)..(278): n is a, c, g, or t
  modified_base (280)..(352): a, c, t, g, unknown or other
  misc_feature (280)..(352): n is a, c, g, or t
tcagtacagatcgtcacgaccggtgctcgatttagagtatacatattgggtttgggggggtttggtggtctccactcccgccttgacgaggctgattattattgttgctcatatgcaggttagtagcactaatgtcttcgggaactggggacccaaaggttcaccggtcctaaggtcagccccaaggccaaccccatgtcactctgttccccaccctcctcacgatctgtactgagcgggctggcaaagggccacatagnntnnnnagtnntnagnnncnnnnnnnnnnnnnnnnnnnnnnnnnnnnnnnnnnnnnnnnnnnnnnnnnnnnnnnnnnnnnnnnnnnnnnnnn

SEQ ID NO: 39852 - DNA, 509 bp, Homo sapiens
  misc_feature: GYAE6OF02F6YZQ.35.67.G01.1.454.CMB.1.raw
  modified_base (389)..(389): a, c, t, g, unknown or other
  misc_feature (389)..(389): n is a, c, g, or t
  modified_base (499)..(499): a, c, t, g, unknown or other
  misc_feature (499)..(499): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttgggggttatgaccttgtctcctggtatcaacagcacccaggcaaagcccccaaatcttaattataaggacactaagcgaccctcaggatttctaatcgcttctctggctccaagtctggcaactcggcctcctgacatctctgggctccgggntgaggacgagctgattattattgttgctcatatgctaggtagtagctaactaatcgtcttcggaactgggaccaggtccaccgtctaggtcagcccaacggcccaacccntcgtcctacg

SEQ ID NO: 39853 - DNA, 513 bp, Homo sapiens
  misc_feature: GYAE6OF02GY1RJ.35.67.G01.1.454.CMB.1.raw
  modified_base (442)..(442): a, c, t, g, unknown or other
  misc_feature (442)..(442): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggcctccaggcaagggctggagtggttggcagttgtgtggtatgatggaagtaatagatactatgcagacaccgtgaaggccgtatcacatctccagagacaattaccaagaactactttgtcctagactaaatgaacngacctgagagccgaggacacggcgatatagttactgtgcgagaagcgatgggacgccgtacccgggatcgg

SEQ ID NO: 39854 - DNA, 253 bp, Homo sapiens
  misc_feature: GYAE6OF02HZ2QX.35.67.G01.1.454.CMB.1.raw
  modified_base (247)..(253): a, c, t, g, unknown or other
  misc_feature (247)..(253): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcaccgatctgtactgagcgggctggcaaggcgcatagnnnnnnn

SEQ ID NO: 39855 - DNA, 530 bp, Homo sapiens
  misc_feature: GYAE6OF02G47Y8.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccgattcaccatctccagagacaattccaagaacactttgttcctgcaaatgaacagcctgagagccgaggacacggcgatatattactgtgcgagaagcgatgggagcctaccccggatcgagcacgtggggccagggccaccgtggtccgccgtctcgttcacgcctccaccgacggcccactccggtcctccccgtcggccaccctcctccaacgacgccacctcgcggggccacgacgcccggg

SEQ ID NO: 39856 - DNA, 556 bp, Homo sapiens
  misc_feature: GYAE6OF02JL9L2.35.67.G01.1.454.CMB.1.raw
  modified_base (199)..(199): a, c, t, g, unknown or other
  misc_feature (199)..(199): n is a, c, g, or t
  modified_base (373)..(373): a, c, t, g, unknown or other
  misc_feature (373)..(373): n is a, c, g, or t
  modified_base (457)..(457): a, c, t, g, unknown or other
  misc_feature (457)..(457): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccnccaggctccaggcaagggactggagtggttggcagttgtgtggtatgatggaagtaatgatactatgcagacacgtgaaggccattcaccatctccagagacaattccaagaactactttgtcctgacaaatgaacagcctgaagagccgaaggacacggcgaatatattacgngtgacgagaagcgagtgggacgccgtaccccggatcgagcgacgtcgggaccgacgggccaccgtcggtccgccgtctcgttcncgcctaccaccgacggccctagtccgtcctcccgtcggcccaccctccgtaccgaacgtccgcctaccgtccggtacggggacctacgaccggtcccgg

SEQ ID NO: 39857 - DNA, 506 bp, Homo sapiens
  misc_feature: GYAE6OF02GIDE3.35.67.G01.1.454.CMB.1.raw
  modified_base (338)..(338): a, c, t, g, unknown or other
  misc_feature (338)..(338): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggctggagtggttggcagttgngtggtatgatggaataatagatactatgcagacacgtgaaggcgatcacatctcagagacaattaccaagaactactttgttcctagacaaatgaacagcctgagagcgaggacacggacatatattactgtgcgagaagcgagtggacgcccgtaccccggatacgg

SEQ ID NO: 39858 - DNA, 250 bp, Homo sapiens; identical to SEQ ID NO: 39844
  misc_feature: GYAE6OF02I4S9X.35.67.G01.1.454.CMB.1.raw
  modified_base (246)..(250): a, c, t, g, unknown or other
  misc_feature (246)..(250): n is a, c, g, or t

SEQ ID NO: 39859 - DNA, 541 bp, Homo sapiens
  misc_feature: GYAE6OF02IHOIN.35.67.G01.1.454.CMB.1.raw
  modified_base (199)..(199): a, c, t, g, unknown or other
  misc_feature (199)..(199): n is a, c, g, or t
  modified_base (504)..(504): a, c, t, g, unknown or other
  misc_feature (504)..(504): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
tcagtacagatcgtcacgaccggtgctcgatttagagtatacatattggggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaagggctggagtggttggcagttgtgtggtatgatggaagtaatagatactatgcagacaccgtggaagggccgattcacccatctccagagacaattccaagaacacttttgtcctgcaaaatgaacagcctgagagccgaggacacggcgaatatattactgtagcgagaagcgaagtgggacgaccgtacccccggatcggagccaacgtcggggaccagggccacccgtgggtccgccgtctcttcacgccctccaccgacggcccagtccgtccttccccgtggccnccctcctccaacgcncacctcgtcgggcacgngccgg

SEQ ID NO: 39860 - DNA, 502 bp, Homo sapiens
  misc_feature: GYAE6OF02FMXPZ.35.67.G01.1.454.CMB.1.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
  modified_base (468)..(468): a, c, t, g, unknown or other
  misc_feature (468)..(468): n is a, c, g, or t
  modified_base (490)..(490): a, c, t, g, unknown or other
  misc_feature (490)..(490): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatcttacaataactatggcatgcacgtgggtccnccaggctccgaggcaagggctgggagtggttggcagttgngtggtatgatggaatatagatactatgcagacacgtgaacgggccatcacatcncaganacatccaagactntttntcctgacaaatgaacagctaganagaccgagacaggcataatattacngtgacgagagcgagtcgggacncccgtaacccgg

SEQ ID NO: 39861 - DNA, 577 bp, Homo sapiens
  misc_feature: GYAE6OF02HT27J.35.67.G01.1.454.CMB.1.raw
  modified_base (180)..(180): a, c, t, g, unknown or other
  misc_feature (180)..(180): n is a, c, g, or t
  modified_base (283)..(283): a, c, t, g, unknown or other
  misc_feature (283)..(283): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactntggcatgcactgggtcccgccaggctccgagggcaaagggactgggagtggttggctagttgtgtggtatgatggaaagtatagatacgatgcagactaccgngaagggccgatcaccatctcagagacaattccaaagaactactttgttcctggacaaaatgaaacagacctgagagacccggaaggacacggtacgattataatactggtgacgagaagacgtagagggagcctaccccggatacggagcgaacgtgggacgaagggtcacccgtcggtcgccggtcctcttcacgtccacgaaccgaacggacccacgtccggtcccttccccgtcggtccaccctccctaccgaacgtacaccaccgtccgtacggggccacgacgcccggg

SEQ ID NO: 39862 - DNA, 498 bp, Homo sapiens
  misc_feature: GYAE6OF02GLZVC.35.67.G01.1.454.CMB.1.raw
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (370)..(370): a, c, t, g, unknown or other
  misc_feature (370)..(370): n is a, c, g, or t
  modified_base (418)..(418): a, c, t, g, unknown or other
  misc_feature (418)..(418): n is a, c, g, or t
  modified_base (489)..(489): a, c, t, g, unknown or other
  misc_feature (489)..(489): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatgttgggggttatgaccttgtctcctggtatcaacngcaccagcaaagccccaaatcttaattanaaggacactaagcgaccctcagggtatttcaatcgcttctctgctcaagtctggcaactcgcctcctgacatcnctgggctcgggctgaggacgaggctgatttattagttgttgctcattntgcaggtagtagcaataatgtcttacggatgggaccaggtcaccgtctaggcacgccaacggcccaacccnctgtctacc

SEQ ID NO: 39863 - DNA, 641 bp, Homo sapiens
  misc_feature: GYAE6OF02HU7JX.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagctgggtggagtcgtgggggaggcgtggtccagccgtggggacggtccctgagactctcctgtgaagcgtctggtattcattcttacaaataactatggcatgcacgttcgggtcccgccgacggcctccgaggcgaagggactgggaggttggttggcgtaggtttggtgttggtatggagtaggtaagtaatagatactatgacagacgaccgtaggaacgggccgtattaccaaccatcctacgaagaacgaacctaattaccgaaacgtaaccttacgttttacgttcctagaactaaagttacgaaacctagtacccgtaggaacgacggacccggaaggaaccgacgggactaagttaacttaacgttacgttacggtacggacggaagtaacggcggtacggtacgggacccgtacccccggttacccggagtaccgg

SEQ ID NO: 39864 - DNA, 618 bp, Homo sapiens
  misc_feature: GYAE6OF02G8VBS.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctccgtgtgaagcgtctggattcatcttcaataactatggcatgcacgtcgggtccgccgaggcctccgaggcgaagggactgggagtggtggctaggttgtgtggtatgatggaagtaatagatactagtgacagacgacgtaggaacgggcctagttaccacctatcctaccgagaacgaactaaacttacccgaaagtaaccttacttttacgttaccgtagactaaacgtcgaaaccacgtaccgtaggaacggtaaccggaccgggaagacccggacgggaccgtaagttaagttaacttacggtaggtacggacggaaggtaacgtacgggaggtacggggaccgtaccccggtaaccccggg

SEQ ID NO: 39865 - DNA, 249 bp, Homo sapiens
  misc_feature: GYAE6OF02I1IAY.35.67.G01.1.454.CMB.1.raw
  modified_base (246)..(249): a, c, t, g, unknown or other
  misc_feature (246)..(249): n is a, c, g, or t
tcagtacagatcgtcacgaccggtgctcgatttagagtatacatattgggtttgggggtttggtggtctccactccctccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnn

SEQ ID NO: 39866 - DNA, 253 bp, Homo sapiens
  misc_feature: GYAE6OF02GQDAI.35.67.G01.1.454.CMB.1.raw
  modified_base (246)..(253): a, c, t, g, unknown or other
  misc_feature (246)..(253): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnnnnnn

SEQ ID NO: 39867 - DNA, 249 bp, Homo sapiens; identical to SEQ ID NO: 39830
  misc_feature: GYAE6OF02IP1DG.35.67.G01.1.454.CMB.1.raw
  modified_base (246)..(249): a, c, t, g, unknown or other
  misc_feature (246)..(249): n is a, c, g, or t

SEQ ID NO: 39868 - DNA, 517 bp, Homo sapiens
  misc_feature: GYAE6OF02IRHAQ.35.67.G01.1.454.CMB.1.raw
  modified_base (505)..(505): a, c, t, g, unknown or other
  misc_feature (505)..(505): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggggaggcgtggtccaggcctgggaggtccctgagactctcctgtgaagcgtctggattcatcttcaataactatggcatgcactgggtccgccaggctccaggcaagggctggagtggttggcagttgtgtggtatgatggaatatagatactatgcagacacgtgaagggccatcacatctccagagacaattaccaagaactactttgtcctagacaaatgaacagcctgacgacgccgaggaccacggacgataatacttactgtgacgagaacgcgagtcgggaccncccgtaacccgg

SEQ ID NO: 39869 - DNA, 543 bp, Homo sapiens
  misc_feature: GYAE6OF02HHB5B.35.67.G01.1.454.CMB.1.raw
  modified_base (317)..(317): a, c, t, g, unknown or other
  misc_feature (317)..(317): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttggggtatgaccttgtctcctggtatcaacagcaccaggcaaagcccccaaatcttaattataaggacactaagcgaccctnagggatttcaatcgcttctctggctcaagtctggacactcggcctcccngacatctcnggctccgggntggagacgagctgatttattattgttgcttcattatggacaggtagtagcctaacttaattgtacttacggtaacgtcgggaacctaagggtccaaccgttccgtaaggtccacggaccccgtaaggaccccaaaccccgacttacggtcctaacccg

SEQ ID NO: 39870 - DNA, 502 bp, Homo sapiens
  misc_feature: GYAE6OF02F08WW.35.67.G01.1.454.CMB.1.raw
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggctgggagtggttggcagttgtgtggtatgatggaagtaatagatactatgcagacaccgtgaggcgatcacatctcaganacaatccaanacactttcgtctgcaatgaacagcctgagacgcgaggacacggcgatatattactgtgcgagaagcgagtgggacgcccgtaccccggatacgg

SEQ ID NO: 39871 - DNA, 371 bp, Homo sapiens
  misc_feature: GYAE6OF02FW2SX.35.67.G01.1.454.CMB.1.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
  modified_base (334)..(371): a, c, t, g, unknown or other
  misc_feature (334)..(371): n is a, c, g, or t
tcagtacagatcgtcacgaccggtgctcgatttagagtatacatattgggtttgggaacctaagtgaacattctgtaggggccactgtcttctccacggtgctcccttcatgcgtgacctggcaactcggcctccctgacaatctctgggctccgggcgtgaggacgaggcttgatttattattgtttgctcatatgcaggtagtagctactaatgtcttcggaacgtgggaccaaggtcaccgtcctagggtcagcccaaggccaaccccntgtcactctgttcccaccctcctcacgntctgtactgagcgggctggcaaggcgngagtagnnnnnnnnnnnnnnnnnnnnnnnnnnnnnnnnnnnnnn

SEQ ID NO: 39872 - DNA, 571 bp, Homo sapiens
  misc_feature: GYAE6OF02FWNTJ.35.67.G01.1.454.CMB.1.raw
tcagtacagatcgtcacgaccggtgctcgatttagagtatacatattgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccgattcaccatctccagagacaattccaagaacactttgttcctgcaaatgaacagcctgagagccgaggacacggcgatatattactgtgcgagaagcgatgggagcctacccccggatgagcacgtggggccagggccacccgtggtcgccgtctcttcagcctccaccaacgggcccatccggtccttcccccgtcggccaccctccctccaacgacgccacctcgtcgggggccacgacgccggccctgggcctcgcccttcgggtccaacgggtacctaaccgtttcccgaaccgtacgttccgtacggttaccgtcggacggccggggtcgtgggacccgg

SEQ ID NO: 39873 - DNA, 557 bp, Homo sapiens
  misc_feature: GYAE6OF02HYSSG.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacacgtgaaggccgattcacatctcagagacaattccaagacacttttgtcctgcaaatgaacagcctgagacgccgaggacacggcatatattacgtgtgcgagagcgagtgggagcctacccggatgacgcgacgtcgggcgacgggcgacccgtcggtcgcccgtctccttcgacgccctccgaccgaacggacccgtacgtccggtcccttccccgtccggccctaccccgttccctacccgtaacgacgccaccgtccgtacggggacctaccgacggcccgg

SEQ ID NO: 39874 - DNA, 597 bp, Homo sapiens
  misc_feature: GYAE6OF02IB2RR.35.67.G01.1.454.CMB.1.raw
  modified_base (198)..(198): a, c, t, g, unknown or other
  misc_feature (198)..(198): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggcctccaggcaagggactggagtggttggcagttgtgtggtatgatggaagtaatagatactatgcagacaccgtgaagggccgattcaccatctccagagacaacttccaaagaacctacttttcgttacctagacaaaatcgaaacagccctaggacgagccgaggacacggcgatatattacgtgagcgagaagcgagtgggacgcccgtaccccggatacggacgaccgtacgtcggggacccgagggccgtacccgtcgggtccgccgtaccgttccttccacgtcctcccgaaccgacggcccacgtccgtccttccccgtcggccctacccctccctacccgacgaccgcctacccgtaccggtcggggccctaccgacggtcccggg

SEQ ID NO: 39875 - DNA, 597 bp, Homo sapiens
  misc_feature: GYAE6OF02H600A.35.67.G01.1.454.CMB.1.raw
  modified_base (238)..(238): a, c, t, g, unknown or other
  misc_feature (238)..(238): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
tcagtacagatcgtcacgaccggtgctcgatttagagtatacatattgggtttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgngtggtatgatggaagtatagatactatgcagacacgtgaaggcgattcacccatctccagagacaattccaaagaacactttgtcctgcaaatgaacagctgagagccgaggacacggnatatattactgtnacgagaagcgagtgggacgcccgtaccccggatgagcgacgtacgggccgagggccaccgtcggtcgcccgtacttccgttaccacgtccctaccgaacccgaaacgggccctagtcccggttacccgttccccccgtcggtccctacccccttcccgtaacccgtaaacgacccgaccctaccccgtccggttaccggggggacctaacccggacggtcccccggg

SEQ ID NO: 39876 - DNA, 546 bp, Homo sapiens
  misc_feature: GYAE6OF02F0TIC.35.67.G01.1.454.CMB.1.raw
tcagtacagatcgtcacgaccggtgctcgatttagagtatacatattgggtttgggctcaactttcttgtccaccttggtgttgctgagctgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccggtgaagggccattcaccatctaccagagacaattccaaagaacactttgttccctgacaaatgaacagcctgagagcgaggacacggcgatatattactgtgacgagaagcggatgggacgcccgtaccccggatcgacgcgacgtggggaccgacgggccaccgtcgggtccggccgttcctccttcgacgccctcccaccgaacgggccccacgtccggtccccg

SEQ ID NO: 39877 - DNA, 589 bp, Homo sapiens
  misc_feature: GYAE6OF02HRSPZ.35.67.G01.1.454.CMB.1.raw
  modified_base (261)..(261): a, c, t, g, unknown or other
  misc_feature (261)..(261): n is a, c, g, or t
  modified_base (304)..(304): a, c, t, g, unknown or other
  misc_feature (304)..(304): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggagcgtggtccaggcctgggaggtccctgagactctcctgtgaagcgtntggattcatcttcaataactatggcatgcacgtcggggtcccnccagggcctccgagggaccaaaggggacctggggagttgggttcggctaggttgtggtggtatgagtggaagtaatagatactatgcagacaccggtaggaacgggccgtacttacaccactctaccgagaacgaactaacttaccgaaacgtaacctaccttttacgttaccctagacctaaatacgaaacacgaccgtagagacgacccggaggaccgacggacgataagtacgttactgtggacgagagacgaggtacggacgacccgtaccccggatacgg

SEQ ID NO: 39878 - DNA, 549 bp, Homo sapiens
  misc_feature: GYAE6OF02G1ERJ.35.67.G01.1.454.CMB.1.raw
tcagtacagatcgtcacgaccggtgctcgatttagagtatacatattgggtttgggggctggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatgttgggggttatgaccttgtctcctggtatcaacagcaccaggcaaacgccccaaactcttaatttataaggacactaagcgaccctcagggatttctaatcgcttctctggctcaagtctgcactcgcctcctgacatctcgtggctcggctgaggacgaggctgtattattattgttgctcatatgacgtaggtagtagctaactaattcgttacgttacggtaacgtcggggaacctaaggtcctaacccggttaccgtacggttccacggaccccgaacgggacccctaaccccgtacgttaccgg

SEQ ID NO: 39879 - DNA, 249 bp, Homo sapiens; identical to SEQ ID NO: 39570
  misc_feature: GYAE6OF02G4SVA.35.67.G01.1.454.CMB.1.raw
  modified_base (246)..(249): a, c, t, g, unknown or other
  misc_feature (246)..(249): n is a, c, g, or t

SEQ ID NO: 39880 - DNA, 333 bp, Homo sapiens
  misc_feature: GYAE6OF02HK8CR.35.67.G01.1.454.CMB.1.raw
  modified_base (323)..(333): a, c, t, g, unknown or other
  misc_feature (323)..(333): n is a, c, g, or t
tcagtacagatcgtcacgaccggtgctcgatttagagtatacatattgggtttgggaacctatgaacattctgtaggggccactgtcttctccacggtgctcccttcatgcgtgacctggcaactcggcctccctgacaatctctgggctccgggctgaggacgaggctgattattattgttgctcatatgcaggtagtagcactaatgtcttcggaactgggaccaaggtcaccgtcctaggtcagcccaaggccaaccccactgtcactctcgttcccaccctcctcacgatctgtactgagcggctggcaggcgcatagnnnnnnnnnnn

SEQ ID NO: 39881 - DNA, 252 bp, Homo sapiens
  misc_feature: GYAE6OF02I48HN.35.67.G01.1.454.CMB.1.raw
  modified_base (244)..(252): a, c, t, g, unknown or other
  misc_feature (244)..(252): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgcctcctcacgatctgtactgagcggctggcaaggcgcatagnnnnnnnnn

SEQ ID NO: 39882 - DNA, 269 bp, Homo sapiens
  misc_feature: GYAE6OF02HSFWF.35.67.G01.1.454.CMB.1.raw
  modified_base (242)..(242): a, c, t, g, unknown or other
  misc_feature (242)..(242): n is a, c, g, or t
  modified_base (248)..(269): a, c, t, g, unknown or other
  misc_feature (248)..(269): n is a, c, g, or t
tcagtacagatcgtcacgaccggtgctcgatttagagtatacatagttgggtttgggggtttggtggtctccactcccgccttgacgaggctgattattattgttgctcatactgcaggtagtagcactaatgtcttcggaactgggaccaaggtcaccgtcctaggtcagcccaaggccaaccccactgtcactctgttcccgccctcctcacgatctgtactgagcgggctggcaaggcncatagnnnnnnnnnnnnnnnnnnnnnn

SEQ ID NO: 39883 - DNA, 251 bp, Homo sapiens; identical to SEQ ID NO: 39835
  misc_feature: GYAE6OF02H2DB3.35.67.G01.1.454.CMB.1.raw
  modified_base (246)..(251): a, c, t, g, unknown or other
  misc_feature (246)..(251): n is a, c, g, or t

SEQ ID NO: 39884 - DNA, 595 bp, Homo sapiens
  misc_feature: GYAE6OF02G3LOF.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccattcaccatctccagagacaattccaagaactacttttgtcctgacaaatgaaacagcctagagacgccgaggacacggcaatatattactgtgcgagaagcgagtgggacgcccgtacccggagtcgagccgacggtcgggccgacgggccgacccgtgggtccgccggttcctccgttccaccgtccctaccgaacccgaacggaccctacgtcccggttcccgttccccgtccggtccctaccccttcccgtacccgaacggaccgaccctacccgtccggtccggggaccaccggacggtccccggg

SEQ ID NO: 39885 - DNA, 536 bp, Homo sapiens
  misc_feature: GYAE6OF02GLX27.35.67.G01.1.454.CMB.1.raw
  modified_base (302)..(302): a, c, t, g, unknown or other
  misc_feature (302)..(302): n is a, c, g, or t
tcagtacagatcgtcacgaccggtgctcgatttagagtatacatattgggtttgggggggagaggagcccagcactagaagtcggcggtgttcccatccggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgaagcgtctggattcatcttacaatactatggcatgcacgtgggtcccncaggcctccgaggcaagggctggagtggttggctaggttgtgtggtatgagtggaagtatagatactagtgacagacacgtgaacgggcgatcacatctcagacacaactaccaacaactactttcgtcctagacaatagaacagacctagacgacgaccgaggaccgacggacgatactagttacgtgtagacgaagagcgaggtcgggaccgcccggtaccccggagtacgg

SEQ ID NO: 39886 - DNA, 256 bp, Homo sapiens
  misc_feature: GYAE6OF02IZ7VV.35.67.G01.1.454.CMB.1.raw
  modified_base (242)..(242): a, c, t, g, unknown or other
  misc_feature (242)..(242): n is a, c, g, or t
  modified_base (248)..(256): a, c, t, g, unknown or other
  misc_feature (248)..(256): n is a, c, g, or t
tcagtacagatcgtcacgaccggtgctcgatttagagtatacatattgggtttgggggtttggtggtctccactcccgccttgacgaggctgattattattgttgctcatatgacaggtagtagcactaatgtcttcggaactgggaccaaggtcaccgtcctaggtcagcccaaggccaaccccactgtcactctgttcccgccctcctcacgatctgtactgagcgggctgggcaaggcncatagnnnnnnnnn

SEQ ID NO: 39887 - DNA, 515 bp, Homo sapiens
  misc_feature: GYAE6OF02IY0V4.35.67.G01.1.454.CMB.1.raw
  modified_base (243)..(243): a, c, t, g, unknown or other
  misc_feature (243)..(243): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtnctgataactatgtctcctggtaccaacaccacccaggcaaagcccccaaactcatgatttatgatgtcagtaatcggcctnagggtttctaatcgcttctctggctcaagtctgcaacncggcctccctgacccatctcgtgggctccagctgacgacgaggctgattatactgcagctacatactacaaccagcagccatcctcgtggttcggcgggaggaccaaggtcctaggaccccgttcgtacggtaccacggtccccaaggtcccg

SEQ ID NO: 39888 - DNA, 598 bp, Homo sapiens
  misc_feature: GYAE6OF02GCZ7N.35.67.G01.1.454.CMB.1.raw
  modified_base (335)..(335): a, c, t, g, unknown or other
  misc_feature (335)..(335): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaaggccgattcaccatctccagagacaattccaagaacactttgtcctgacaaaatnaacagcctgagagaccgaggacacggcaatatattactgtacgcgagaagcggagtgggacgacccgtacccccgggagtcgacgtcaccggtcggggaccgaggggccacccgtgggtccgccgtactccgtcgacgtccctccacccgaacggccccgacgttccggtcccttcccccgtacggtcccaaccccgttccctacccgtaacgaccgcctaaccccgttccggtaccgggggcctacccggacggtccccggg

SEQ ID NO: 39889 - DNA, 536 bp, Homo sapiens
  misc_feature: GYAE6OF02H82P6.35.67.G01.1.454.CMB.1.raw
  modified_base (337)..(337): a, c, t, g, unknown or other
  misc_feature (337)..(337): n is a, c, g, or t
  modified_base (371)..(371): a, c, t, g, unknown or other
  misc_feature (371)..(371): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (484)..(484): a, c, t, g, unknown or other
  misc_feature (484)..(484): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcccgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaaggccgattcacatctccagagacaattccaagaacacttttgtcctgcaaatgaacngcctgagagccgaggacacggcgaatatattacngtgcgagaagcgagtgggacgcctaccccggatgacgcacgtcgggccgaggccaccgtggccgcgtctctcncgccnccaccgacggccacgtccgtcctccccgtcggccnccctccctaccgaacgaccgccaccgtcggcgggccacgaccggcgtcccgg

SEQ ID NO: 39890 - DNA, 665 bp, Homo sapiens
  misc_feature: GYAE6OF02JM8GL.35.67.G01.1.454.CMB.1.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggacggtccctggagactctcctgtgaagcgtctggattcatcttcaataactntggcatgcactgggtccnccaggcctccaggcaagggctgggagtggttgctagttgtgtggtatggtatggtaaagtaatagataacgtagtggactaggaacaccggtaggaacgggacctattaccgaacctacgtcctaccgagaacgactaaacgttaccaaagtaacctacgttttacgtaacccttagaacctaaaagttacgaaaccgtacgtaccgttaggaacggaacgtacccggaaacggtaaccgaccgggtaccgagttaacgttaacgtttaacggtacggttacgggtaacggtaacgggtaaacggtaccgggtaacggttacgggggaaccgtacccccggtaacccccgggtagtaaccggg

SEQ ID NO: 39891 - DNA, 533 bp, Homo sapiens
  misc_feature: GYAE6OF02FLDX6.35.67.G01.1.454.CMB.1.raw
  modified_base (199)..(199): a, c, t, g, unknown or other
  misc_feature (199)..(199): n is a, c, g, or t
  modified_base (447)..(447): a, c, t, g, unknown or other
  misc_feature (447)..(447): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccnccaggctccaggcaagggactggagtggttggcagttgtgtggtatgatggaagtaatagatactatgcagacaccgtgaagggccgattcaccatctccagagacaattccaagaacacttttgtcctgcaaatgaacagcctgagagccgaggacacggcgaatatattactgtgcgagagcgatgggagccgtaccccggatgagcacgtggggccagggccacccgtggtccgccgtctcgtcncgcctccaccgacggcccacgtccggtccttccccgcggccaccctccctccaacgacgccaccgtcgtcggggccacgcgcccgg

SEQ ID NO: 39892 - DNA, 252 bp, Homo sapiens
  misc_feature: GYAE6OF02FVZ2P.35.67.G01.1.454.CMB.1.raw
  modified_base (246)..(252): a, c, t, g, unknown or other
  misc_feature (246)..(252): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnnnnn

SEQ ID NO: 39893 - DNA, 569 bp, Homo sapiens
  misc_feature: GYAE6OF02JBPCB.35.67.G01.1.454.CMB.1.raw
  modified_base (386)..(386): a, c, t, g, unknown or other
  misc_feature (386)..(386): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtatagatactatgcagacaccgtgaagggccgattcaccatctccagagacaattccaagaactacgttttgtcctgcaaatgaacagcctagagacgccgaggacacggcgatatattactgtgacgagaagngagtgggacgcccgtaccccggagtcggacgcgagtcggggccgacgggccacccgtggtccgccgtctcgtcacgcctaccaccgacggcccagtccggttccttcccccgtcggccctaccccttcccgtaccaaccggacgccgtacccgtccggtcgggggccaccggtcggccccggg

SEQ ID NO: 39894 - DNA, 547 bp, Homo sapiens
  misc_feature: GYAE6OF02G0979.35.67.G01.1.454.CMB.1.raw
  modified_base (375)..(375): a, c, t, g, unknown or other
  misc_feature (375)..(375): n is a, c, g, or t
tcagtacagatcgtcacgaccggtgctcgatttagagtatacatattgggtttgggggctggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatgttgggggttatgaccttgtctcctggtatcaacagcacccaggcaaacgcccccaaactcttaatttataaggacactaagcgaccctcaggtatttctaatcgcttctctggctcaagtctgcactcgcctccngacatctcgtgggcctccgggctgaggacgaggctgtattattattgttgctcattagtgacgaggttagtagctactaagttcgttcgttacgggacgtacggggaaccctaaggtcccaaccgttccgtaggtccacggaccccgaacggacccctaccccgagttccgg

SEQ ID NO: 39895 - DNA, 546 bp, Homo sapiens
  misc_feature: GYAE6OF02I2URB.35.67.G01.1.454.CMB.1.raw
  modified_base (373)..(373): a, c, t, g, unknown or other
  misc_feature (373)..(373): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccattcaccatctccagagacaattccaagaacacttttgtcctgacaaatgaacagcctgagagccgaggacacggcgatatattactgngcgagaagcgagtgggagccgtaccccggatgagcacgtgggaccagggccgacccgtgggtccgccgtcttcgttccacgccctccaacccgaacgggcccatccggtccttccccgtcggccaccctcctacccaagtacgccaccgtccgtcggggccaccgaggcccgg

SEQ ID NO: 39896 - DNA, 540 bp, Homo sapiens
  misc_feature: GYAE6OF02GH332.35.67.G01.1.454.CMB.1.raw
  modified_base (304)..(304): a, c, t, g, unknown or other
  misc_feature (304)..(304): n is a, c, g, or t
  modified_base (516)..(516): a, c, t, g, unknown or other
  misc_feature (516)..(516): n is a, c, g, or t
tcagtacagatcgtcacgaccggtgctcgatttagagtatacatattgggtttgggggggagaggagcccagcactagaagtcggcggtgtttccatccggtgatcagcgactgaacacagaggactcaccatggagtttgggctgagcgtgggttttcctcgttgctcttttaagaggtgtccagtgtcaggtgcagctggtggagtctgggggaggcgtggtccagcctgggaggtccctgagactctcctgtgagcgtctggattcatcttcaattactatggcatgcacgtggggtcccnccgaggcctccgaggcaaggggctgggagtgggttggcaggttgtgtggtatgatggaagtatagatactatgacagacacggtaggaagggccgtatcaccatcctccagacgacaacttaccaaacgaactactttcgttcctgacaaatagaacacgacctagacgagccgaggacacggacgatatagttactgtgagagaagcgagngggacgccgtaccccggagtacgg

SEQ ID NO: 39897 - DNA, 266 bp, Homo sapiens
  misc_feature: GYAE6OF02I2HG0.35.67.G01.1.454.CMB.1.raw
  modified_base (248)..(266): a, c, t, g, unknown or other
  misc_feature (248)..(266): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaaccccactgtcactctgttcccaccctcctcacgatctgtactgagcgggctggcaaggcgcatagnnnnnnnnnnnnnnnnnnn

SEQ ID NO: 39898 - DNA, 575 bp, Homo sapiens
  misc_feature: GYAE6OF02ICCKW.35.67.G01.1.454.CMB.1.raw
  modified_base (303)..(303): a, c, t, g, unknown or other
  misc_feature (303)..(303): n is a, c, g, or t
  modified_base (360)..(360): a, c, t, g, unknown or other
  misc_feature (360)..(360): n is a, c, g, or t
tcagtacagatcgtcacgaccggtgctcgatttagagtatacatattgggtttgggagaggagcccagcactagaagtcggcggtgtttccatccggtgatcagcactgaacacagaggactcaccatggagtttgggctgagctgggttttcctcgttgctctttaagaggtgtccagtgtcaggtgcagctgggtggagtcgtgggggagcgtggtccagcctggggagtccctgaagctctcctgtgaagtcgtctggattcatcttacaaataactagtggcatgcctacgtgggtccnccaggcctcgagcaagggctggagtggtgctagtgtgtggtatgtatggaacgtaanacgatactatgcagacacgtagaggccgatcacatctaccagacgaacattaccaaagtaaactactttcgttacctagacaaatacgaaactacgtacctaggaacgacgaccggaaggaaccgacggacgtaataattagtaacgttggtcgtaacggaagtaacggacgtaacggtacgggaacggtaccccgtaccccgggtataaccggg

SEQ ID NO: 39899 - DNA, 636 bp, Homo sapiens
  misc_feature: GYAE6OF02JOGMY.35.67.G01.1.454.CMB.1.raw
  modified_base (297)..(297): a, c, t, g, unknown or other
  misc_feature (297)..(297): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactcgtccgtgtgaagcgtctggattcatcttacaattactatgcatgacncgtcgggtccgaccgaggcctaccgagggaccgaaggggtaccgtgggtaaggtggggttacggcggttaaggttgttagggtggttagtggaacggttagggaaataacgtagtaattactagtcgacgaacgacgaaccggtaggaacgggtcctagtcaccgtatcgtacgaagactactaacttaccaaagtaaccgttactttcgtacctagacctaaagtcgaaactcgaccgagaacgcggaacggaacgacgacggctaatcgttaacgttacgtggttacggaagtacgggaacgtaccgggagtcgggtacccgaccccggtaacccgg

SEQ ID NO: 39900 - DNA, 635 bp, Homo sapiens
  misc_feature: GYAE6OF02GAG38.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgacgactctccgtgtagaagcgtctggtattcatcttacaataactagtggcagtcgcacggttcgggtcccgccgacggtcctccgaggaccgaagggacgtgggaggttgggtggcgtaggttgtggtggtagtggtagtggaagtatagtatactatgacagacgaccggtaggacggccgtattaccacctactccgtaccagtaacaactaacttaccgaacgtaaccttacttttcgtaccctagtaacctaaagtacgaacgtacgccgttaggaacgtacggacccggaaggaccggaccggcgtaattaacgtaacgtttacgtggtacgacgggaagaacggccggtaaggtcggggacccgttacccccggtaacccggg

SEQ ID NO: 39901 - DNA, 592 bp, Homo sapiens
  misc_feature: GYAE6OF02HLA5U.35.67.G01.1.454.CMB.1.raw
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (375)..(375): a, c, t, g, unknown or other
  misc_feature (375)..(375): n is a, c, g, or t
tcagtacagatcgtcacgaccggtgctcgatttagagtatacatattggtttcctcgttgctctttaagaggtgtccagtgtcaggtgcagctggtggagtcgtggggggaggcggtggtccgaggccgtgggaggtccctggagactctcctgtgaagcgtctggattcatcttcaataactatggcatgcactgggtcccaccgaggctccgaggcaaagggactggagtggtgcagttgtgtggtatgagtggaagtaatagatactatgcagacacgngagggcatcacatcncaganacatcaagacacttgtccngacaaaatnaaacngacctggaangaccgaaggactacggactataatattacngtgacgagaagtacgagtagggacgaccgtaacccggagtacgagacgaacgtcgggacaacggggaccacccggtcggccgcccggtccgtccttacgacgtccctaccgaacccgaacggtacccacgtccggttcccgttccccgtcggtcccacccctccctacccgaacgacgtccgaccctcggtaccggggtacaccgggccgtacccgg

SEQ ID NO: 39902 - DNA, 251 bp, Homo sapiens
  misc_feature: GYAE6OF02JH44P.35.67.G01.1.454.CMB.1.raw
  modified_base (239)..(239): a, c, t, g, unknown or other
  misc_feature (239)..(239): n is a, c, g, or t
  modified_base (245)..(251): a, c, t, g, unknown or other
  misc_feature (245)..(251): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcggctggcaaggcncatagnnnnnnn

SEQ ID NO: 39903 - DNA, 623 bp, Homo sapiens
  misc_feature: GYAE6OF02GK118.35.67.G01.1.454.CMB.1.raw
  modified_base (199)..(199): a, c, t, g, unknown or other
  misc_feature (199)..(199): n is a, c, g, or t
  modified_base (347)..(347): a, c, t, g, unknown or other
  misc_feature (347)..(347): n is a, c, g, or t
tcagtacagatcgtcacgaccggtgctcgatttagagtatacatattgggtttccttcgttgctcttttaagtaggtgtccagtgtcaggtgcagctggtggagtctgggggaggcgtggtccagcctgggaggtccctgagactctcctgtgaagcgtctggattcatcttcaataactatggcatgcactgggtccnccgaggctccaaggctaagggacttggagtggttggcagttgtggtggtatggatggaaagtaatagactataatgcagacaccgtggaaggccgaagttcaaccgatctccagagacaattccaagaacactttgtcctgacaaatnaacagcctagagacggccgaaggaccacggacgaatagtaattactgacgtacgagaagcgagtgggacgaccgtaccccggagtcgacgacgacgtaggggcccgagggaccgtccctacgggtccgaccgtctccgttacgaccgtcctacccgaccgtaaccgggcccacgtccggttaccctcccccgtccgggaccctacccccgttcccgtacccgaaacggtcacccgtacccgttaccggtccggggccctaccgacggtccccgggg

SEQ ID NO: 39904 - DNA, 585 bp, Homo sapiens
  misc_feature: GYAE6OF02IZM9L.35.67.G01.1.454.CMB.1.raw
  modified_base (470)..(470): a, c, t, g, unknown or other
  misc_feature (470)..(470): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagcctggggacggtccctgagactctcctgtgagcgtctggattcatcttacaattaactatggcatgcacgtgggtccgccaggcctccgaggcaaggggctgggagtggttggcaggttgtggtggtatgagtggaataatagatactatgacagacacggtgaacgggctatacaacatctaccagacgaactaacttccaaagtaccttacgtttcgttcctacgaactaaagtcgaaacncggtacctaggaacgacgacccgaggaaccgaccgggacgtatattacgttacgtggtacggacggtaagaaggacggagtacggggaccgtaccccggtaccccggtatacggg

SEQ ID NO: 39905 - DNA, 521 bp, Homo sapiens
  misc_feature: GYAE6OF02HMZ9Q.35.67.G01.1.454.CMB.1.raw
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
  modified_base (400)..(400): a, c, t, g, unknown or other
  misc_feature (400)..(400): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
  modified_base (479)..(479): a, c, t, g, unknown or other
  misc_feature (479)..(479): n is a, c, g, or t
  modified_base (507)..(507): a, c, t, g, unknown or other
  misc_feature (507)..(507): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgaagcgtctggattcatcttcaataactatggcatgcacgtgggtccncaggctccgaggcaagggctggagtggttgctagttgtgtgtatgatggaatanagatactatgcagacacgtgaacgggccattcaccatctcaganacaattccaaagtaaccacttttgtcctgacaaatcgaaacngcctgacgacgaccgaggacacggngaatatattacnggtacacggaagaggcgaggtcgggacncccgtaaccccggg

SEQ ID NO: 39906 - DNA, 587 bp, Homo sapiens
  misc_feature: GYAE6OF02HUF5Z.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcacgtgggtccgccaggctccaggcaaagggctgggagtgggttggcagttgtgtggtatgatggaagtaatagatactatgcagacaccgtgaaggcgattcaccatctccagacgactaattccaagtaaccaacttttgttcctagacaaaatgaaacagcctagagacgccgaggacacggcgatagtattacgtgtgcgagaagcgagtgggagccgtaccccggatcgaggccacgtcggggccacgggaccgaccgtcgggtccgcccgtacctccgttcgacgtcccttcccgaccgaacggccccacgttcccgtacccgttccccgtccggccctacccctccctccgtaacgacgcctacccgtcgtcggggcctacgacggtcccggg

SEQ ID NO: 39907 - DNA, 524 bp, Homo sapiens
  misc_feature: GYAE6OF02IQHSQ.35.67.G01.1.454.CMB.1.raw
  modified_base (177)..(177): a, c, t, g, unknown or other
  misc_feature (177)..(177): n is a, c, g, or t
  modified_base (312)..(312): a, c, t, g, unknown or other
  misc_feature (312)..(312): n is a, c, g, or t
  modified_base (356)..(356): a, c, t, g, unknown or other
  misc_feature (356)..(356): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagnggtgtccagtgtcaggtgcagctggtggagtcgtgggggaggcgtggtccaggccgtggggacggtccctgacgactctctgtgaagcgtctggattcattcttacaaataactatggacatgcacgtgggtccnccaggcctaccagggcaaggggactgggagtggttgcaggttgngtggtatgacttgggaaataatacgatactatgacagacacgtggaaggcatcacatctaccagagacaattccaagaactactttcnctanactaaatcgaaacagtctagacgagccgagacacgganatatatctgtcacgagacngatagggactcctacccgg

SEQ ID NO: 39908 - DNA, 609 bp, Homo sapiens
  misc_feature: GYAE6OF02G6VPM.35.67.G01.1.454.CMB.1.raw
  modified_base (380)..(380): a, c, t, g, unknown or other
  misc_feature (380)..(380): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccaggcaagggctggagtggttggcagttgtgtggtatggatggaagtaatagatactatgcagacaccgtgaaggcattcacatctccagacgacaattccaaagaactctttgttcctagactaaatcgaacagcctagagagccgaggaccacggcaatatatactgtcgngagagcgagtgggacgacccgtacccggagtacgagcgacgtcggggcccagggccacccgtggtccgcccgttaccgtccgttccgacgtccctacccgaccgaaaccgggcccgtaacgtcccggttcccttcccccggtaccggtccctacccccgttccgtaacccgaacggtaccgacccgtacccggtccggtaccgggggacctacccggacggtccccggg

SEQ ID NO: 39909 - DNA, 527 bp, Homo sapiens
  misc_feature: GYAE6OF02I7DHP.35.67.G01.1.454.CMB.1.raw
  modified_base (198)..(198): a, c, t, g, unknown or other
  misc_feature (198)..(198): n is a, c, g, or t
  modified_base (345)..(345): a, c, t, g, unknown or other
  misc_feature (345)..(345): n is a, c, g, or t
  modified_base (453)..(453): a, c, t, g, unknown or other
  misc_feature (453)..(453): n is a, c, g, or t
  modified_base (510)..(510): a, c, t, g, unknown or other
  misc_feature (510)..(510): n is a, c, g, or t
  modified_base (523)..(523): a, c, t, g, unknown or other
  misc_feature (523)..(523): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaagggactggagtggttggcagttgtgtggtatgatggaagtaatagatactatgcagacaccgtgaagggccattcaccatctccagagacaattccaagaacacttttgtcctgacaaatgaacagcctganagccgaggacacggcaatatattactgtagacgtaaaattggacgaacgtggggaatggtacttcgatcgtcgtggggcctggccacccgtggtcacgtgtcctcctnacgccctccaacgaacggcccatccggtccttcccgtggcctccctgctccgaggcnccaccctcgagcncacg

SEQ ID NO: 39910 - DNA, 259 bp, Homo sapiens
  misc_feature: GYAE6OF02J3ERJ.35.67.G01.1.454.CMB.1.raw
  modified_base (251)..(259): a, c, t, g, unknown or other
  misc_feature (251)..(259): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggcccaaccccactgtccactctcgttccccaccctcctcacgatcctgtactgagcgggctggcaaggcgcatagnnnnnnnnn

SEQ ID NO: 39911 - DNA, 564 bp, Homo sapiens
  misc_feature: GYAE6OF02GU1AD.35.67.G01.1.454.CMB.1.raw
  modified_base (326)..(326): a, c, t, g, unknown or other
  misc_feature (326)..(326): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttgggggttatgaccttgtctcctggtatcaacagcacccaggcaaacgcccccaaactcttaattataaggacactaagcgaccctnagggtatttcaatcgtcttctctggctcaagtctggcaacgtcgcctcctgacatctctcgggctccgggctgaggacgaggctgatttattattgttgctcattatgacgtaggtacgtagactacttaagttcgttacgttacggaacgttcgggaacctaacgggtcctaaccggttcctagggttccaacggaccctaacgggcccctaaaccccgacgttacgtactaacccg

SEQ ID NO: 39912 - DNA, 250 bp, Homo sapiens
  misc_feature: GYAE6OF02GW6SY.35.67.G01.1.454.CMB.1.raw
  modified_base (247)..(250): a, c, t, g, unknown or other
  misc_feature (247)..(250): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnn

SEQ ID NO: 39913 - DNA, 616 bp, Homo sapiens
  misc_feature: GYAE6OF02FS9JO.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctctttaagaggtgtccagtgtcaggtgcagctggtggagtcgtgggggaggcgtggtccagccgtgggacggtccctgagactctcctgtgaagcgtctggattcatcttacaataactatggcatgcacgtgggtccgccgaggcctccgagggcgaaggggactgggaggttgggttggctaggttgtgtggtatgagtaggaagtaatagatactagtgcagacacggtaggaacgggtccattaccgaccatccctaccgaagaacgtaactaaacgttcccgaaaagtaaccttacgttttcgttacctgtaactaaagtcgaaacacgtcgtagaacgtacggaccggaaggaccgacggacgaagtttaacgttacttacgtggttacgacggaaggaacggtccggtaagtccgggggaccgtaccccggtaacccccggg

SEQ ID NO: 39914 - DNA, 605 bp, Homo sapiens
  misc_feature: GYAE6OF02IM1ZG.35.67.G01.1.454.CMB.1.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgcttcttttaagaggtgtccagtgtcaggtgcagctggtggagtctggggganacgtggtccagcctgggaggtccctgagactctcctgngagcgtcgtggattcatcttacaataactatggcatgcactgggtccgcaggctcaggcgaaggctggactggtgcagttgngtggtatgatggaatangatactangagagtacacgtggaacgggaccgtagttccaccgtaactctccagtacgaacaagttccaaacgtaactacgttttcgtaccttagactaaaactcggtaaacacgtccgtaagacggaacggacccggaaacgggaaccgaacgggaaccgtattaacttaacgtttaacctaggtaggtccgaaggaacgcggtaaggttacggggaacccgtaccccgttaacccccgggagtaaccggg

SEQ ID NO: 39915 - DNA, 251 bp, Homo sapiens
  misc_feature: GYAE6OF02FOZHQ.35.67.G01.1.454.CMB.1.raw
  modified_base (245)..(251): a, c, t, g, unknown or other
  misc_feature (245)..(251): n is a, c, g, or t
tcagtacagatcgtcacgaccggtgctcgatttagagtatacatattgggtttgggggtttggtggtctccactcccgccttgacgaggctgattattatgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnnnnn

SEQ ID NO: 39916 - DNA, 679 bp, Homo sapiens
  misc_feature: GYAE6OF02IBQNK.35.67.G01.1.454.CMB.1.raw
  modified_base (175)..(175): a, c, t, g, unknown or other
  misc_feature (175)..(175): n is a, c, g, or t
  modified_base (314)..(314): a, c, t, g, unknown or other
  misc_feature (314)..(314): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctgagctggttttcctcgttgctcttttaagnggtgtccagtgtcaggtgcagctggtggagtcgtgggggaggcgtggtccagccgtggggacggtcctgagactctcctgtgaagcgtctggattcattcttacaaataactagtggactatgcctacgtcggggtccnccgaggcctccagggaccaaggggtactgggacgttgggttcgcgtaggttgtggttggtagttgaagttggaaagttaatagtatacgtatggacaaggactaccggtaggaacgggccgtaagttccgaacctaagtccttaccgaacgaagaacctaaacgtaccaaacgtaaaccttacgtttacgttcctagaaccgtaaaacgttacggaaaccaacgcccgttaagaacggaaccggacccggaaaggaaccgaaccggtacggaatttaacgtaacgttaacgttacggtaacggaccgtaaaggaacgtacggaaggttaccgggaaccggtacccccgtaaccccggagtaacgg

SEQ ID NO: 39917 - DNA, 532 bp, Homo sapiens
  misc_feature: GYAE6OF02IECZW.35.67.G01.1.454.CMB.1.raw
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggggagcgtggtccagcctgggaggtccctgagactctcctgtgaagcgtctggattcatcttcaataactatggcatgcacgtgggtccgccaggcctccgaggcaagggctggagtggtggctagttgngtggtatgatggaataatagatatangcagacgacgtgaagggccatcacatcaccagacactaactaccaanaactactttcgtaccagacaaagtgaacagcagagacgccgaaggaccaggacgaatacgttattacgtgacggtacgaggaacgcggaaggtcgggacctcccgtaaccccggg

SEQ ID NO: 39918 - DNA, 618 bp, Homo sapiens
  misc_feature: GYAE6OF02HXPB4.35.67.G01.1.454.CMB.1.raw
  modified_base (306)..(306): a, c, t, g, unknown or other
  misc_feature (306)..(306): n is a, c, g, or t
  modified_base (384)..(384): a, c, t, g, unknown or other
  misc_feature (384)..(384): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctggtggagtcggtgggggaggcgtggtccagccgtggggagtccctgacgctctctgtgagcgtctggattcattcttacaataactgtgcatgcacgtcgggtccncgaggcctccgaggcgaagggcgtgggagttgggtggctaggttgtgtaggtatgagtaggaacgtaatacgatactncgacagacgtaccggtaggaacgggtcctattccgacctatccaccgaagacgaactaactaccaaacgaccaacgtactagaactccgtacgaaactaaagtacgaaaccgtagaccgtagaacggacgaaccgggacgaccgtaccgggtacgtttaacgtaacgttaccggtggtaacggtaaccgaagtaacctaagttaccggtaccgttacgtttacttacggtacgg

SEQ ID NO: 39919 - DNA, 699 bp, Homo sapiens
  misc_feature: GYAE6OF02JPU6R.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcacgttggggtcccgccaggcctccgaggccgaaaggggactgggagtggttggctaggttgtggtggtatgagtggaagtaatagatactatgacagaccgaccggtggaacgggccgtattcaccactcctccgagacgactaacttaccaagtaacctacttttcgtcctagactaaatacgaacagcgtagacgacggcggacggacgacggacgtaatacgttaagttacgtaggtagaccggaagaaggtcgtaaggtcgggaacgtccccggtaacccggagtccggaacggccggacggtaccgggggccgaaccgggtcccgtacccggtacgggtcccgtcccggttccgttaccgtccgacccgtcccgtacccgaccggaccggtacccctagtccccgggttcccttccccggtaccgccccgtaacccctccgtaaccccgaacggtcccgacccggtaccggtcccgggacgggtcccaccggccccgggtcccggg

SEQ ID NO: 39920 - DNA, 602 bp, Homo sapiens
  misc_feature: GYAE6OF02IX4IU.35.67.G01.1.454.CMB.1.raw
  modified_base (298)..(298): a, c, t, g, unknown or other
  misc_feature (298)..(298): n is a, c, g, or t
tcagtacagatcgtcacgaccggtgctcgatttagagtatacatattgggtttgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggagtcgtggtccagccgtgggacgtccctgagactctctgtgagcgtctggattcatctacaataactatggacatgctacgtgggtccnccgaggcctaccgaggacgaagggctggagtggttggcgtaggttgtggtgtatagtataggaaatagtaagatactatgacagacctacggtaggaacgggccgtaagttaccaaccgtagtacctacgagtaacgaacgtaaacttaccgaaagtaacctactttacgtacctagaactaaatacgaacacgtacctagacgtaacgccggaacgaacgacgggtacacgttagttaataaccgtagtcgaacgagtaacgacggtacggtacccgggacccgtacccggtagtagaccggg

SEQ ID NO: 39921 - DNA, 531 bp, Homo sapiens
  misc_feature: GYAE6OF02G2ASG.35.67.G01.1.454.CMB.1.raw
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggggaggcgtggtccagcctggggaggtccctgagactctcctgtgaagcgtctggattcatcttcaataactatggcatgcacgtggggtccnccaggcctccgaggcaagggctggagtggttggcagttgngtggtatggatggaatanagatactatgcagacacggtgaacgggccatcaacatctaccagacgaactaacttaccaaagtaactactttcgtcctagactaaatgaacncgacctagagacgcgagacgacganatatacgttacgtgtagcgagagcgagtggacgcccgtacccggatacgg

SEQ ID NO: 39922 - DNA, 250 bp, Homo sapiens
  misc_feature: GYAE6OF02GJ5QV.35.67.G01.1.454.CMB.1.raw
  modified_base (247)..(250): a, c, t, g, unknown or other
  misc_feature (247)..(250): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnn

SEQ ID NO: 39923 - DNA, 248 bp, Homo sapiens; identical to SEQ ID NO: 39518
  misc_feature: GYAE6OF02GU0TV.35.67.G01.1.454.CMB.1.raw
  modified_base (246)..(248): a, c, t, g, unknown or other
  misc_feature (246)..(248): n is a, c, g, or t

SEQ ID NO: 39924 - DNA, 605 bp, Homo sapiens
  misc_feature: GYAE6OF02IKLGZ.35.67.G01.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatcctcctgcactggaaccngcagcgatggttggggttatgaccttgtctcctggtatcaacagcaccaggcaaacgccccaaactcttaattanaagacactaagccaccctcagggtatttactaactcgtacttctctggcctacagtctggaccaacgtcgcctccctgacactctacgtggtcctcgggctagacggcgacggtcctgtactttattatttcggttgtcttacagttatcgacgtaggtagtacgactaacgtaagttcgtaccgttacggtaaccgtcgggaaccgtacgggtaccgtaacccgttaccgtaacggttacccgacggtaccccgaacgggtacccccaaaccccgtacgttaccggtacccttaacccgg

SEQ ID NO: 39925 - DNA, 685 bp, Homo sapiens
  misc_feature: GYAE6OF02HEUFT.35.67.G01.1.454.CMB.1.raw
  modified_base (275)..(275): a, c, t, g, unknown or other
  misc_feature (275)..(275): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgccctccgtgtctgggtcctcctggacagtcgatccacatctcctgcactggaaccagcagcgtagtggttgggggttatgaccttgtcctcgtgtatcaanacgccaccgaggacaaaaccgccccaaacttctttaaattagaacggaacaactaacgaccgtaccctagacgggttactttacctaagtccgtcgtttctcgtacgcctaccgtaacgttcgtcggactaaccgtcccggtcccttacccgtagaacctacgttccgtacgtcggggtacctcccggggactacgggacggacggtaggtccttagtaacggtttagtcggtacgtcgtacgttattaacgtaagtaaggtactccggtagtccgaaccttacgttacgtaacgtttaacggtacggttacgggacgggtaaccggtaacgacggttaccgtacgtacccggttacgtaaccggtaccgacggtaccccgaacggtcccgtccccggtccccgtaacgg

SEQ ID NO: 39926 - DNA, 593 bp, Homo sapiens
  misc_feature: GYAE6OF02JDRAQ.35.67.G01.1.454.CMB.1.raw
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttccttgttgccattttaaaaggtgtccagtgtgaggtgcagctggtggagtccgggggaggcttagttcagcctggggggtccctgagactctcctgtgaagcgtctggattcatcttcaatactatggcatgcacgtgggtccgcaggctccaggcaagggacnggagtggttgctaggttgtgtggtatgatggaagtanagtatactatgacagacaccgtaggaacgggccattacacactctaccagacgacaagtaccaaagactactttgttcctagactaaacgtcgaaactacgaccgtagaacgtacgacgtaacggacgacggacgaagttaagtaaccttacgtaggtccggtaacgaaggtaacggacgtaaggtagggaaccgtacccggtaaccccggagtacggtaacggtccgtaaccggg

SEQ ID NO: 39927 - DNA, 633 bp, Homo sapiens
  misc_feature: GYAE6OF02JC8F0.35.67.G01.1.454.CMB.1.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (389)..(389): a, c, t, g, unknown or other
  misc_feature (389)..(389): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccnccaggctccaggcaagggactggagtggttggcagttgtgtggtatgatggaagtaatagatactatgcagacacgtgaaggcattcacatctcanagacaatccaagaactactttgtcctgacaaatgaacagcctagacgagccgaggacacggngatatatacngtagngagaagcgagtgggacnccgtacccggatagacgcacggtcgggaccgacgggaccacccgtcggtccggacccgttccgttaccgtccgtaccggtaccccgttacccgaacccggaacgggtaccccgtaacgttcccgggttaccccgtttacccccggtccggtacccctaacccccgttcccgtaaccccgaacggtacccgtacccgtacccggttaccggtaccgggggacccacggtacccgggtaccccggg

SEQ ID NO: 39928 - DNA, 550 bp, Homo sapiens
  misc_feature: GYAE6OF02G6PBY.35.67.G01.1.454.CMB.1.raw
  modified_base (518)..(518): a, c, t, g, unknown or other
  misc_feature (518)..(518): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggacggtccccgagactctcctgtgaagcgtctggattcatcttcaataactatggcatgcactcggggtcccgccaggcctcccagggccgaaggggactgggagtgggttggctaggttgtgtggtatgatggaagtaatagatactatgcagacaccgtaggaacgggcgatcaacaatctaccagagaactaactccaaagtaactactttgttacctagacaaatacgaacacgcctagagacgacgacggacacggacgatatactacgtgtcgagaagagngagtcgggacgacccgtacccggagtagacgg

SEQ ID NO: 39929 - DNA, 655 bp, Homo sapiens
  misc_feature: GYAE6OF02IRLGU.35.67.G01.1.454.CMB.1.raw
  modified_base (224)..(224): a, c, t, g, unknown or other
  misc_feature (224)..(224): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccngcagcgatggttggggttatgaccttgtcctcctggtactcaacagaccacccgaggaccaaacgacccccaaattcttaattaactaaggacaactaagccgaaccctagagggtaatttctaatcgtccttcgtcgtgcctactaagtctaggacaacgtccggccctcctcgaactactcctcgtcgggcctccgggtctaggacggaccggaggtccgtagtagttttaagtttagttcgttacgtcgttactagtacgtcggacgtaacggtacgttaacgtacgtaaccgttaacgttacgttacgtaaccggttaacgggtacggtaacggtaccggtaacccggttacccgtaaccggttacggtaaccgtacggaaccgtacccggaacccctaaccccgaaccgttaccgtacctaaccgg

SEQ ID NO: 39930 - DNA, 555 bp, Homo sapiens
  misc_feature: GYAE6OF02HX6GA.35.67.G01.1.454.CMB.1.raw
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacgtccctgagactctcctgtgaagtcgtctggattcattcttacaaataactntggcatgcacgtcgggtcccnccgagggcctccgaggccaaggggctgggagttgggttggctaggttgtgtggtatgagtggaaattaatagatactatgcagacgcgtagaacggctatcactatctacagagactaactaccaagtaactacgtttcgtaccagtaacaaagtacgaacgcgtactagacgacgacggagaccacggatatatagtacgtgtagacgagacggacgaggtcggaccgacccgtacccgatacg

SEQ ID NO: 39931 - DNA, 643 bp, Homo sapiens
  misc_feature: GYAE6OF02F6HLZ.35.67.G01.1.454.CMB.1.raw
  modified_base (431)..(431): a, c, t, g, unknown or other
  misc_feature (431)..(431): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcacgtgggtccgccaggctccaggcaagggactggagtggttgcagttgtgtggtatgatggaagtatagatactatgacagacacggtgaacgggccgattcgactatcctaccgagacgacaacttccaagaacctacttttcgtacctagacaaaactgaaacacgcctagaacgacggccgaagggaccaacgggcgaaattactaattacgtgtagacgaagaacgcgaaggtgggacncccgtaacccggatcggacgccgacggtcggggaccgacgggccacccggtcgggtcccgaccgttccgtccgttaccgacgtccctaccgaacccgaaccggccctacgtcccgttacccttccccgtcgggccctaccccgttcccgtaacccgaacgtccgaccctacccggttccggcccgggggtacccaaccggtccggccccggg

SEQ ID NO: 39932 - DNA, 543 bp, Homo sapiens
  misc_feature: GYAE6OF02FFV18.35.67.G01.1.454.CMB.1.raw
  modified_base (246)..(246): a, c, t, g, unknown or other
  misc_feature (246)..(246): n is a, c, g, or t
  modified_base (381)..(381): a, c, t, g, unknown or other
  misc_feature (381)..(381): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggtttcctcgttgctcttttaagaggtgtccagtgtcaggtgcagcgtgggggagtcgtggggggaggcgtggtcccagcctggggaggtcccngagactctcctgtgcagcgtctggattcaccttcagtagttatggcatgcacgtggtccgccaggctccgagggcaagggggctgggagtggggtggcagttatagtggtatgatggaagtcaataaagactagngacagacctcggtagagggccgattccaaccatcctaccgaagagaactaacttccaaagtaacaccgctgtactctagacaaatagaacacgacctgaagacgaccgacgacgacggctggtattacgtacgtgtggacgacggaacaggtagagagtcgg

SEQ ID NO: 39933 - DNA, 515 bp, Homo sapiens
  misc_feature: GYAE6OF02FUHCC.35.67.G01.1.454.CMB.1.raw
  modified_base (417)..(417): a, c, t, g, unknown or other
  misc_feature (417)..(417): n is a, c, g, or t
tcagtacagatcgtcacgaccggtgctcgatttagagtatacatattgggttgggggtcacaagaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagcccccaaactcatgatttatgatgtcagtaatcggccctcgaggggtttctaatcgcttctctgctcaagtctggcaacacggcctccctgaccatctctggctcaggctgacgacggagctgattattactgcancctacatactacagcagcagcactctcgtgttcggcgggtaagggaccaaggcctacggccgtaccgtacgggccacggacccgaggccctaccccgg

SEQ ID NO: 39934 - DNA, 641 bp, Homo sapiens
  misc_feature: GYAE6OF02G2451.35.67.G01.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccaggccaagggactggagtggttggcagttgngtggtatggatggaagtaatagatactatgcagacacgtgaaggccattcaccatctccagagacaattccaagtaacncttttntcctagcaaaatgaaacngcctaggagagaccgaggaccaggcgatataattactgtagacgagagacgatagggacgtaccgtaccccggatgacgacgacgtacggggaccgacgggacccaccgtcgggtccgcccggtccgttccgttaccgaccggtacccctaccccgaacccggaaaccgggccccctacgttaccccggttcccgttccccccgttacgggtaccccctaccccctcccccgtaacccgaaccgacccgtaccgtaccccgtaccggtcccgggggacctaccggaccggtaccccggg

SEQ ID NO: 39935 - DNA, 605 bp, Homo sapiens
  misc_feature: GYAE6OF02JNRM5.35.67.G01.1.454.CMB.1.raw
  modified_base (313)..(313): a, c, t, g, unknown or other
  misc_feature (313)..(313): n is a, c, g, or t
  modified_base (380)..(380): a, c, t, g, unknown or other
  misc_feature (380)..(380): n is a, c, g, or t
  modified_base (560)..(560): a, c, t, g, unknown or other
  misc_feature (560)..(560): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtgggtccaggccgtggggacggtccctgagacctctcctggtgaagcgtctggattcattcttacaataactatggcatgcacgtgggtcccncaggctccgaggaccaagggctgggagtgggttgacgtaggttgtgtagtagtgaagtggaaattanagtataatatggacaagaccgtacggtaggtaacgggccgtaattccacgtatccgtcaaggacaactaacttaccgaaagtaactacgtttgtaccctgaactaaatcgaaactcgacccgttagacggacgacccgaagaaccgtaccggactaagttaacgtattacgtagtacggngaacggtacgacggacggtaggggaccctccccggtaaacccggg

SEQ ID NO: 39936 - DNA, 649 bp, Homo sapiens
  misc_feature: GYAE6OF02IWJ59.35.67.G01.1.454.CMB.1.raw
  modified_base (641)..(641): a, c, t, g, unknown or other
  misc_feature (641)..(641): n is a, c, g, or t
tcagtacagatcgtcacgaccggtgctcgatttagagtatacatattggggggaggcgtggtccagcctgggaggtccctgagactctcctgtgaagcgtctggattcatcttcaaataactatggcatgcactgggtccgccaggctccgaggggaaggggctggagtgggtctcagttattagtggtagtggtgatactatacactacgcagactccgtgaagggccgttcaccatctccagagacaattccaagaacacactgaatctgacaaaatgaaacagcctgagagccgaggacacggcgtatattactgtcgacgaaagacaatatcgacgttaattactatgtccgttacggaagtaactttaaaattggaagtcttttagaccttaacggtcggggacccgtaacgggtaacccgtcggttaccgacccgttcccgtccctaccgtacgccccgttacccaacccgtaacgggaccccgtacgttcccggttcccttcccccgtaccgccctacccctaccctcccgaacgaccgacctacccgtccgtacggggccaccgcgaccggcccgtgggccgtcgtccgtcggtacgaacgtaccgtactcccgacgtacgtcgtcgttacgnggtaccgg

SEQ ID NO: 39937 - DNA, 553 bp, Homo sapiens
  misc_feature: GYAE6OF02HYMPT.35.67.G01.1.454.CMB.1.raw
  modified_base (400)..(400): a, c, t, g, unknown or other
  misc_feature (400)..(400): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacacgtgaaggccgatcacatctccagagacaattccaagactactttgtcctgacaaatgaacagcctgagagccgaggacacggcatatatactgtgacgagaagcgagtgggacgcccgtaacccggntcgacgcgacgtggggccacggggccacccgtggtccgtcccgtcgtccttcgacgccctccaccgaaggccctagtccggtccttccccgcggccctacccctccgacctaacgccgccaccgtccggtcggggaccaccgacggtcccggg

SEQ ID NO: 39938 - DNA, 658 bp, Homo sapiens
  misc_feature: GYAE6OF02HEC10.35.67.G01.1.454.CMB.1.raw
  modified_base (228)..(228): a, c, t, g, unknown or other
  misc_feature (228)..(228): n is a, c, g, or t
tcagtacagatcgtcacgaccggtgctcgatttagagtatacatattgggtttggggggggtcacaagaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgctgataactatgtctcctggtaccaacaccacccaggcaaacgccccaaactcatgatttatgatgtcagtaactcggcctcgaggggtttctaagtcgcttctctgctcagtctggacaacaccggcctccctcgacctatccttcgtcgggcttccgaggtctggaccgacggaacggctaggtatttaacgtttatttggttcgtccttctaagtttattcggtacgtaagggttagtaacgtacctaaccgttaaagttcggtttacgtttaaccgggtaaccgtttacggggaacccgtaaacgggttaccctaacccgggttacccggttaacgggtacccgtaaccgggtaacccccgtaaacggggtacccccctaaaaccccccggttacgttcccggttaacccc

SEQ ID NO: 39939 - DNA, 261 bp, Homo sapiens
  misc_feature: GYAE6OF02GJZGQ.35.67.G01.1.454.CMB.1.raw
  modified_base (248)..(261): a, c, t, g, unknown or other
  misc_feature (248)..(261): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaaggtcaccgtcctaggtcagcccaaggccaacccccactgtcactctgttcccaccctcctcacgatctgtactgagcgggctggcaaggcgcatagnnnnnnnnnnnnnn

SEQ ID NO: 39940 - DNA, 632 bp, Homo sapiens
  misc_feature: GYAE6OF02FYU2D.35.67.G01.1.454.CMB.1.raw
  modified_base (312)..(312): a, c, t, g, unknown or other
  misc_feature (312)..(312): n is a, c, g, or t
tcagtacagatcgtcacgaccggtgctcgatttagagtatacatattgggtttgggggggagaggagctcagcactagaagtcggcggtgtttccatccggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggacggtccctgagactcctcctggtgaacgcgtctggattcattcttacaaattaactatggcatgcacgtgggtccnccgaggcctccgaggacgaagggctggagttgggtggctagttgtgtgtatggatggaagtatagatactatgacagaccacggtaggaacgggtccgtaattaccaacgtaactccgtaccgaagaacgaactaacttaacccgaaacgtaaccttactttacgttacctacgaactaaatacgaaaccacgtccgtagaacgtacggaccggaacggacgaacgggtacgtaataacgtttaacgttaacgtaggtacgaacggaagggaacggtcggtaaggtacggggaacccgtaccccggtaaccccgggtacg

SEQ ID NO: 39941 - DNA, 591 bp, Homo sapiens
  misc_feature: GYAE6OF02HB5LN.35.67.G01.1.454.CMB.1.raw
  modified_base (317)..(317): a, c, t, g, unknown or other
  misc_feature (317)..(317): n is a, c, g, or t
tcagtacagatcgtcacgaccggtgctcgatttagagtatacatattgggtttgggggggggtcacaagaggcagcgctctcgggacgtctccaccatggcctgggctctgctgctcctcactctcctcactcaggacacaggtgacgcctccagggtaggggtcttggggacctctggactgatccttggtctcccgctcctcaggctcaccggggcccagcactgactcagtggcatgtgtttcctccctctttccgaggtcctgggcacagtctgccctgactcagcctgcctcgtgtctgggtctcctggacngtcgatcaccatctcctgcactaggaaccagcagcgagttggttaggggtatcgtaccttgtcctcgtggtactacaactcgcacccgaggaccaaacgcccctaaacttacttaattaacgtaaacggacaacgtaacgccgtaacctacgaacgggttactttacgtaactccgtctttcctcgtcgcttaccagtcgtgtaccgtaacgtccggtccctacctacgtaacctacgttccgtacggtccgggtccgttccgggcgtaccggg

SEQ ID NO: 39942 - DNA, 602 bp, Homo sapiens
  misc_feature: GYAE6OF02F4TY0.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagagtgtccagtgtcaggtgcagctggtggagtcgtgggggagcgtggtccagccgtgggacgtccctgagacctctcctgtgaagcgtctggattcatcttacaatactagtggcatgcacgtcgggtccgccgaggcctccgaggcgaaggcgtggagttggtggctaggttgtggtgtatgataggaatagtagatactatcgacagaccacggtagaacggtccgtagttccaactctacctccgaaggaacaaccgtacttaaccaaagtaaccttacttttacgttacctagactaaagtcaacgcgtaccgtgaacgacgtaccggaacgacgaccggagtacgtacgttacgttcgagttacggacgtaaggaagaccggttaggccgggaaccgtacccccggttacccggagtacccggg

SEQ ID NO: 39943 - DNA, 257 bp, Homo sapiens
  misc_feature: GYAE6OF02GFNBR.35.67.G01.1.454.CMB.1.raw
  modified_base (247)..(257): a, c, t, g, unknown or other
  misc_feature (247)..(257): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnnnnnnnnn

SEQ ID NO: 39944 - DNA, 662 bp, Homo sapiens
  misc_feature: GYAE6OF02JAU50.35.67.G01.1.454.CMB.1.raw
  modified_base (265)..(265): a, c, t, g, unknown or other
  misc_feature (265)..(265): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgaagcgtcnggatcatctcagtagtcatggatgcacgtgggttccatcgaacgttccgaaggggtaggctggtggtggtttcacgtattacgagtgagttgggacttgaacacgaatcgaacgcggacgtccgtgggaacgggccgtacgtttacccgaccccctacgaaggacgtaacgaaccgtaccgaaacgaaccgaacctaactaacgtactaccgtacgaactaaaacgtacggaaacctagttacgtacggaacggaacgacccgggaaagaaccggtaaaccgggtacttacgggttaccttacgttaacgttacggtcggtaaccggtaaaggtaacggggtcggtaacccgtaacgtaacgttaccgtaggtttacgggtttagtaacgttccggg

SEQ ID NO: 39945 - DNA, 556 bp, Homo sapiens
  misc_feature: GYAE6OF02JEA6K.35.67.G01.1.454.CMB.1.raw
  modified_base (201)..(201): a, c, t, g, unknown or other
  misc_feature (201)..(201): n is a, c, g, or t
  modified_base (246)..(246): a, c, t, g, unknown or other
  misc_feature (246)..(246): n is a, c, g, or t
  modified_base (400)..(400): a, c, t, g, unknown or other
  misc_feature (400)..(400): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcattcttcaataactatggcatgcacgtgggtccnccaggcctccgaggcaaaggggactgggagtggttggcaggttgngtggtatgatggaataatagatactatgacagacaccggtggaagggccattcacatctcagagacaatccaagaactactttgtcctagacaaatgaacagcctgagagccgagacacggacatatatactgtgacgagaagcgagtgggacncccgtacccggagtcgacgcgacggtcggggccgacgggccaccgtcggtccgccgttctccgtcacgcctaccaccgacggcccacgtccgtccttcccgcgccctaccctccacctacgacaccgtaccgtcggtcgggcctacgacgtcccgg

SEQ ID NO: 39946 - DNA, 668 bp, Homo sapiens
  misc_feature: GYAE6OF02GTK88.35.67.G01.1.454.CMB.1.raw
  modified_base (303)..(303): a, c, t, g, unknown or other
  misc_feature (303)..(303): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagcctgggacgtccctgagactctcctgtgagcgtctggattcatcttacaataactatggctatgcacgtgggtccnccgaggcctccgaggcaagggctgggagttggtggctagttgtgtgtatgagtggaagttatagatacgtatgactaacggacctaccggtaggaacgggtaccgtagttaccgaacctacgtacctaccgaacgaacggtaacctaaacgtttacccgaaacggtaaccttacgttttacgttacccttagaacctaaacgtacgtaaaccgtacgtaccgtaggaacggaccgacccgggaacggaaccgaaccgggtacgtaagttaacgttaacgttaacgtacggttaggaaccggtaaggaacggtcggtaacggttaccggggaacccggtaccccggttaccccgggtagtaccggg

SEQ ID NO: 39947 - DNA, 740 bp, Homo sapiens
  misc_feature: GYAE6OF02GZ6NJ.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgaagcgtctggattcatcttcaataactatggcatgcacgtcgggtccgccgagggccctccgaggacgaagggacgtgggaggtgggttggctaggttggtgtggtagtgtagtaggtaaagttaagtacgtaattacgtatcgacgtaaggtacaccggtagggaacgggccgtaacgtttacccgaacccgtaacgtcccttaaccggaagtaacggtaaaccgtaaaccgtttaacccgaaaacggttaaacccttaaccgtttttaccgtttacccttacggtaaccgtaaaacgttacggtaaaaccgtaccggtaccgtaacggtaacgggaacccggtaaccgggaacgggaaaccggaccgggtaccggtaacgttaacgttaacgtttaacgttacgggttacggacgggtaacggaaaggtaccgtaacgggtaccggggaccggtacccccggttaccccggggtaacgtaacggg

SEQ ID NO: 39948 - DNA, 657 bp, Homo sapiens
  misc_feature: GYAE6OF02I01NX.35.67.G01.1.454.CMB.1.raw
tcagtacagatcgtcacgaccggtgctcgatttagagtatacatattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgacccccaaactcatgtattttgagtcagtaagcggccctcgacgggtcctgatcgcttctcgtgctacagtctgacacaccggtcctccctaccgtctcgtcggctcagactgagtatgagctgtatttattactgactacgtctacatactgcaggtaccacgtacgttaaccggtttgtaacggtttcgggaccgggtacgggtaaccttaaggttaccgtaacccgttaccgttaaacggtccgtaaccggacccgtaacgggtcccgttacccggtacccccgttcggttacccttaccgttcccgttcccggttacccccgtccccttcccgtaccgtaccgtacgttaccgttccgtacgtacggtacggtcccggtacggtacgggaccgaacgggtccgaccgtagtacg

SEQ ID NO: 39949 - DNA, 709 bp, Homo sapiens
  misc_feature: GYAE6OF02H7RJY.35.67.G01.1.454.CMB.1.raw
tcagtacagatcgtcacgaccggtgctcgatttagagtatacatattgggtttgggtctgggagaggagcccagctactacgaagtcggcggtgtttcccatccggtgatcagcactgaacacagaggactcaccatggagtttgggctgagctgggttttcctcgttgcttactttttaagaggtgtccagtgtcgaggtgcagcgtggtgagtcgtgggggagtcgtggtccagccgtgggacgtccctgagactctcctgtgacgcgtctggattcattccttactaaattaacttagttgggactagtgcctacggttccggggtaccccgccgacgggtccctaccggacgggccgtaaaagggggtcttggggtacggttcggggttaggaccgtaaaggtttggtaggttaggtaagttacggaagtagggtaaagtaatagtattacgtagtacggacctaacgtaccgaccggtaggtaacgggaccgtaatacccgaacctaatacccgtaaccgaaaggtactaactaacgttaacccgaaagtaaccttacgtttgttaccctagacctaaagtacgaacgacgtaccgtaggaaccgacggtaccgaaggtaccgacggtacgtaagttaagtacgttcgtaaggtcgtacgtaggacgtaccggttagtacgggttacccacccgttaacccggg

SEQ ID NO: 39950 - DNA, 770 bp, Homo sapiens
  misc_feature: GYAE6OF02JY4PR.35.67.G01.1.454.CMB.1.raw
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
tcagtacagatcgtcacgaccggtgctcgatttagagtatacatattgggtttgggggggtcgacaagaggcagcgctctcgggacgtctccaccatgcctgggctctgctgctcctcactctcctcactcaggacacaggtcctgggcacagtctgccctgactcagcctgcctccgtntctgggtctcctggacngtcgatcaccatctcctgcactggaaccngcagcgatggttggggttatgtacttgtcctccgttggtactctaacgacgccacccgaacgaccaaacccggacccccctaaaacttcctttaaattttaacgtaaacggaacctaaaccgttaacgaccgtaacccctacgtaacgggtacctttaacgtaacgttcgtacctttctcgtcggtacctaccgtaacgtcctagggtactaacccgtccgtacccgttccctacgtaacctaaccgttcctacggtccgggtacccgttcccggggtcctacgggtaaccgggtaaccggaccgggtcgttaaggtaactttttaacgtttaagtttcggtttacgtcgtaaccttaagtttaagtcgttactaagggtttaagacgtaccgtaaagtttaacgttccgtttaaaccgtttagggaacccgttagggaacccttaacgggttccctaacccgggttctaaccgggttacctaacccgaaccccggttaaccgaacccccgtaaacccctacgtttcccggaacccttacccgg

SEQ ID NO: 39951 - DNA, 669 bp, Homo sapiens
  misc_feature: GYAE6OF02J0U94.35.67.G01.1.454.CMB.1.raw
  modified_base (227)..(227): a, c, t, g, unknown or other
  misc_feature (227)..(227): n is a, c, g, or t
  modified_base (270)..(270): a, c, t, g, unknown or other
  misc_feature (270)..(270): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatccaccatcctcctgcactcggaaccngcagcgatggttggggttatgaccttgtctccgtgtatcaacngcaccgagaccaacgaccccaactacttaattatacggaacacaacgccgacctagtaggtactttactaacgtcgctttccgtcgtgtccttaccgtaacgttcgtacggacctaacgtccggccctccctagacctaacttcgtcggtacgggccgttaccggggctaggaaccgggacgggtacggtcgtaggttacgtttaagttttacgttcgttacgttacctcgtatttaagtcgtacggtaagggttcgttaaacgctttaacttaacgttcggttacgtaccggttaacggtacgggtaaccgttacgggttacctaacccgtttcggtaaccggtccgtaccgaccccgtaacgggacccccttaaacccggcttaccgtaccgttacc

SEQ ID NO: 39952 - DNA, 249 bp, Homo sapiens
  misc_feature: GYAE6OF02FP6WY.35.67.G01.1.454.CMB.1.raw
  modified_base (249)..(249): a, c, t, g, unknown or other
  misc_feature (249)..(249): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaacccccactgtcactctgttcccaccctcctcacgatctgtactgagcgggctggcaaggcgcatagn

SEQ ID NO: 39953 - DNA, 250 bp, Homo sapiens
  misc_feature: GYAE6OF02IHR8E.35.67.G01.1.454.CMB.1.raw
  modified_base (245)..(250): a, c, t, g, unknown or other
  misc_feature (245)..(250): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctctcacgatctgtactgagcgggctggcaaggcgcatagnnnnnn

SEQ ID NO: 39954 - DNA, 546 bp, Homo sapiens
  misc_feature: GYAE6OF02F5XET.35.67.G01.1.454.CMB.1.raw
  modified_base (373)..(373): a, c, t, g, unknown or other
  misc_feature (373)..(373): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccgattcaccatctccagagacaattccaagaacactttgtcctgcaaatgaacagcctgagagccgaggacacggccgtatactactgngacgaacttgccgactacgattatttgagttggtcttgtactacgtggggccagggacgcccgtggtcatcgtctcctcacgcctccaccgaacggcccacgtccggtccttcccccgtggccctacccctccctacccgaacgcgccacccgtcgtcggggccacgtaccgg

SEQ ID NO: 39955 - DNA, 281 bp, Homo sapiens
  misc_feature: GYAE6OF02GCI21.35.67.G01.1.454.CMB.1.raw
  modified_base (244)..(244): a, c, t, g, unknown or other
  misc_feature (244)..(244): n is a, c, g, or t
  modified_base (250)..(281): a, c, t, g, unknown or other
  misc_feature (250)..(281): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaacccccactgtcactctgttcccgccctcctcacgatctgtactgagccgggtctggcaaggcncatagnnnnnnnnnnnnnnnnnnnnnnnnnnnnnnnn

SEQ ID NO: 39956 - DNA, 636 bp, Homo sapiens
  misc_feature: GYAE6OF02HBVCW.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaaggccgattcaccatctccagacgacaacttccaaagtaaacctacttttcgttcctaggaccaaaattcgaaacacggtacctgaacggacgcccggaaggaaccgacgggacgaattaactacgtttacgtgtacggacgaagaaggacgagtcgggacgacccgtaccccggatcggacgcgacggtcggggccgagggccacccggtcggcgtcccgtcttcctcgacgtccctaccgaaccgacggccctacgtccgttccttcccgtccgtccggaccctaccccgttccctacccgaacggtaccgtcccgtaacccgtccgggtacgggggtacccaccggtacccggg

SEQ ID NO: 39957 - DNA, 708 bp, Homo sapiens
  misc_feature: GYAE6OF02IQDOW.35.67.G01.1.454.CMB.1.raw
  modified_base (278)..(278): a, c, t, g, unknown or other
  misc_feature (278)..(278): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgcctccgtgtctggtcctcctggacagtcgatcaccatcctcctgcactcggaaccagccagcgagttggttaggggttatgaccttgtctctgtactcaacacncaccctaggacaaaccgaccccctaaacttcttaaattacgtaaggaccaacttaacgccgaacccctagtacgggtactttactaacgtcgtctttactacgttcggtcctaccgtaagtcgtacgtacctaacgttccggacccttcccgtacgaaccgaatttccgcgttacgggccgttcccgggtcaggacgggaacgacggtactaggttactttaagtttagtttcggttaccgtactacctaatgttacggacggttaacgggttaagtaacgtaccttaaacggtttagttacggtttaccgtacgggtaaccgtacgggttaaccctaagggtcccgttaacccgttacccggtagtcccggtaaaccgacccgtaacggaacccccttaaccccgacgttacccggtaccttaacccgg

SEQ ID NO: 39958 - DNA, 562 bp, Homo sapiens
  misc_feature: GYAE6OF02FVS0P.35.67.G01.1.454.CMB.1.raw
  modified_base (396)..(396): a, c, t, g, unknown or other
  misc_feature (396)..(396): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgaagcgtctggattcatcttcaatactatggcatgcactgggtccgccaggctccgaggcaagggctggagttggtggctagttgtgtgtatgagtggaagtaatagatactagtgcagacacgtgaaggccatcactatcnccgagagacaatccaaagactactttgtacctgaactaagacgaacagaccctgaacgtacggccgaaggaccaccgggtacgaacgttaataacgttacgtacggttaggacgtaaacggtacggtccggtaaggtcggggacccgtccccgtaaacccccgggg

SEQ ID NO: 39959 - DNA, 626 bp, Homo sapiens
  misc_feature: GYAE6OF02GROJB.35.67.G01.1.454.CMB.1.raw
  modified_base (198)..(198): a, c, t, g, unknown or other
  misc_feature (198)..(198): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacaggtgacgcctccagggtaggggtcttggggacctctggactgatccttggtctcccgntcctcaggctcaccggggcccagcactgactcagtgcatgtgttcnccctnttccgaggtcctgggcacagtctcgccctgactcacgcctgccctcgtgtcgtcgggtctccgtggacagtcgactccacctactcctcctgccacgtacggaaccacgcacgcgagttgggttagggggttatcggtaccttgtcctccgttaggtactacgaacacgaccaacccgacggaccaaaccgaccccctaaacttacttaaacttacgaagaccaactaacgaccgaccctacgaacggttactttacgtaactcgtaccttacgtccgtacgtaccttaccgtacgttcgtacggtaccgtaaccggtccgtaccctacccgttagaacctaacttccggtccgtacgggtccgtccgggatacggg

SEQ ID NO: 39960 - DNA, 677 bp, Homo sapiens
  misc_feature: GYAE6OF02HS64H.35.67.G01.1.454.CMB.1.raw
  modified_base (179)..(179): a, c, t, g, unknown or other
  misc_feature (179)..(179): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggtttcctcgttgctcttttaagagtntccagtgtcaggtgcagctggtggagtcgtgggggagcgtggtccagcctgggagtccctgagactctccgtgtgaagcgtctggattcattcttacaataactagtggcatgactacgttgggtccgccgaggcctccgagggacaaggggtacgtgggaggttcgggttggctaggtttgtgggttcggttagtgagtagggtaaagtaagtaggaattacgttatcgacgagaaccgacggtagggaacgggtaccgtagtaccactagttccctacgacgtagaactaacttacccgaaagtaaacccttagttttccgttaccgtacgaaactaaacgtcgaacgtacgtaccgtagtaacgggacggacccggtaacgggaaccgtaccggggtacgtaacgttaagttaactttacggtcggttaacggaccggaaaggtacggtaccggtaagggtttcccggggaccgttacccccggtaaaccccggg

SEQ ID NO: 39961 - DNA, 665 bp, Homo sapiens
  misc_feature: GYAE6OF02GMRIG.35.67.G01.1.454.CMB.1.raw
  modified_base (193)..(193): a, c, t, g, unknown or other
  misc_feature (193)..(193): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtncagctggtgcagtctgggggcgcgtggtccagcctgggagtccctgagactctcctgtgaagcctctggattctccttcaagaactatggcatgcacgtgggtccgccaggctccgaggcaaggggctggagtgggtggctaggtgtatacgtctagtttgataggaaagtaaaataaacgattacgactaacgaccgttccggtaaggaacgggaccgtaactttccgaaccctaagtacctaccgaaggaacgtaaccgtaaacgttaacccgaaaacggaaacctaacctttacgtaccgttacccgttacgtcgtaccgtaacctaagtacggaaactaacggttccgttaccgggaaccgtacggaaacggtaccgtaccggtacgttacgtacgttaacgttacgttaggtcggtacggaagaacggtacttaaaccggtaaattacggttacgtaggttaaccgg

SEQ ID NO: 39962 - DNA, 504 bp, Homo sapiens
  misc_feature: GYAE6OF02GSPTX.35.67.G01.1.454.CMB.1.raw
  modified_base (338)..(338): a, c, t, g, unknown or other
  misc_feature (338)..(338): n is a, c, g, or t
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
  modified_base (455)..(455): a, c, t, g, unknown or other
  misc_feature (455)..(455): n is a, c, g, or t
tcagtacagatcgtcacgaccggtgctcgatttagagtatacatattgggtttggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgaagcgtctggattcatcttcaatactatggcatgcactgggtccgccaggcctccgaggcaagggctggagtggtggcagttgngtggtatgatggaagtataggatatatgcagacacgtgagggcgatcacatctcanagacaatacaagaactacttgttcctnacaatagaacagactgagacgacgacgacgacgnatatagtactgtgacgagagacgagtggacgaccgtaccccggagtacg

SEQ ID NO: 39963 - DNA, 584 bp, Homo sapiens
  misc_feature: GYAE6OF02HKJ78.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccaggcaagggactggagtggttgcagttgtgtggtatgatggaagtaatagatactatgcagacaccgtgaagggccgattcaccatctccagagacaattccaaagaactactttgttcctgacaaatgaacagcctagagacgccgaggacgacggcgatatatactgtgacgagagacgagtgggacgccgtacccggatcgacgcgacggtcgggccgagggccacccgtcgggtccgtccgtacctcgtccgacgtccctacccacccgacggcccacgttcccggtcccttccccggtcggtccctccccgtcctacccgaacgaccacccgtaccgtccggtcgggggaccaccggtaccggtccccggg

SEQ ID NO: 39964 - DNA, 688 bp, Homo sapiens
  misc_feature: GYAE6OF02GF3C0.35.67.G01.1.454.CMB.1.raw
  modified_base (199)..(199): a, c, t, g, unknown or other
  misc_feature (199)..(199): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccnccaggctccaggcaagggactggagtggtgcagttgtgtgtatgatggaagtaatagatactatgacagacaccgtggaacgggccgattcacatcctaccagacacaattccaaagtaactacttttcgttacctagactaaatcgaaacagcctggacgacgcggacggacacggacgtaattataacttacgtggtacggacgaagaacggcgtagtacggggactaccccggtaaccccgggatacggacgaccgtacggtcggggaccgacggggaccctaccggtcgggtcccgtccggttccttccgttaccgaccgtacccctaccgtaaacccggaccgggtacccctacggttcccggttccccgttacccccgtacgggtcccctaaccccccgttcccgtaacccggtaaccgacccggtacccgtacccggttcccggggtacgggggtacccctaaccggaccgggtaacccggg

SEQ ID NO: 39965 - DNA, 252 bp, Homo sapiens
  misc_feature: GYAE6OF02HGDE8.35.67.G01.1.454.CMB.1.raw
  modified_base (248)..(252): a, c, t, g, unknown or other
  misc_feature (248)..(252): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggcccaaccccactgtcactctgttcccaccctcctcacgatctgtactgagcgggctggcaaggcgcatagnnnnn

SEQ ID NO: 39966 - DNA, 618 bp, Homo sapiens
  misc_feature: GYAE6OF02GSBFH.35.67.G01.1.454.CMB.1.raw
  modified_base (198)..(198): a, c, t, g, unknown or other
  misc_feature (198)..(198): n is a, c, g, or t
  modified_base (585)..(585): a, c, t, g, unknown or other
  misc_feature (585)..(585): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccncaggctccgaggcaagggactggagtggttgcagttgtgtggtatgatggaagtaatagatactatgacagacacgtgacggcgatcacatctacgagagactaactccaaagtaactactttgttcctagactaaaagtcgaaactacggtacctaggaacgaacggacccggtaaggaaccgacgggtacgaattaagtacttacgtggtagacgaaagaggacgtaaggtacgggaccgtacccgtaccccgggagtcgacgacgacgggtacgggacgacgggcctaccggtcggccgtccgttcctcgtaccgacgtccctaccgaccggaacgtccctacgttccggtccctcccgtacgccctaccctccgtacgacgcnccgtaccgcggccggactaccggacgtcccggg

SEQ ID NO: 39967 - DNA, 784 bp, Homo sapiens
  misc_feature: GYAE6OF02I0J0K.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcacttaacacagaggactcaccatggagtttgggctgagctgggttttcctcgttgctcttttaagaggtgtccagtgtcaggtgcagctggtggagtcgtgggggaggcgtggtccagccgtgggacggtccctgagactcctcctgtcgaagcctcgtggattctccttcaagtaacctatggacatgcacgtcgggtcccgccgacggcctccgacggcggaagggggcgtgggaggtgggtcggcgagtagatagtctagtttgagtagggaagttaaataaacacgttacgactaagacctccggtaggaacgggtcccgtaatttccgaaccctattcccgaccgaaggtaacctaactaaaccgttacccgaaaacgaacccgttaccttacgttaccgttacccgtacgtttaccgacctaaacgtaaccgttaacggaaaccgttacgggttaccggtaccggggtaacccgtttaacgggggaaacccggtacccggttaacccggggtacccgttttacggtttacccgtttaaacggttttaacccgttaggggtttaccgaacgggggttaaaaccggtaaacgggttaaacggtttaaaacccgtaaaaggttttaaccgtttaagggttaacccggtttaaccggttaagggttaaaccgg

SEQ ID NO: 39968 - DNA, 640 bp, Homo sapiens
  misc_feature: GYAE6OF02IB3TH.35.67.G01.1.454.CMB.1.raw
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggtttcctcgttgctcttttaagaggtgtccagtgtcaggtgcagctggtggagtcgtgggggaggcgtggtccaggccgtgggacggtccctgagactctctggtagagcgtctggattcaattcttacaaattaactagtggcagttcgcacgtgggtccccacaggtcctccgaggcaagggactggacgttggtggctaggttgngtgtatggagtggaaactaganattacgtaatgacaaggacgtaccggtaggaagggcctattacaccatctaccgaagacgactaacttaccaaagtaaccttgtttacgttaccctagaaccgtaataccgaacacgaccgtaggacgtaacgaccgggtaaggaaccgacgggtaccaagttacgttaacgttaaccgtaggttacggacgtaaacgggaacggtacggtacgggtaccgggaacccggtacccccggttaccccgggagtaaccggg

SEQ ID NO: 39969 - DNA, 541 bp, Homo sapiens
  misc_feature: GYAE6OF02H5AZV.35.67.G01.1.454.CMB.1.raw
  modified_base (298)..(298): a, c, t, g, unknown or other
  misc_feature (298)..(298): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgagcgtctggattcatctcaataactatggcatgcactcgggtccnccaggctccgaggcaagggctggagtgggttgcagttgtgtgtatgatggaaagtanagatacatgcagacnccgtagaggcgatcacatctcaganacaattaccaataactactttcgttcctgactaatacgaacacgacctgacgtacgaccggacggaaccgacggacgatactagttacgttagtcggacgaagaacggacggtagtacgggacggacccgtacccccggagtacgg

SEQ ID NO: 39970 - DNA, 559 bp, Homo sapiens
  misc_feature: GYAE6OF02JOJVS.35.67.G01.1.454.CMB.1.raw
  modified_base (307)..(307): a, c, t, g, unknown or other
  misc_feature (307)..(307): n is a, c, g, or t
  modified_base (407)..(407): a, c, t, g, unknown or other
  misc_feature (407)..(407): n is a, c, g, or t
  modified_base (451)..(451): a, c, t, g, unknown or other
  misc_feature (451)..(451): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagctctcctgtgaagcgtctggattcattcttacaataactatggctatgctacgtcgggtccncaggcctccgaggcaagggactggagttggtggcgtagttgtgtggtatggatggaaagttaatagatactatgacagacacggtggaggcatcacatcncgagagacataccaagaactactttcgtcagaacaagtcgaacncgacctggacgacgaccggacgtaacgacggacgtagtacgtaattacggtgtaggaccgaagtacggacggtaggtcggtaccgtaccccgtaccccggagtaccgg

SEQ ID NO: 39971 - DNA, 536 bp, Homo sapiens
  misc_feature: GYAE6OF02IKTG9.35.67.G01.1.454.CMB.1.raw
  modified_base (199)..(199): a, c, t, g, unknown or other
  misc_feature (199)..(199): n is a, c, g, or t
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgtcctgactcagcctgcctccgtgtctgggtctcctggacngtcgatcaccatctcctgcactggaaccagcagcgatggttgggggttatgaccttgtcctcctggtatcaacngcacccaggcaaacgcccccaaatcttaattanaagacactaagcaccctnagggtatttcgtaatcgcttctcgtggcctcaagtctgacacgtccgcctcccngactatctgtcggctccggntggagtcgagctgtattattnttgtgctnatangntagtagtanctactatnttaccgttacggaactgggaacctaggtccaccggtcgtaggtccacgtaccgaccggtacccaaccccgtagtccgtactacccg

SEQ ID NO: 39972 - DNA, 623 bp, Homo sapiens
  misc_feature: GYAE6OF02GCOVA.35.67.G01.1.454.CMB.1.raw
  modified_base (410)..(410): a, c, t, g, unknown or other
  misc_feature (410)..(410): n is a, c, g, or t
  modified_base (446)..(446): a, c, t, g, unknown or other
  misc_feature (446)..(446): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttgggggttatgaccttgtctcctggtatcaacagcacccaggccaaacgcccccaatcttaattataaggacaactaacgcgaccctgaggtatttctaactcgtcttctcgtggctaccgaagtctggctaacgtccggccctcctgaactactcctcgtcgggtcctccgggntggacggacgaggctagtatttagttagtttgttcnctcattagtgacgtaggttaacgtaggaccttaacgttaacgttcggttaccgtttaccgggaacgttacggggaacctaacgggtcccgtaacccggttaccgttaacgggtcctaaccggtacccccgtaaacgggtacccccctaaacccctacggttaccgtaccgtaccccg

SEQ ID NO: 39973 - DNA, 767 bp, Homo sapiens
  misc_feature: GYAE6OF02IO26Z.35.67.G01.1.454.CMB.1.raw
  modified_base (335)..(335): a, c, t, g, unknown or other
  misc_feature (335)..(335): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctgagcttgggttttcctcgttgcttcttttaagaggtgtccagtgtcaggtgcagctggtggagtcggtgggggaggcgtggtccagccgtggggacggtccctggagtacctcctccgtggtaggaagccgttacgtggtattccattccttacaaattaacgtatggcagtgacctacggtcgggtccnccgaggtcctaccgaggcgtaagggactgggtacggttgggttacggcgttaggttggtcgtaggttaagtggaagttaagggaaagttaagtaaggtactaactagtcggaacgtagaaccgtaccggtaggaaacgggtccctaacgttaccccaccgtaacgttcccgtaaccggaaacggtaacgaaccgttaaacgttacccgaaaaacgttaacccgtttaaccgtttttaccgtacccgttacggtaaaccttaaaggtaaccgaaactaacccggtccgtaggaaaccggtcgaacccggaaacggaaccgaccggtaacgaccgtttaagttaaccgttaacccgtggtaacgaacggtaacggtaaggtaccggtagggtaaccggacccggtaacccccggttaccccggagtaacccggg

SEQ ID NO: 39974 - DNA, 506 bp, Homo sapiens
  misc_feature: GYAE6OF02FI789.35.67.G01.1.454.CMB.1.raw
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (391)..(391): a, c, t, g, unknown or other
  misc_feature (391)..(391): n is a, c, g, or t
  modified_base (431)..(431): a, c, t, g, unknown or other
  misc_feature (431)..(431): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgagcgtctggattcatcttacaattaactatggcatgcacgtgggtcccnccaggcctccgaggcaagggctggagtggtgcagttgngtgtatgatggaatatagatactatgcagacacgtagaggcatcacatcncagagacataccaagactactttcgtcctgacaatgaacncgctgacgagccgaggacacggngatatagttacngtgacgtagagcgagtcgggacncccgtacccggatacgg

SEQ ID NO: 39975 - DNA, 256 bp, Homo sapiens
  misc_feature: GYAE6OF02IA2GE.35.67.G01.1.454.CMB.1.raw
  modified_base (185)..(185): a, c, t, g, unknown or other
  misc_feature (185)..(185): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (243)..(256): a, c, t, g, unknown or other
  misc_feature (243)..(256): n is a, c, g, or t
tcagtacagatcgtcacgaccggtgctcgatttagagtatacatagttgggtttggggggtttgtggtctccactcccgcttgacgaggctgattattattgttgctcatatgcaggtagtagcactaatgtcttcggaactgggaccaaggtcaccgtcctaggtcagcccaaggccaaccccntgtcactctgttccccgcctctcacgatctgtacngagcggctggccaaggcncatgnnnnnnnnnnnnnn

SEQ ID NO: 39976 - DNA, 253 bp, Homo sapiens
  misc_feature: GYAE6OF02F0J4Y.35.67.G01.1.454.CMB.1.raw
  modified_base (246)..(253): a, c, t, g, unknown or other
  misc_feature (246)..(253): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnnnnnn

SEQ ID NO: 39977 - DNA, 589 bp, Homo sapiens
  misc_feature: GYAE6OF02GCYD4.35.67.G01.1.454.CMB.1.raw
  modified_base (193)..(193): a, c, t, g, unknown or other
  misc_feature (193)..(193): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtncagctggtggagtcgtgggggaggcgtggtccagccgtgggaggtccctgagactctcctgtgagcgtctggattcatcttcaataactatggcatgcacgtgggccgccgagcctccgaggcgaagggactggagtggttggctagttgtgtggtatgagtgaagtatagatactatgacagacacggtaggaacggtaccattacaccataccgtaccagacaactaacttaccaacgtaacttcgtttacgtacctagaacaagtcgaaactcgtacgtaggtacgacgacgaacggacacggacgtattagttaacggttacgtaggtacggaacggaacggtaacgtacggtacggtacgggaaccctaccccggtaccccggagtaccgg

SEQ ID NO: 39978 - DNA, 525 bp, Homo sapiens
  misc_feature: GYAE6OF02G1PUG.35.67.G01.1.454.CMB.1.raw
  modified_base (398)..(398): a, c, t, g, unknown or other
  misc_feature (398)..(398): n is a, c, g, or t
  modified_base (437)..(437): a, c, t, g, unknown or other
  misc_feature (437)..(437): n is a, c, g, or t
  modified_base (512)..(512): a, c, t, g, unknown or other
  misc_feature (512)..(512): n is a, c, g, or t
tcagtacagatcgtcacgaccggtgctcgatttagagtatacatattgggtttgggtctgggagaggagcccagcactagaagtcgacggtgtttccatccggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgaagcgtctggattcatctcaataactatggcatgcactgggtccgccaggctccaggcaaagggctgggagtggttgctaggttgtgtggtatgatggaaagtaatagatactatgacagacaccgtagaggcatcaccatcncagagacaataccaagaactactttagtctagactaaangaaacagcctagagagccgaaggaccacggacgaatactaattactggtagacgaagaacggcgagtcggggacncccgtaaccccgg

SEQ ID NO: 39979 - DNA, 628 bp, Homo sapiens
  misc_feature: GYAE6OF02HF5J7.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcaccatgggagtttgggctgagctgggttttcctcgttgcttcttttaagaggtgtccagtgtcaggtgcagctgggtggagtcgtgggggagcgtggtccagccgtgggacgtccctgacgctctcctgtgacgcgtctggtattcattcttacaaattaactagtggactagtcgctacggtcgggtcccgccgaggcctaccgaggacgaaacggggcttgggaggttgggtggtacgtagtttggtggtggttatcggtagtaggtaagtaagtagaattacgtagtcgactagaccgtacggtaggaacgggtaccgtatcccgaactctacgtaccgagaacgaattaaccgttaaccaaacgttaactactttcgtcctagtaactaatacgaactacgtactagacgacgacggaacgaccgacggtatagtaacttaagtacgtaggacgaagtaacggacgcggtacggacgggcccgtacccgtaccgg

SEQ ID NO: 39980 - DNA, 573 bp, Homo sapiens
  misc_feature: GYAE6OF02HBZTL.35.67.G01.1.454.CMB.1.raw
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
  modified_base (442)..(442): a, c, t, g, unknown or other
  misc_feature (442)..(442): n is a, c, g, or t
  modified_base (566)..(566): a, c, t, g, unknown or other
  misc_feature (566)..(566): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtggggggaggcgtgggtccagcctggggaggtccctgagactctcctgtgaagcgtctggattcatcttcaataactatggcatgcactggggtcccnccaggcctccgagggcaaggggctgggagtggttggcagttggtgtggtatgatggaataanagatactatgcagacacggtgaacgggccattcactatcctacatagactattaccaaagtactctttgtcctnacaaatgaacagaccgtggaacgacgaccggaacggaccgaccggtcgtaattacgttattacgtggtacggaacggaaggtaacggacggtacggtacggggaccgtcccccggtaacccggngtaccgg

SEQ ID NO: 39981 - DNA, 564 bp, Homo sapiens
  misc_feature: GYAE6OF02I0SN9.35.67.G01.1.454.CMB.1.raw
  modified_base (420)..(420): a, c, t, g, unknown or other
  misc_feature (420)..(420): n is a, c, g, or t
  modified_base (535)..(535): a, c, t, g, unknown or other
  misc_feature (535)..(535): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgcaggctccaggcaagggctggagtggttggcagttgtgtggtatgatggaagtaatagatactatgacagacacgtgaacgggccgattcaccatcctccagagacaattccaaagaactactttgttccagacaaatgaactagcctgagagaccgaggacacggcgaatactattactgtgacgaagagacggagtaggggacgtcccgtaaccccggntcgacgcgacggtggggcccacgggccaccgtgggtccgccgtcctcgttcacgccctaccaccggacggccctagtccgttccttccccgtgcccaccctccaccaacgcgccnccgtcggtccggggacaccgcggtcccgg

SEQ ID NO: 39982 - DNA, 552 bp, Homo sapiens
  misc_feature: GYAE6OF02HBBPB.35.67.G01.1.454.CMB.1.raw
  modified_base (342)..(342): a, c, t, g, unknown or other
  misc_feature (342)..(342): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgaagcgtctggattcatcttcaatactatggcatgcactgggtccgcaggcctccgaggccaagggctgggagtggttggcaggttgngtgtatgatggaatatagatactatgcagacacgtgaacggcattcaacatctacagagaactacttaccaagacttactttcgttacctagactaaatgaaacacgtcctagacgtacgccggaaggaaccgtacggacgagttacttagttacgtagtggacgaagaacggcggaagtcgggaccgacccggtaccccggagtaccgg

SEQ ID NO: 39983 - DNA, 590 bp, Homo sapiens
  misc_feature: GYAE6OF02F13QF.35.67.G01.1.454.CMB.1.raw
  modified_base (468)..(468): a, c, t, g, unknown or other
  misc_feature (468)..(468): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctgagctgggttttcctcgttgctcttttaagaggtgtccagtgtcaggtgcagctggtggagtcgtgggggaggcgtggtccagcctggggaggtcccctgagactctcctgtgaagcgtctggattcatcttacaataactatggcatgcacgtggggtcccgccaggctcccaggccgaaggggactgggagttgggttggcgtaggttggtgttggtatgagttaggaaagttaagtagatactatgacagacaccggtggaacgggccgattccacactctaccagacgacaacttaccaagaactactttcgttcctanactaaatacgaaacacgacctaggacgacggtaccgacggaaccgacgggacgtatagtacgtttactaggtagaccggagaaggtcgaggtcgggacgaccccggtaccccggagtaccgg

SEQ ID NO: 39984 - DNA, 799 bp, Homo sapiens
  misc_feature: GYAE6OF02JJVWV.35.67.G01.1.454.CMB.1.raw
  modified_base (177)..(177): a, c, t, g, unknown or other
  misc_feature (177)..(177): n is a, c, g, or t
  modified_base (207)..(207): a, c, t, g, unknown or other
  misc_feature (207)..(207): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagttgggctgagcgtgggtttcctgttgcttacttttaagnggtgtccagtgtcaggtgcagctgggtggngtcggtgggggagtcgtggtccaggcccgttagggggaccgttcccgtaggacgaccttctccgttggtagaacggtccgttcgtagggtactttcgattccttacgaaatttaaccgtgtaggactaatcgaccgtacggtcggtcccgcgacgccgtacgaagggcctaaggggacctggggtacggtggtaaggtcgtaaggttcgtggttggtagtggaagtagggtaaagttaataacggatttacggacttaggaccgtaacgtaacgggtaaccgggtaacggtaaccgggtaccgtaacttaacccggaaccgttaaccgttaccggtaacgtaaaccggtaaccgttaaacgtaaaccgtttaaaccctaaacggtttaaaccgttacctttacggttacccttaaacgtaaacctaaagtaaccgtaaccgttacggaaacgttaacggaccggaacgtaacccgggacgaaccggaacggttaccgtaagtttaaacgttccccggtaagttcgggtaagggaccgtaacgggtaaagcccgggttaaggtcccgggtaaccctaccggttaaccccgggg

SEQ ID NO: 39985 - DNA, 594 bp, Homo sapiens
  misc_feature: GYAE6OF02HVIHV.35.67.G01.1.454.CMB.1.raw
  modified_base (391)..(391): a, c, t, g, unknown or other
  misc_feature (391)..(391): n is a, c, g, or t
  modified_base (419)..(419): a, c, t, g, unknown or other
  misc_feature (419)..(419): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtgtccagcctggggagtccctgagactctcctgtgaagcgtctggtattcattcttacaataactatggcatgacacgttgggtcccgaccgaggtcctcccaggctaagggcttggagtggttggctaggttcgtaggtggtattgagtagggaagtactaggactatagtnacgagtacacgtgaggctattcgaaccnttcacagtacgacacgttaccagtaactactttcgtctacgaactagtacgaacagtccgtagacgacgaccggaacggaacgacggaccgagttactaagttcaggttcgaacggaaggaacgtacgggtaggaccgggtaacccggtaccccgttacccccgggattaccggg

SEQ ID NO: 39986 - DNA, 595 bp, Homo sapiens
  misc_feature: GYAE6OF02H4JUD.35.67.G01.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
tcagtacagatcgtcacgaccggtgctcgatttagagtatacatattgggtttttcctcgttgctcttttaagaggtgtccagtgtcaggtgcagctggtggagtctggggggaggcgtggtccagcctgggaggtccctgagactctcctgtgaagcgtctggattcatcttcaaataactatggcatgcactgggtccnccaggctccaggcaaagggactggagtggttggcaggttgtgtggtatgatggaagtatagatactatgcaagacacgtgaaggcatcaccatcncagagacaatcaaagactacttgtcctgacaaatgaaacngctgaacgagccgaacgacacggacctaattactaacgtgtacgaacgtaaaagtggacggtaacgtagggaagttaggtacgtacgtactcgtcgtggggccgtggaccacccgtgtactacgttcgtccgtcctacaccgtcctaccgtaaccgaaccgggccacgttcccgtcccttccccgtacggtcccgaaccctccctaccgaacgacgaccgtccgtaccggtcggggaccacgaccggccggtaccccgg

SEQ ID NO: 39987 - DNA, 747 bp, Homo sapiens
  misc_feature: GYAE6OF02HFXCF.35.67.G01.1.454.CMB.1.raw
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttggggtatgtaccttgtctcgtggtatacaacacgccacccgaaggaccaaaaccgaccccctaaaacgttactttaaacgtttaacgtaaacgggaacctaaccgtaaacggacccgaaccccgttcgaaacgggtacttttaaccgtaaagtccgttacccgttttacctccgttacgggtacctttacccgtaaaggtttcccgtagggtaaccctaaccggttcccggtaccccttcccgttaggaaccttaacgttccgtttcggtaccggggtccgtttaccccgggggactacggggaacgggaccgtagggtccttagtaacgtttagttttacgttcgttcgcctatagttactggtaacgtgggttacgtacgtacgtaaccgttaagtcgttaaccgttcggtaacggtacgggtaacgtacggtaccgtaccggtttaccgtaggtccgaaccggtcccgaaaccggcccctaacccgtcgttacgcccttacccg

SEQ ID NO: 39988 - DNA, 634 bp, Homo sapiens
  misc_feature: GYAE6OF02JC0DQ.35.67.G01.1.454.CMB.1.raw
  modified_base (198)..(198): a, c, t, g, unknown or other
  misc_feature (198)..(198): n is a, c, g, or t
tcagtacagatcgtcacgaccggtgctcgatttagagtatacatattgggttttcctcgttgctcttttaagaggtgtccagtgtcaggtgcagctggtgcagtctgggggcggcgtggtccagcctgggaggtccctgagactctcctgtgaagcctctggattctccttcaagaactatggcatgcactgggtccnccaggctccaggcaggggctggagtgggtgcagtgatatcatttgatggaagtaataaacattacgcagactccatcgagggccattcaccatctcagagacacttaccaagactactctgtcctctgacacatacgaactacgtcgtacgggacctggacggaccgacggtctacggttacttagttacgttgtcgacggtaagaagtataaacggtaaattagttggtagtaccgttaaggttacgtactaggtttcgtacgtttaccggttaccttttttcgaagttacgttacgtaccgttacggtcgggtaccggtaacgggtaacccttgggtcctaacgttcgttccgtaccgtcgtacgcccttaccgaccggtaacggcccgtacgttccggttaccccgttccccgtaccggtccccttacccccg

SEQ ID NO: 39989 - DNA, 700 bp, Homo sapiens
  misc_feature: GYAE6OF02GUGMN.35.67.G01.1.454.CMB.1.raw
  modified_base (229)..(229): a, c, t, g, unknown or other
  misc_feature (229)..(229): n is a, c, g, or t
tcagtacagatcgtcacgaccggtgctcgatttagagtatacatattgggtttgggggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccngcagcagttggttagggggttataactatgtctcctacggtaccaacgaccacccgaggaccaaaccgaccccctaaactccaagttagtaacgttttatacgtaattgtactaagttaacgtccgggtccctacggttacggggtttactaacgtccgtcctttcctacgtcgtaccttacccgtaacggttcgtacggaacctaaccgtacccgggtccccttcccgtacgtaacccgtacgttccttccggttcggggtcccttaccgaaccgggtccgtaacgggacccggtaaccggtcggtacgttacggtaacttttacgttaccgtcgtactacggtcccttacgaaacttactaaacgacgacacgtcacgtacctacgttcgtcggttcggtacgggacggtacggacgtacgtccgtacggtcccgttacgaggttacccgaacgtcccggagtccccgg

SEQ ID NO: 39990 - DNA, 620 bp, Homo sapiens
  misc_feature: GYAE6OF02HKT6E.35.67.G01.1.454.CMB.1.raw
  modified_base (274)..(274): a, c, t, g, unknown or other
  misc_feature (274)..(274): n is a, c, g, or t
  modified_base (503)..(503): a, c, t, g, unknown or other
  misc_feature (503)..(503): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtcccgccaggctccgaggcaagggactgggagttgggttggcaggttgtgtggtatgatggaagtaatagatactatgnagacaccgtgaagggccgattcacatctccagagacaattccaagtaactacttttgttccctgacaaatgaacacgccttgaacgacgacccggaaggaccacggggacgaattactaactttacgtgtcgacggaaggaaggacggagtggggaccgacccgtaccccggatcggacgcgacggtcgggaccgacggccgaccgtcggtaccgtccgtcctccgtcncgtccctaccgaccgaccggaccacgttccgtcccgttccccgtcggtccctaccccgtcctaacccgaacgtccgacccgacccggtccggtaccggggccacggtcgtccccggg

SEQ ID NO: 39991 - DNA, 586 bp, Homo sapiens
  misc_feature: GYAE6OF02JKAJY.35.67.G01.1.454.CMB.1.raw
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttgcagttgtgtggtatgatggaagtaatgatactatgcagacacggtgaacgggccgattcaccatctccagagaacaattccaagaacacttttgtacctgacaaatgaaacngcctagagagaccgaggacacggcaatatacttangtgcgagaagngagtgggacgccgtacccggatcgagccgacgtcgggacgacgggccacccgtgggtaccgtccgttccgtccgttacgaccgcccgtccgaaccgaacggcccgacttaccggtcccttccccgtcggacccgtaccctccgtacccgtaacgaccgtacctacccgtccggtccgggggaccaccggacggtcccgg

SEQ ID NO: 39992 - DNA, 608 bp, Homo sapiens
  misc_feature: GYAE6OF02GN6YV.35.67.G01.1.454.CMB.1.raw
  modified_base (373)..(373): a, c, t, g, unknown or other
  misc_feature (373)..(373): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccgattcaccatctccagagacaattccaagaactactttgtcctgacaaaatgaacagcctagagagccgaggacacggcatatattacngtagcgagaagcgagtgggacgaccgtaccccggagtcgaacgcgacgtcggggccacgggcacccgtacgggtccgcccgtcttccgttccgacgtcccgtacccgaacccgaacgggcccctaacgtccggttcccttcccccggtcggtcccctaccccgttacccctacccgaacggaccgacccgtacccgttccggttaccgggggccctaccggacggtaccccgggg

SEQ ID NO: 39993 - DNA, 602 bp, Homo sapiens
  misc_feature: GYAE6OF02JFAGC.35.67.G01.1.454.CMB.1.raw
  modified_base (303)..(303): a, c, t, g, unknown or other
  misc_feature (303)..(303): n is a, c, g, or t
  modified_base (465)..(465): a, c, t, g, unknown or other
  misc_feature (465)..(465): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgaagcgtctggattcatcttacaatactatgcatgcacgtgggtcccnccaggcctccgaggcgaagggctgggagtgggtggctagttgtgtggtatgagtaggaagtaatagattactatgacagacacgtaggaacggccgtatccacctatcctaccgagacgaacctaacttacccgaaagtaacctacgttttacgtaccttanacctaaatacgaacacgcgtaggacgacgccgaacggaccgacggactagttaacttacgttacgtaggtacggacgaacgtaacggtacggtacggtaccgggaaccgacccccggttaaccccgggagttaccgg

SEQ ID NO: 39994 - DNA, 261 bp, Homo sapiens
  misc_feature: GYAE6OF02IZ51E.35.67.G01.1.454.CMB.1.raw
  modified_base (247)..(261): a, c, t, g, unknown or other
  misc_feature (247)..(261): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaccccatgtcactctgttccccgccctcctcacgatctgtactgagcgggctggcaaggcgcatagnnnnnnnnnnnnnnn

SEQ ID NO: 39995 - DNA, 500 bp, Homo sapiens
  misc_feature: GYAE6OF02IT80E.35.67.G01.1.454.CMB.1.raw
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
tcagtacagatcgtcacgaccggtgctcgatttagagtatacatattgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcgcgtggtccagcctgggagtccctgagactctcctgtgaagcctctggattctccttcaagaactatggcatgcactgggtccgcaggcctccgaggcaaggggctggagtgggtgcagtgatatcatttgatggaagtaataaacattacgcagacgtccgtgaacggctatcacatcncagagacatcaagaacnctctntctcngcanatagacagtcgtggactgacgacncgntggtctagttactggtcgacgagagactaacgaattgttagagtacg

SEQ ID NO: 39996 - DNA, 681 bp, Homo sapiens
  misc_feature: GYAE6OF02HLIN6.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagcgtggtggagtcgtgggggaggcgtggtccagccgtgggacgtccctgagactctcctgtagagcgtcgtggacttcacttcttactaaattaacctagtcggcatgactaccgtcgggcccgccgaggcctcgaggaccgaagggcgtggtggtggtgagtagttggtgtggtatggagtaggaataagtagaacttacgtatacgacgtacgaaccgtaccggtaagggaacgggtacccgtaacttacccgaaccctaacgtcccgtaacccgaagggaaccgtaaaccttaaacgttaaccctaaaacgtaaaccgtttaacgttttccggttacctaacgtaacctaaacgttaacgaaccacgtacgtaggacggaacgaccgggaagacgaaccgggtacaagttacttaacgttacgtaggcggtacggaacggagtcggaaggtcggacccgtacccggtacccggtagtaccgg

SEQ ID NO: 39997 - DNA, 680 bp, Homo sapiens
  misc_feature: GYAE6OF02ID7YF.35.67.G01.1.454.CMB.1.raw
  modified_base (219)..(219): a, c, t, g, unknown or other
  misc_feature (219)..(219): n is a, c, g, or t
  modified_base (371)..(371): a, c, t, g, unknown or other
  misc_feature (371)..(371): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttggggttttcctcgttgcttctttttaagaggtgtccagtgtcaggtgcagctggtggagtcgtgggggnggcgtggtccagcctggggacggtccctgagacctctcctgtagacgcgtctggattcattcttacaatactatggcatgctacgtcgggtccgccgagggtcctccggaggccaaaggggtctgggaggttcggttgggcctaggttttgngggttaggttatggagtacgggaagttaaattacggaattacttaagtgacgacgaacctaccgggtaggtaacgggccgtacttaccgactactcctaccgaggacgaactaacttaaccgaaacgtaacttaccgttttacgttacccgtagtactaaacgtacgtaaaccgacgtaccacggaggacgccggaacggaccgaccggtacgtattaagttaacgttaacgttaggtacggtacggtaacggacggtacggtacgggtacgggtaacccgtaccccggtacccccgggtaagtaccgg

SEQ ID NO: 39998 - DNA, 600 bp, Homo sapiens
  misc_feature: GYAE6OF02GPAHT.35.67.G01.1.454.CMB.1.raw
  modified_base (198)..(198): a, c, t, g, unknown or other
  misc_feature (198)..(198): n is a, c, g, or t
  modified_base (344)..(344): a, c, t, g, unknown or other
  misc_feature (344)..(344): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (414)..(414): a, c, t, g, unknown or other
  misc_feature (414)..(414): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggcctccaggcaagggactggagtggttggcagttgtgtggtatgatggaataatagatactatgcagacaccgtgaacgggccgattcaccatctccagagacaacttccaaagaacacttttgtcctagacaaatgaaacncgctgacgagccgaggacacggngaatatacttcngtgacgagagcgagtcgggacgaccgaaccccggntacgacgcgacggtcggggaccgagggccgacccgtcgggtccgtcccgttctccgttcgaccgtccctccgaacccgacgggccctacgtccgtcccttccccgtccggcccttaacccctccgtaccctaacggaccgtacccgacccgttcggtaccggggccctaccggaccggtccccggg

SEQ ID NO: 39999 - DNA, 646 bp, Homo sapiens
  misc_feature: GYAE6OF02JIZJX.35.67.G01.1.454.CMB.1.raw
  modified_base (303)..(303): a, c, t, g, unknown or other
  misc_feature (303)..(303): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggtttctcgttgctctttaagaggtgtcagtgtcaggtgcagctggtggagtcgtgggggaggcggtggtccagcctggggaggtccctgagactctcctgtgaagcgtctggattcatcttacaatactatggcatgcacgtcggggtcccnccagggtcctccgaggcgaagggtctgggagttggttggctagttgtgtggtatgagtggaagtaatagtatactagtgacgacgacgaccgtagggaacgggacccgtaacttccgaaccctagttacccgtacgaacggtaacgtaaccgtaaactttacccgaaacggtaacttaccgttttcgttacccgttagactaaaacgtgaaccacgtacccttaggaagtccggaaccggacggaacggacccgggtacgtaacttagttaacgtttcggtaaggtgaaccggtaaggaagttaccggaggtacggggaccctcccggtacccggtagtacgg

SEQ ID NO: 40000 - DNA, 561 bp, Homo sapiens
  misc_feature: GYAE6OF02IFEFI.35.67.G01.1.454.CMB.1.raw
  modified_base (199)..(199): a, c, t, g, unknown or other
  misc_feature (199)..(199): n is a, c, g, or t
  modified_base (461)..(461): a, c, t, g, unknown or other
  misc_feature (461)..(461): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcacgtgggtccnccaggctccaggcaagggctggagtggttggcagttgtgtggtatgatggaagtaatagatactatgcagacaccgtgaaggccattcaccatctcagagacaattccaaagaactacttttgtcctagacaaaatcgaaacagcctaggacgacgccggaaggacacggcaatatattactgtgcgaagaagcgagtgggacgccgtacccggatcgagcgacgtcgggacgacgggccaccgtggtcgccgtctcttacncgtcctccgaaccgacggccctagtccgtccttccccgtcggcctaccctcctaccgacgacgccgtaccgtccggtcggggacctacggacggtcccgg

SEQ ID NO: 40001 - DNA, 542 bp, Homo sapiens
  misc_feature: GYAE6OF02F3CK8.35.67.G01.1.454.CMB.1.raw
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (375)..(375): a, c, t, g, unknown or other
  misc_feature (375)..(375): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgnagacacgtgaagggccgattcacatctccaganacaattccaaagaactactttntcctagacaaaatgaaacagcctgagagcccgaggacacggcatatattacngtgacgagaagcgagtgggagccgtaaccccggatacgagaccacgtcggggaccagggcacccgtggtccgccgtctctcacgcctccaccaacggcccagtccgtccttcccctggcccaccctcctaccgaacgcgaccaccgtcgtcggggacacgcgcccgg

SEQ ID NO: 40002 - DNA, 611 bp, Homo sapiens
  misc_feature: GYAE6OF02H4V3J.35.67.G01.1.454.CMB.1.raw
  modified_base (348)..(348): a, c, t, g, unknown or other
  misc_feature (348)..(348): n is a, c, g, or t
  modified_base (554)..(554): a, c, t, g, unknown or other
  misc_feature (554)..(554): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctggagggtccctgagactgtcttgtgcagcctctggattcaccttcagagactattcatgacctggatccgccagactccgagggaaggactggagtgggtctcacacatcagctagtacctggcaatcccatcgtactacgcacgactctgtagaagggccgattccacctagttttacgggacaacgccaaggttcgcgtgtatctgacaatagaacganccgtgacgagaccgaacgacgaacggctgtagtacttactgtgtacgaagacacgtaaggatagcggtaactaagtaagttcgggtacgtcgtttagtaattagtacgtcggggtacaagggtaacgtagtacggtaccgaaccgttcgtcttacgaccgtccgacctaaccggaccgtccctaacgtccggttccttaccccggngaccccgtacccctccgtaccaaacgggcctcccaccgttccggtcgggtaacccgg

SEQ ID NO: 40003 - DNA, 699 bp, Homo sapiens
  misc_feature: GYAE6OF02HLB9Y.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagctggtggagtcgtggggagcgtgtccagccgtgggacgtcctgacgactctcctgtagagtcgtcgtggtattcgattcttacaaataactatggacatgcacgtcgggtcccgcgaggcctacgaggacgaagggactgggagttggtggctaggttgtgtggtatgagtaggtaatagtaagtattacgtatgacgaacgactaccgggtaggaacgggcccgtaacttaccaaccgtactacccgtaccgaaacgtaacgtaaacctaaacttacccgaaaacgtaaaccgttaaccgttttcgtttaccctacgtaactaaacgttaacgaaaccgtaccgtaccgtaggtaacggaaccggaccgggtaaccgaacgaccggtacggtaacttaacgtttaacggtttaaccgttaggtacggtaacggtaacgggaagtaccggtacggtacggggaaccccgttacccccgggtacccccgggtattaacccggg

SEQ ID NO: 40004 - DNA, 710 bp, Homo sapiens
  misc_feature: GYAE6OF02JVQWA.35.67.G01.1.454.CMB.1.raw
  modified_base (364)..(364): a, c, t, g, unknown or other
  misc_feature (364)..(364): n is a, c, g, or t
  modified_base (617)..(617): a, c, t, g, unknown or other
  misc_feature (617)..(617): n is a, c, g, or t
  modified_base (625)..(625): a, c, t, g, unknown or other
  misc_feature (625)..(625): n is a, c, g, or t
  modified_base (643)..(643): a, c, t, g, unknown or other
  misc_feature (643)..(643): n is a, c, g, or t
  modified_base (679)..(679): a, c, t, g, unknown or other
  misc_feature (679)..(679): n is a, c, g, or t
tcagtacagatcgtcacgaccggtgctcgatttagagtatacatattgggtttgggtctgggagaggagcccagcactagaagtcggcggtgtttccatccggtgatcagcactgaacacgagacgctcaccagtggtagtttggctggagtcgttcgggtttcctcgttgccttacgttttaaagacggtctaccgaggtgtccgagggtcacgtaggcgtgggtggaggtcggtaggggggacgtccgtcgggtaccacggcccggttaggacgggttacccgtacgtaggtaaccgtcttccgtacggtaggtaacgcgtcgttgtacgttactactacttacaacttaacggggttaacnggtacgactaggtaccgacggttacgggtcccgaccgcggtaaccgtaccgtaacgggacggtaacgggaaggtcggtagggttaggtcggtaggttacgttgggtaggttcgggtaagttaaggtacggtaaggtaaaaggtaatacgtaagtacttaagcgacgacgtaaccgtaacgtaggtaacggcgtactactacacgtaccgtagaacgataacgactaaccacgtaactctttacgtctaacaanagtaacgngtaacgcgtacgagacgngacgacacgatagtaactgaacgtgacgtaagacgnggtaccgtagccgggtaacgccgtaacccgg

SEQ ID NO: 40005 - DNA, 735 bp, Homo sapiens
  misc_feature: GYAE6OF02JWRZI.35.67.G01.1.454.CMB.1.raw
  modified_base (149)..(149): a, c, t, g, unknown or other
  misc_feature (149)..(149): n is a, c, g, or t
  modified_base (176)..(176): a, c, t, g, unknown or other
  misc_feature (176)..(176): n is a, c, g, or t
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (334)..(334): a, c, t, g, unknown or other
  misc_feature (334)..(334): n is a, c, g, or t
  modified_base (371)..(371): a, c, t, g, unknown or other
  misc_feature (371)..(371): n is a, c, g, or t
  modified_base (450)..(450): a, c, t, g, unknown or other
  misc_feature (450)..(450): n is a, c, g, or t
tcagtacagatcgtcacgaccggtgctcgatttagagtatacatattgggtttggggggtaggaggaggcccgaggcactagaagtcggcggtgtttccagtccggtgatcagcactgaacacagaggactcacatgagtttgggctgngctgggtttctcgttgctactttaagnggtgtccagtgtcaggtgcagcgtggagagtcgtgggggagcgtggtacnggcgtgggaggtccctggagacctcttccgnggtcgaacggcttcgtaggtntttacgnttcttacaataaaccgttntcggctaatggactaccgtgggggtccccnccaaggtcctcccggaagggaccccgtaaacgggggnttcgggaacggtggttttcggggacctaggttggtcgttggaagtcgtaatagggtaaataacgtacaagttaacggtnacgacggtaactcgggtagaacggtcctacgtacaaccgacttactccaacgtacggaaccttaactaaccaaacggtaacttaccgtttcgttacccgtagtaactaaacggtataaacggaaccgtacctaaacggtcgaacgacccgggaaacgttaaacccggacggtaaccggttaacgtaacgttaacggtacccttaaaggggtataacccggggaaagtacccggtaagggtaccggtacgggtaaccggaaccccggttaccccgggaggtaaccg

SEQ ID NO: 40006 - DNA, 262 bp, Homo sapiens
  misc_feature: GYAE6OF02GP76D.35.67.G01.1.454.CMB.1.raw
  modified_base (247)..(262): a, c, t, g, unknown or other
  misc_feature (247)..(262): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcgcatagnnnnnnnnnnnnnnnn

SEQ ID NO: 40007 - DNA, 876 bp, Homo sapiens
  misc_feature: GYAE6OF02JN0W3.35.67.G01.1.454.CMB.1.raw
  modified_base (417)..(417): a, c, t, g, unknown or other
  misc_feature (417)..(417): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggtttcctcgttgctcttttaagaggtgtccagtgtcgaggtgcagcgtggtgagtcgtggggaggcgtggtccaggccgtgggacgtccctgagacttctcctgtagagcgtctggtactctatcttacaaagtaacagtcggcagtcgacgtaccgttaggggtccccgacctaagggcccttacccgaaggggacccaaaagggggtaccttgggggtaagttcggggtttcggccggttaaggtttggtgttaagggtttancggtaaggttgggtaaaaaggttaacgtaagttacgtaacttaaggtcgtacaaagggcccaacggggttcgggaacggggtaccgttaacgttccaaacccgtacgttacccgaacccgtaaggtaactaaacccgttaaaccgtaaacccgttaaaacggtaaacccgtttaaaccgtttttccgttaacccgttacgggaaaaccctaaaaagttacccggaaaaccgttacccggtaccgtaaacggggttaaaccgggaaccgggttaaaccgggaaacccgggtaaacccgggtaaccggttaaacccgggtaaagtttaaccgttaaacccgttaacggttttacccggtaaagggtaacccgggtaaagtaaaccgggtaaccgggttaaggggtaaaccccgggtccggtaaaaccccccgggttacccccgggttaagtaaccccgggg

SEQ ID NO: 40008 - DNA, 641 bp, Homo sapiens
  misc_feature: GYAE6OF02IOMMZ.35.67.G01.1.454.CMB.1.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
tcagtacagatcgtcacgaccggtgctcgatttagagtatacatattgggtttgggggggggtcacaagaggcagcgctctcgggacgtctccaccatggcctgggctctgctgctcctcactctcctcactcaggacacaggtgacgcctccagggtaggggtcttggggacctctggactgatccttggtctcccgntcctcaggcctcgaccggggcccagcactgactcagtggcatgtcgttcnccctntttccaggtcctggcacagtctgccctgactcacgcctgcctccgtgtctcgggtctccgtgacagtcgactccacctatctccgtgccacgtcggaaccagacaagcgagttggttagggggttaactcggtaccgttgttccgttcgttaggtactacgaacacgaccgacccaagggaccaaaaccggaccccctaaaaccttacctttaaacgtttaacgtaaaccggtaacctaaaccgttaacgaccgaaccccttacgtaacgggttaactttacgtaacgttacgttacttccgttactcggccttaccgaagtccgtagtaccgaaccgtcgtaccctcctacgaactacgtcgtcggtacggtccgtcggctacggg

SEQ ID NO: 40009 - DNA, 769 bp, Homo sapiens
  misc_feature: GYAE6OF02JME5A.35.67.G01.1.454.CMB.1.raw
  modified_base (318)..(318): a, c, t, g, unknown or other
  misc_feature (318)..(318): n is a, c, g, or t
  modified_base (612)..(612): a, c, t, g, unknown or other
  misc_feature (612)..(612): n is a, c, g, or t
  modified_base (761)..(761): a, c, t, g, unknown or other
  misc_feature (761)..(761): n is a, c, g, or t
tcagtacagatcgtcacgaccggtgctcgatttagagtatacatattgggtttgggggggaggaggagcccagcactagaagtcggcggtgtttccatccggtgatcagcactgaacacagaggactcaccatggagtttgggctgagctgggttttcctcgttgctctttaagaggtgtccagtgtcaggtgcagctggtgagtcgtggggagcgtggtccagcctggggacggtccctgacgactcgtcctgtgaacgcgtctggtattcattccttacaaactaactagtggctagtgccgtacgtcgggtaccnccgtacggccttacccgaggtaccgaaaggggtaccgtgggtaacgggttcgggtttgggaccgttaagggttttcggtacgggttaggttaagttgggtaaagttacgggggtaaaagtaaacgttaaggaactttaacgttagttcggaccaacggtacccgtacgggttaaggaaccgggtacccggtaatttccgaacctactaccccgtgaacgtaagaaccgtaaacttaccgaaacgtacctaacgttttaccgttcctagtaacctaaacgtacggtaacccgtanaccgtaaggaccgtaaacgggtaccggaacggtaacccgggtaggtacccgtagtttaaaccgttacgtttacggttaagtcgggaacgtaacggtaaacggccgggttaagtcccggggaacccggtttaccccccgtaacccggggngtaaccgg

SEQ ID NO: 40010 - DNA, 888 bp, Homo sapiens
  misc_feature: GYAE6OF02HZZTO.35.67.G01.1.454.CMB.1.raw
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtncagcgtggtggagtcgtgggggagcgtggtccagccgtgggacggtcctagagacctctcctgtgaagtcgtacgtggtaacttccagttcctttanaaacttaacgtagtcggacagttcggacctaaccgttcggggtccccgaccgagggtccctaccgagggtaccgaaacggggtcctaggggtaacggttcggggtttacgggaccgttaaggtttcggttacgggttagggtaacgttggggtaagtttaacggggaaaaagtttaaacgttaagggtaaactttaaaccgttaagtcgggaaccttaaacgggaacccgtaaacccggggttagggaaaaccgggggtacccccttaacgttttacccgaaaacccgttagtttaccccttaacccgggaaaggttaacccgaaacgttaaaccgtttaacccgaaaaacgttaccgttaacgtttttacggtaccccgttaaggaacctaaaaccgtttacggaaacccgttaaggccccgttaaaggggaaaccgggaacggttaccccgggtaaaaggggaacccaccggggttaacgttaacgttaaacgttaccgttttaacggacggggtttacgaaacccgggtaacggaagggttaccccggtaaagggtttccgggggacccttaaccccccggtaaccccggggg

SEQ ID NO: 40011 - DNA, 699 bp, Homo sapiens
  misc_feature: GYAE6OF02GK5BV.35.67.G01.1.454.CMB.1.raw
  modified_base (333)..(333): a, c, t, g, unknown or other
  misc_feature (333)..(333): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctggagacctctccgtgtgaaggtcgtcgtaggattcaattcctttacaatttaaacgtgtcggtcaagtcgactacgttcggggtcccnccgaggcctaccgagggcgaagggtactgggaggttggttacggcttaggttcgtggttaggtatggtagtacggtaaagttaagtaaggtacttaaacgtgtgaccgtaaaggccgtacgggtaggaaacggggtccctataccgactacgtaccgttacgaacgaagtaacctaacgttaacccaaagtaccttcgtttacgtaccagtaactaaacgttacgaacctcgtaccgtagaaccggtacgaaccggacgtaccggacggacgtaacgtaacggttaaccttacggtaaggttacgacggttaaacggacggtacggtaaccgggttacgggaccccggtaacccggtaaccccggg

SEQ ID NO: 40012 - DNA, 684 bp, Homo sapiens
  misc_feature: GYAE6OF02JEI16.35.67.G01.1.454.CMB.1.raw
  modified_base (199)..(199): a, c, t, g, unknown or other
  misc_feature (199)..(199): n is a, c, g, or t
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (435)..(435): a, c, t, g, unknown or other
  misc_feature (435)..(435): n is a, c, g, or t
tcagtacagatcgtcacgaccggtgctcgatttagagtatacatattgggtttcctcgttgctctttaagaggtgtcagtgtcaggtgcagctggtggagtctgggggaggcgtggtccagcctgggaggtccctggagactctcctgtgaagcgtctggattcattcttcaataactatggcatgacactggggtccncaggcctccgaggctaaagggctggagtggtgcagttgtgtggacngatggaagtatagatactanagcagacgtccgtagaacgggccgtaattcgacctatacctccaagacgactaacgtccaagtaaacctacttttacgttacctagactaaaagtacgaaccgtacgaccgtaagacggtaggccccgaaacggacgaccgaggtaacttagttacgttagtaggtacgnggaacggaacgacggtaggtacgggacgtaccgtacccggtagtacgacgtaccgacgtcgggggaccacgggaccgaccgtaccggtcggcccgttacctccgtttacgccgacccgtaccgacccgtaaacgggcccttaacgtccgggttcccctacccggtaccggtccctaccccgtaccgtccgaaacccggcctacccggtaccgttcccggaccggggtaccgaccgtaccggtccccggg

SEQ ID NO: 40013 - DNA, 941 bp, Homo sapiens
  misc_feature: GYAE6OF02G1NCE.35.67.G01.1.454.CMB.1.raw
  modified_base (181)..(181): a, c, t, g, unknown or other
  misc_feature (181)..(181): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagcttgggttttcctcgttgctctttaagaggtntccagtgtcaggtgcagctggtggagtcgtgggggaggtcgtggtccaggccgtaggggtacggtcccctaggacgtaccgttccgttcccgtagggttcggaaaacggttcccggttccgttaggggttactttacccgtaagtttcccctttaaccgtaaaaactttaaacgttacgttacggggacccttaagttccgggaacccttacccgggtttaccgggggttcccccccggaaccggtaaacgggtccccgttcccccgaaagggggacccggtaaaaacgggggtacccgttaggggggttaaccgggttttgggggttacggggaccgttaaggggtttttcggttgggttagggtttaaccgtagggttaaaggttaaggggtaaaacggtttaaaatacggttaaaaccgttaattaacgggtagtacccggaagggtaaaccctaacccggggttaagggggaacccggtacccggtaaacgtttcccgaaacccgtagtttccgtaacccgaaaggaacgtaccctaaaaacgtcccaaaacggttaaacctttacgtttaccgttcccgtaagttaacctaaaaggtcgaaaccgtacggtaccctagggtacggaaccaccggggaaccgaccgggaccgtaaccggtaacgttaaagtacgttttaccggagggtaccggtaagtaaccgggaaggtccggaaagggtacccggggtaccgtaaccccccggttaaccccggg

SEQ ID NO: 40014 - DNA, 583 bp, Homo sapiens
  misc_feature: GYAE6OF02IYK6H.35.67.G01.1.454.CMB.1.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcacgtgggtccnccaggctccgaggcaagggactgggagtgggttggctaggttgtgtggtatgatggaagtaatagatacgtatgcagacacggtgacgggcatcacntcncaganacatcaanactcttntcnanaatnaacngcngagcgacgagacgcggnatatattacgngtacgcgaagaggcgagtacgggacncccgtacccggntaggacgcgacgtcgggaccgacgggcctaccggtcggtccgtccgtcctcgtccgacgtccctaccgaccgaaccggccctacgttcccggtcccttcccccggtacgcccctacccgttccctacccgaaggtcccaccgtaccggtcccggtcggggaccctacgggtccgtcccggg

SEQ ID NO: 40015 - DNA, 664 bp, Homo sapiens
  misc_feature: GYAE6OF02FYD6K.35.67.G01.1.454.CMB.1.raw
  modified_base (269)..(269): a, c, t, g, unknown or other
  misc_feature (269)..(269): n is a, c, g, or t
  modified_base (348)..(348): a, c, t, g, unknown or other
  misc_feature (348)..(348): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatgggagtttgggctgagctgggttttcctcgttgctcttttaagaggtgtccagtgtcaggtgcagctggtggagtcgtgggggaggcgtggtccagccgtggggaggtccctggagactctcctgtgaagcgtcnggattcatcttcaataactatggcatgcacgtgggtccgccaggcctccgaggcaagggactgggagtggtgcagttgngtggtatgatggaagtaatagatactagtcgcaagactaccggtaggaacggggccgaatttccgaacccattcccgtaccgaaggacgtaaaccgtaaacttacccgaaagtaaacccttaccgtttttacgttaccctaggacctaaaacggtcgtaaaaccgacgtacccgttaggtaaacgacggtaaccggaacgggtaaccacggggaccaagtttaaacgttacgtttaaaccgtggttacggaaccggaaggtaaacgggtccggtaacggttacggggaacccggtcccccgttaaaccccccgggg

SEQ ID NO: 40016 - DNA, 697 bp, Homo sapiens
  misc_feature: GYAE6OF02IUUE7.35.67.G01.1.454.CMB.1.raw
  modified_base (173)..(173): a, c, t, g, unknown or other
  misc_feature (173)..(173): n is a, c, g, or t
  modified_base (632)..(632): a, c, t, g, unknown or other
  misc_feature (632)..(632): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgcagcctctggattcacctttnagtagtcactggatgcactgggtcctcaagttccagggagggctggtgtgggttcacgtattacggagtgatgggactgacacatctacgcggactccggtgaacgggccgattcccaccccctcgagacgaacaaccgaccaagacacgactagtactctgacaatgaactgtacgtagaaggcgaccggaggaccgacggtcttgtactttaattacgtttacacgaagtaggtacggtactactaactctagtttggtttacgtatccgttacgggtcgggggaaccaaacggggtactaacggttcgggaccttaacccgttcgttaccttaccacccggtaccctacccggtaaaccccggtaacggtccccgtaacgttcccgggtttccccctttaacccccggccggtacccggtcccttccgcctaacccgggacggaacccggtacccncccgggtaccgtacggacccgtacacccggacggcccggtaccccggtccgggtccgtacccggg

SEQ ID NO: 40017 - DNA, 700 bp, Homo sapiens
  misc_feature: GYAE6OF02HHQDF.35.67.G01.1.454.CMB.1.raw
  modified_base (318)..(318): a, c, t, g, unknown or other
  misc_feature (318)..(318): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgcttcttttaagaggtgtccagtgtcaggtgcagctggtggagtcgtgggggagcgtggtccagccgtggggacgtccctgacgctctccgtgtgagtcgtctggattcattcttacaaattaactagtggctagtcgacctacgtggggtcccnccgaggcctccggaggaccgaaggggtctgggaggttgggttggctaggttgtggtaggtatggagtaggaaagtaataggataactatacgacgtaacgaccgtaccggtaggaacgggtaccgtacgttaccgaacctactacctaccgaacgtaacgtaaccgtaacgttaaccgaaacgttaaaccttaccgttttaccgtttaccgtacgtaacgtaaacgtaacgtaaccgacgtaccgtaagaacggacgacccggaaacggaaccgacggacgtacgtaacgttacgttaacgttacggtacggtaacggtaacggtaacggtacggtaacgggtacgggaaccggtaccgtacccggtaacccccggtaacgg

SEQ ID NO: 40018 - DNA, 713 bp, Homo sapiens
  misc_feature: GYAE6OF02JJ6KR.35.67.G01.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
  modified_base (300)..(300): a, c, t, g, unknown or other
  misc_feature (300)..(300): n is a, c, g, or t
tcagtacagatcgtcacgaccggtgctcgatttagagtatacatattgggtttgggggggaggaggagcccagcactagaagtcggcggtgtttccatccggtgatcagcactgaacacagaggactcaccatggagtttgggctgagctgggttttcctcgttgcttcttttaagaggtntccagtgtcaggtncagctggtggagtcgtgggggagcgtggtaccagccgtgggacgtccctgacgctcgtcctgtagagcgtctggtacttcattcttacaaataactagtggactntacgctacgtcgggtcccaccgacggtcctaccggaggaccggaagggtcctagggacggtttgggtcggcgtaggttggtacgtggttagtcggaagttagggaaaagttaagtaagtaacttacgtagtcgacgtaacgacccgtacgggtaggaacggtacccgtagtttacccaaccgtactaccgtacgaaaggtaccgtaaacgttaaccttaaccgaaacggttaaacctttaccgttttacgtaccgttaaccgaccttaaaagttaccgtaaaccgtacgtaccttaggaaccgtaacggcccggaaacggtaccgaacgggtactaagtacgttagttaaccggtgacgtaccgtaaggaacgtcggtacggtacggacccgtaccccgtaccggtatacggg

SEQ ID NO: 40019 - DNA, 647 bp, Homo sapiens
  misc_feature: GYAE6OF02IW07U.35.67.G01.1.454.CMB.1.raw
  modified_base (313)..(313): a, c, t, g, unknown or other
  misc_feature (313)..(313): n is a, c, g, or t
  modified_base (399)..(399): a, c, t, g, unknown or other
  misc_feature (399)..(399): n is a, c, g, or t
tcagtacagatcgtcacgaccggtgctcgatttagagtatacatattgggtttgtgggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcggtgggggaggcgtggtccagccgtgggacggtccctggagactctcctgtgaacgcgtctggattcattcttacaaatactagtggacatgccacgtggggtccnccgacggcctccgaggcgaaagggctgggtaggtggtggctaggttcggtggtggtataggagtaggtaataagtagatacgtagngacacggaccgacggtaggaacgggtacctattaccacctatccacgaagacgtaactaacgttaacccgaaagtaacctttacgtttcgttccctaagaactaaagtacgaacgacgtacgaggaaacggccgaaccggtaacggacccgtaacgggtacgaacttaagttaaccgttacttagggtacgaccggaaaggaagtacggaaggtacgggggaacccttaccccggaccccgggtaacg

SEQ ID NO: 40020 - DNA, 606 bp, Homo sapiens
  misc_feature: GYAE6OF02F9FAT.35.67.G01.1.454.CMB.1.raw
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacaggtgacgcctccagggtaggggtcttggggacctctggactgatccttggtcctcccgctcctcaggctcgaccggggcccagcactgactcagtggcatgttcgtttcctcccttctttccgagggtccgtgggcacgtacgtctcgcctgacctcacgcctcgccgttcgtgtccgttgggtcctcgtggacngtcgatccacctntcctcgtgctacgacggaccagcagtcgtaggttggttaggggttatcgtcgttcgtctcgtgtactacacgacgccaccgacgacaaaccgaccctaacgtactttaacgttaataacgactacgtacgccgtacctagtgtacttacgacttctcttcgtcgtcggtacctacgtacgtcgtacgtaccgtaccggtccgtccgtacccgtacgtaactacgttcggtaccggtcgggtccgtaccggtggtacgg

SEQ ID NO: 40021 - DNA, 649 bp, Homo sapiens
  misc_feature: GYAE6OF02GOQW3.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagccgtggggacggtccctggagactctcctgtagaagcgtctggattcatcttacaatactatggcatgctacgttcgggtcccgccaggcctaccgaagggaccgaaagggcctgggacggttgggtttggcgtaggttgtcggtggtatggtagtaggtaaatagtagatactagtcgacagacacgggtaggaacggacgtactacaactacgtcctacgaagaacgaactaaacgttaccgaaacgtaacttacgtttcgttaccgtacgtaactaaacgttacgaaacgacgtaccgtacggacggtacgaaccgacggaaccgacggacgtagttaactacgttacgtaggtacgtacgaacggtaacggacggtacggtaaccgggtaccggacccggttaccccggagtaaccggg

SEQ ID NO: 40022 - DNA, 781 bp, Homo sapiens
  misc_feature: GYAE6OF02IW8WB.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaaataactatggcatgcacgtcgggtccgccaggctccgaggcaaagggactggagtggttggctagttgtgtggtatggagtggaaagtaataagatactagtcgacagtaccgacgtaggaacgggtccaagttccaacctagtctaccgagaacgaactaattaccgaacgtaaactcgttttacgtaccgtagaacctaaaatacggaaactacgaccctaggaacggtaacgacccgggaaggaccgtaaacgggcctaaattaacgtacgtttacgttaggacgaacggaaggaaacggtggtaacggtacggggacgttaacccccgtacccgggaagtacggtaagaccgtaaccgggttcgggggaccgaaaccgggtcccgaacccggttgggtaccccgtcccggttacccgttccttaccggtaccgtcccccgtaaccgtaaacccggaccggtacccctaacggttccccgggttaccccttcccccgggtacccggttaccccaacccccccgtttcccggaaccccgtaacggtaccttacccccggacccggttaccggccggggaaccttaccggacccggggtcccccgg

SEQ ID NO: 40023 - DNA, 803 bp, Homo sapiens
  misc_feature: GYAE6OF02GAVZC.35.67.G01.1.454.CMB.1.raw
  modified_base (312)..(312): a, c, t, g, unknown or other
  misc_feature (312)..(312): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccaggcctggggacggtccctggacgactctcctgtgaagcgtctggattcattcttacaattaactatggcatgcgacgtcgggtccnccgaggtcctccgaggcaagggctgggagtggtggctaggtgtggtggtagtaggagtaggaaagttaactaggtaacttaacgtagtacggaccaaaggtaccgaaccgggtagggaaaccggggtacccgtacgtttaccccgaaccctacgtttacccgtaccgtaaagggaaaccgtaaacccgtaaaacgtttaaccccgaaaaggttaaacccgtttaccgttttttaccggtaacccgtttaacggaaaccgttaaaacgttaacggtaaaacccgtcggtaaaccccgttaagggaaaccggggtaacccgggtaaccgggaaaccggaaacccgggtaacgggtaccgtaaacgtttaaacgtttaaaccggtttaacggttcgggtaacgggaacgggttaaaccggaaacgggtacggtaaggggttacccggggaacccggttaaccccccgggttaaccccgggtaaggtaacccggg

SEQ ID NO: 40024 - DNA, 498 bp, Homo sapiens
  misc_feature: GYAE6OF02FLJ9E.35.67.G01.1.454.CMB.1.raw
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (475)..(475): a, c, t, g, unknown or other
  misc_feature (475)..(475): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccaggcctggggaggtccctgagactctcctgtgaagcgtctggattcatcttcaataactatggcatgcacgtgggtccnccaggcctcgaggcaagggctgggagtggtggcagttgtgtggtatgatggaagtanagatactangcagacacgtgaggcgatcacatcncaganacatcaagacacttntctnacaatgaacngcngagagccgagacacgacgatatatactgtagcgagacgcgagngggacgcccgtacccggagtacg

SEQ ID NO: 40025 - DNA, 687 bp, Homo sapiens
  misc_feature: GYAE6OF02HYMT3.35.67.G01.1.454.CMB.1.raw
  modified_base (291)..(291): a, c, t, g, unknown or other
  misc_feature (291)..(291): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtcctgagactctcctgtgaagcgtcgtggtattcattcttacaaataacttnggcatgctacgtcgggtcccgccagggcctccggaggtcgaaacgggtcgtgggaggttgggttcggacgtaggtttgtagggttaggtagtaggtagtagggaagtaaagtaagtataactagtacgacgaaggtaacccgacgggtaggaacggggtcccgtaattaccaacctactcccgtaccgaacgacgtaacccaaattaccgaaacgtaaccttaccttttagttacctacgaactaaagtaacgaacctacgtaccgtacggaacggaacgacccgggaaggaaccgaccgggaccgtataacgttaacgttaaccgtggttacggacggaacgaacgtacggaaggtaccgggtaaccggtacccccgtaccccgggagtaccggg

SEQ ID NO: 40026 - DNA, 740 bp, Homo sapiens
  misc_feature: GYAE6OF02H0XMF.35.67.G01.1.454.CMB.1.raw
  modified_base (290)..(290): a, c, t, g, unknown or other
  misc_feature (290)..(290): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttggggtttttcctcggttgctctttttaagaggtgtccagtgtcaggtgcagctggtggagtcgtgggggagcgtggtccagccgtgggacgtcctgagactctcctgtgagcgtctggtatcattccttacaaatactanggcagtgctacgtgggtccgccgaggtctccgaggacgaacgggcgtggtaggttggttaggccgtaggttggtggttggtagtagtaagtacgggtaaaagttaagtaagtaattaacgtatacggcaagaacccgtaccgggtaagggtaaccggggacctattaacccgaacgtaactaccgtaaccgaaggaaacgtaaccttaaacgttaaccgtaaacgtaaaccttaccgttttacgttaccgtagtaactaaaagtccgtaaactacgtacccgtaggaacggtaccggaaccggacggtaacccgaacgggtaccgttaagttaaccgttacgttaacggttagggtaaccggtaaccgggtaacggtaaaccggtacggttaacgggttaaccggggaacccgggttaaccccccggtaaccccgggtagttaaaccggg

SEQ ID NO: 40027 - DNA, 276 bp, Homo sapiens
  misc_feature: GYAE6OF02HATX3.35.67.G01.1.454.CMB.1.raw
  modified_base (251)..(276): a, c, t, g, unknown or other
  misc_feature (251)..(276): n is a, c, g, or t
tcagtacagatcgtcacgaccggtgctcgatttagagtatacatattgggtttggggggtttggtggtctccactcccgcccttgacgaggctgattattattgttgctcatatgcaggtagtagcactaatgtcttcggaactgggaccaaggtcaccgtcctaggtcagcccaagactgccccctggtcactctgttccccaccctcctcacgactcctgtacctgagcgggctggcaaggcgcatagnnnnnnnnnnnnnnnnnnnnnnnnnn

SEQ ID NO: 40028 - DNA, 275 bp, Homo sapiens
  misc_feature: GYAE6OF02GDXRW.35.67.G01.1.454.CMB.1.raw
  modified_base (238)..(238): a, c, t, g, unknown or other
  misc_feature (238)..(238): n is a, c, g, or t
  modified_base (244)..(254): a, c, t, g, unknown or other
  misc_feature (244)..(254): n is a, c, g, or t
  modified_base (256)..(256): a, c, t, g, unknown or other
  misc_feature (256)..(256): n is a, c, g, or t
  modified_base (259)..(275): a, c, t, g, unknown or other
  misc_feature (259)..(275): n is a, c, g, or t
tcagtacagatcgtcacgaccggtgctcgatttagagtatacatattgggtttgggggtttggtggtctccactcccgccttgacgaggctgattattattgttgctcatatgcaggtatagcactaatgtcttcggaactgggaccaaggtcaccgtcctaggtcagcccaagactgcccccctggtcactctgttcccaccctctcacgatctgtactgagcgggctggcaaggcncatagnnnnnnnnnnngnaannnnnnnnnnnnnnnnn

SEQ ID NO: 40029 - DNA, 695 bp, Homo sapiens
  misc_feature: GYAE6OF02JBRYP.35.67.G01.1.454.CMB.1.raw
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctgagactctcctgtgagcgtctggattcatcttcaataactatggcatgacacgtcggggtccgccgaggcctccgaggccgaaaggggactgggaggtgggttggcgtaggtttggtggtaggtagtggagtagggaaagtaagtagtaataactagtcgacgagaccgacggtaggaacgggtccgtaagttcccaaccgtacgttacctaccgaagaacgtaacctaaacttacccgaaaagtaaccttaacgttttccgttaccttacgtaaccgtaaacgttacgaaaccgtacggtaccgttaaggaacggaaccggacccggtaagggaaccgaccggggtaacgtaacgttaacgttaacgtttaacggtaggtacggaccggtaacggaacgggtaccggtaacgggtacggggtacccgtacccccggttaacccccgggg

SEQ ID NO: 40030 - DNA, 628 bp, Homo sapiens
  misc_feature: GYAE6OF02IW5OE.35.67.G01.1.454.CMB.1.raw
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgcttacttttaagaggtgtccagtgtcaggtgcagctggtggagtcgtgggggagcgtggtccaggccgtgggaggtccctggaacgctcctccgtagtagaagtccgtgtggacttcaatcttacaataacntggcatgcagtgggccncaggctccgaggcgtaaggctgggagtggttgctaggttgtggtagtgtgagtaggaagttaatagaacttactagtcgatacgacgtacgtaggaacggcgtacttcaccntcnccaagagaacctattacccaaagtactacgttttacgcctagactaaacgtacaaccagtaccgtagaacggaccggaccgggaacgaaccgacggggtactaacgttaacggtacgtttaacgtcgggtaacgaaccggtaagggaacggtacggttaacgggtacggggacccggtaacccccttaaccccggggg

SEQ ID NO: 40031 - DNA, 580 bp, Homo sapiens
  misc_feature: GYAE6OF02IE8P0.35.67.G01.1.454.CMB.1.raw
  modified_base (198)..(198): a, c, t, g, unknown or other
  misc_feature (198)..(198): n is a, c, g, or t
  modified_base (337)..(337): a, c, t, g, unknown or other
  misc_feature (337)..(337): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaagggctggagtggttggcagttgtgtggtatgatggaagtatagatactatgcagacacgtgaaggccgattcaccatctccagagacaattccaagtaactactttgtcctagctaaatgaacngtctgagagccgaggacacggctgtactattacgtgtgacaagacggtgactacgaatctagttgtttgattcgtcgtcggggacaagggtacaagtcggtcaccgttctacgttcgacgtcctaccgacgaaacgggccctagttccgggtccttacccccgtgggcccttcccgtacggtccctaccggtaacgggtacgacccgtaccccgtaccgggaacgtacccggtcccaaccggg

SEQ ID NO: 40032 - DNA, 708 bp, Homo sapiens
  misc_feature: GYAE6OF02I0OCF.35.67.G01.1.454.CMB.1.raw
  modified_base (325)..(325): a, c, t, g, unknown or other
  misc_feature (325)..(325): n is a, c, g, or t
  modified_base (702)..(702): a, c, t, g, unknown or other
  misc_feature (702)..(702): n is a, c, g, or t
tcagtacagatcgtcacgaccggtgctcgatttagagtatacatattgggtttgggagaggagcccagcactagaagtcggcggtgtttccatccggtgatcagcactgaacacagaggactcaccatggagtttgggctgagcgtgggtttcctcgttgctacttttaagaggtgtccagtgtcaggtgcagcgtggtggagtcgtgggggatcggtggtccagccgtgggacgtccctgacgtactcgtcctagtgaagtcgtctaggtacttcatcttacaaaattaacgtagtcggctaagtcggacctacgtcgggtccnccgaaggccttaccgaaggacgtaagggcctaggacggttgggttacggacgtggttgtcggtaggtaagtggaagtagggtaaagtaagtaaggtattaacgtaagtgacctaaggaccgtaaccgttaggggaaacggtccgtaacgtttaccaaccgtaacgtcgtacccgaagggtaactaaccgtaaacgttaccccgtaaaagaaccgtttaactttcggttacccgtcgtaaacgtaaataaccgggtacctaacggaccgttaagaaggacccgtaacggacggaaaccggtacggacgattaaccgttaggttcttacggtacgacgtaaagtacgcgttacggaccgggaactcccgtaacccggtnaccggg

SEQ ID NO: 40033 - DNA, 761 bp, Homo sapiens
  misc_feature: GYAE6OF02IORKR.35.67.G01.1.454.CMB.1.raw
  modified_base (133)..(133): a, c, t, g, unknown or other
  misc_feature (133)..(133): n is a, c, g, or t
  modified_base (156)..(156): a, c, t, g, unknown or other
  misc_feature (156)..(156): n is a, c, g, or t
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
tcagtacagatcgtcacgaccggtgctcgatttagagtatacatattgggtttggggggggtcacaagaggcagtcgctctcgggacgtctccaccatggcctgggctctgctgctcctcactctcctcactnaggacactagggtcctgggcacngtctgccctnactcncgcctgccgtccgtgtctgggtctccgtggacngtcgatcacgtatcctctgctacgtacggaaccngacgtacgacgtagttcgggttacggggttaagtcgaccgtttcgtccgttaccgtcggtacttacaaccgtacgacgtacccgaacggaccaaaccggtaccccctaaaccgtttacgttaaacgtttacgtaaacgtaccgtaaacctaaggtacccgtaccggtacgtaacgggtacttacggttaacttccgtcgttaccgtcggtcgtaccgtaccgtaaggtcgtacggtacctaaccgtccgaacccgtccctagacttacgtccttacgtcgggtcccgtacggccgttagacgggtacgtacggtcgtacgtaagtttacgttaacgttcgttacggtcgtttaccgaagtacggttacgtacggttaaccgggtagtacggaactttaacgtaaacggttcggttaacccgtaaggttaccggtacggaaccgtacgtacccggtaaccggttcgtaaccgttcgaaccgaccgtaacccggtacctaaccccgtcgtacggtacctacccgg

SEQ ID NO: 40034 - DNA, 604 bp, Homo sapiens
  misc_feature: GYAE6OF02HTH6F.35.67.G01.1.454.CMB.1.raw
  modified_base (264)..(264): a, c, t, g, unknown or other
  misc_feature (264)..(264): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacgtccctgagacctctcctgtgacgcgtntggattcatctacaaatactgtgcatgcacgtcgggtccgcaggcctccgaggcgaagggctggagtggttgctagttgtgtgtatgataggaataagtagattactatgacacgaacgtacggtagaacgggccgtattaccgacctagtacctacgaagacaactaactaccgaaacgtaactacgtttcgtacctagaactaaatacgaacgacgtacgtacggaacgacggaccggaggaaccgacgggactagtaacttaacgttacgtaggtacggaccggaaggtaacgacggtaacggtacgggacccgtaccccgtaccccggagtaccgg

SEQ ID NO: 40035 - DNA, 263 bp, Homo sapiens
  misc_feature: GYAE6OF02HQHXF.35.67.G01.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (250)..(263): a, c, t, g, unknown or other
  misc_feature (250)..(263): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggcccaacccccatgtcactctgtccccgccctcctcacgatctgtactgacgcgggntggccaaggcctnatagnnnnnnnnnnnnnn

SEQ ID NO: 40036 - DNA, 740 bp, Homo sapiens
  misc_feature: GYAE6OF02IVDZK.35.67.G01.1.454.CMB.1.raw
  modified_base (286)..(286): a, c, t, g, unknown or other
  misc_feature (286)..(286): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcattcttcaataactatggcatgcacgttcggggtcccgccaggcctccgagggccaagggctggagtggttggctagttggtgtggtatgataggaataatagatactatgacagaaccncccggtaggaaacggggcccgtaacgtttacaacccgagttcctaacccgaggaacgaacctaaattaccccgaaagtaacccttaactttttcggttaccctcgaactaaaagtacgaaacgacgaccgttaggaaggtaccgaccgggaaagggacccacgggtacgtaaattaacgttaacgtttaccgtggtacggtacgaaaggtaagacgggacggtacggggaccgaccccggttaaacccccggagtaccgacggccgacgggtcggggacccgacgggaccctacccggtcggtcccgccgttaccttccgtaccgaccgtcccgtacccgacccggtaaaccggtccctacgttcccggtccctttacccccgtcgggcccttaaccccgtccctaacccgaacgtaccgccctcggttccggcgggaccgaccgcggccccgg

SEQ ID NO: 40037 - DNA, 830 bp, Homo sapiens
  misc_feature: GYAE6OF02HAXH4.35.67.G01.1.454.CMB.1.raw
  modified_base (191)..(191): a, c, t, g, unknown or other
  misc_feature (191)..(191): n is a, c, g, or t
tcagtacagatcgtcacgaccggtgctcgatttagagtatacatattgggtttggggggagaggagcccagcactagaagtcggcgtgtttccatccggtgatcagcactgaacacagaggactcaccatggagtttgggctgagctgggttttcctcgttgctcttttaagaggtgtccagtgtcaggtncagctggtgagtctggggagcgtggtccagcctgggagtccctgacgtactcgtacctggtacgaagcgtcttgggatttccaagttccttacaaaagttaacctaattcgggcctaagttcggacctaccgttgggggtcccccaccgtaagggccttacccgaaggggaccgtaaacgggggaccctttggggaaggtttccgggtttgggccctaaggttttcggtacggttggggttaaactggggtaacttcgggggtaaaagttaacgttaggtaacttaacgtaatttcgggaccgtaaggacccgtacccgggttagggaaacggggtcccgtaacgtttaccaacccgtaacgttacccgttaccgaacggaacgtaaaccgtaacgtttacccgaaacggtaaacccgttaaccgttttacggtttacccgtacgtaaccgtaaaagttcggtaaaccttacgggtacccgttaggaacggtaaaccggtacccggtaaacgggtaaccgtaccggggtaacgtacgttaacgtaacgtttaaccgtacgggttacggaaccggtaacggtaacggaccggttacggttaccggggaccgtcccccgtaacccccggggtatacccggg

SEQ ID NO: 40038 - DNA, 646 bp, Homo sapiens
  misc_feature: GYAE6OF02GTH4Z.35.67.G01.1.454.CMB.1.raw
  modified_base (178)..(178): a, c, t, g, unknown or other
  misc_feature (178)..(178): n is a, c, g, or t
  modified_base (326)..(326): a, c, t, g, unknown or other
  misc_feature (326)..(326): n is a, c, g, or t
  modified_base (399)..(399): a, c, t, g, unknown or other
  misc_feature (399)..(399): n is a, c, g, or t
  modified_base (512)..(512): a, c, t, g, unknown or other
  misc_feature (512)..(512): n is a, c, g, or t
  modified_base (559)..(559): a, c, t, g, unknown or other
  misc_feature (559)..(559): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgcttcttttaagnggttgtccagtgtcaggtgcagctggtggagtcgtgggggagcgtggtccaggcccgtgggacggtccctgacgactctccgtgtagagtcgttctggtacttcattctttacaattaactagtggcattcggactacgtcggtaccnccgaggctccgaggctaagggctggcgtggttgctaggttgtggtgtatgagtgaaacgtagtagattacgtncggacagaccgacggtaggacgtctaattccacctagtccacgagacgtaacgtactaacccgaagtaaacttcggttttccaccgttacgaaacgttaaacctggtaaaccnggtacctacgggaacgaccggtaccgggacgtaaccgacccgggttntaatttaacgtttaacttccgtaggtacggtaacgaaacggttacggagttaccggggtacgggacccgttaccccgtaacccgggg

SEQ ID NO: 40039 - DNA, 715 bp, Homo sapiens
  misc_feature: GYAE6OF02IS296.35.67.G01.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcacgtcgggtccnccaggcctccgaggcaagggactgggagttgggttggctaggttgtggtggtatgagtggaagtaatagatactatgcagacaccgtagaagggcattcacntctacgagacgacaacgaccaagaacaacactatactactagactaaagtgaaactacgtactaggaggacgaccggaaggaaccgacggtcgttagttacttaagtttacgtgtacggaacgaaagggtaggtacgggtacttaaacgtaacgttacgtacggtttagggttttacgtacgtttccgttaccgggttacggggaacccggtaaacgggtaacctaacggttaggttacccccccccgtagtttcccttaccgttacgacccgttaccctacccgaaacccgtaccgggtacccgttaccggttacccgtttacccccggttcccccgtaccgggtccccgtaccccgtacgtacccgtaccggtacggcccgtacccgtacccggtaccggacgtaaccgg

SEQ ID NO: 40040 - DNA, 651 bp, Homo sapiens
  misc_feature: GYAE6OF02I6C6K.35.67.G01.1.454.CMB.1.raw
  modified_base (185)..(185): a, c, t, g, unknown or other
  misc_feature (185)..(185): n is a, c, g, or t
  modified_base (236)..(236): a, c, t, g, unknown or other
  misc_feature (236)..(236): n is a, c, g, or t
tcagtacagatcgtcacgaccggtgctcgatttagagtatacatattgggtttggggggggtcacaagaggcagcgctctcgggacgtctccaccgatggcctgggctctgctgctcctcactctcctcactcaggacacagggtcctgggcacagtcctgccctgactcagcctgcctccggtntcgtcgggtctccgtggacagtcgactcaccatcctctgcacgtggaaccngcagcgtagttcggttggggttatggtaccttgtccttccgtggtactacaactgccacccaggtaccaaaccgccccccaaattcctttaaattagtaaacggtacaaccgttaaacgccgtaccctcgagggtactttactaactcgtcttctccgtagcctacgagtcgtcgactacctccgtccctaccctgtaacacttccgtacgtacgggtcctccgggtatcggaacggtacgagggtcctagtactttagtacgttttcgtacgcctacgtacgtagcgtacgtaggtacggtacgacctacgttaagttcgtacgttacgaacgttcggaacgtaccgtcccgtacgttcctaggtacctaccggacccgacgacccccgaacctaacggtcgttaccctacccg

SEQ ID NO: 40041 - DNA, 705 bp, Homo sapiens
  misc_feature: GYAE6OF02FHVHB.35.67.G01.1.454.CMB.1.raw
  modified_base (160)..(160): a, c, t, g, unknown or other
  misc_feature (160)..(160): n is a, c, g, or t
  modified_base (314)..(314): a, c, t, g, unknown or other
  misc_feature (314)..(314): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggtttccncgttgctcttttaagaggtgtccagtgtcaggtgcagctggtggagtcgtggggggagcgtgggtccaggcctggggacggtccctgagtactctccgtgtgaacgcgtctggacttcatcttacaataactatcggcatggcacgtggtaccnccgaggcctaccgagggtaccaaagggggtacttggggacgttcggggttacggacctaagggtttggtgggttagggttaactgggtaatacgggggaaaattaacgtaggaacttaacgtagtcggactaacgggaaccgtaaccggtagggaaaccggggtcctaaacgtttcccgaaccgtattacccgtaccgaaggaacgtaacctaaaccgttcccgaaaagtaaccttacgttttacggttaccttagaactaaaacgtcgaaacctacgtacctaggaacgacggtacccggagggaccacgggtacctattaaacgtcttaacgtggtacggaccgaaggaacgtccggtaaggcgggtaacccgtccccgtaaacccggg

SEQ ID NO: 40042 - DNA, 580 bp, Homo sapiens
  misc_feature: GYAE6OF02GYFUM.35.67.G01.1.454.CMB.1.raw
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
tcagtacagatcgtcacgaccggtgctcgatttagagtatacatattgggttgggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccngcagcgatggttgggggttatgtaccttgtctcctggtatcaacagcaccaggacaaacgaccccaaactcttaattanaacggacactaagcgaccctgaggtatttactaatcgtcttctctcggctaccaagtctaggactaacgtccggccctccgtagaactaactcgtcgtcgggccgtccgggtctaggacggacgaggacctagtaatttagttagttgtgactacattactgactaggtagtagactaacgttaatcgtacgttacggaacgtacgggtacctaacggtccaccggttcgtaaggtaccacggacccaacggccctaaccctcgtacgtacctaccg

SEQ ID NO: 40043 - DNA, 621 bp, Homo sapiens
  misc_feature: GYAE6OF02IOJKE.35.67.G01.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (404)..(404): a, c, t, g, unknown or other
  misc_feature (404)..(404): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctaggattcatccttcaataactatggcatgcactgggtccncaggcctccaggcaagggactggagtggttggctagttgtgtgtatgataggaagtatagatactagtgacagacacgtggaacggccgtatcaccatcncagagacatacaagtactactttgtcngactaangaactagctagacgagaccgaggaccgacggacatagtacttacgtgtacgacgtaagagtacggtagngggtaccgaccccgtacccggatcgaacgtcgaacggcgggtaccggaacggcctacccggtcgggtcccgtccggttcctccgttcgacccgacccgtaacccaaccggaacccgggtacctaccggttccgtccccgttacccggaccggtcctacccctcccgtaaccgaacgcgtacccgtaccgtccggcgggacccacgtaccggcccggg

SEQ ID NO: 40044 - DNA, 931 bp, Homo sapiens
  misc_feature: GYAE6OF02GDD74.35.67.G01.1.454.CMB.1.raw
  modified_base (586)..(586): a, c, t, g, unknown or other
  misc_feature (586)..(586): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcagggaccacagggtcctagggcacagtctgccctgactcagcctgccttccgtgtctgggtctccgtggacagtcatccacctagtcctcctagcctacgtacggaacccagaccgtagccggtagtttggggttagggggttatcgtaccgtttcggttccttaccgttaggttaactacctaaacgaccgaccgaacccccgaacggggaaccctaaaaacccggtaaccccccccttaaaacgtttaccttttaaaaacgttttaacgtaaaaccgggaaccttaaaccgttaaacggtaaccccggtaacccccttacggtaaacggggttactttttaacgttaaacgttccgttaccttttacccgtccgtttacgggtaccctttacccgtaacggttccgtaacggtaaccctaacccgggttcccggttacccttaccccggtanaacccgtttaactaccgtacggtccgggtaccccgtcccggggtacgttacgggaacccgggtaacgggtaccgggttacgtaacggtttaacgtttttaaacgttttacgggttttaccggtttacggtttaccgtttaaccgttaaacgtttaacggttacgtacgggttaaagggtaaccggttaacgtaacccgttaacgtttaaccgtttacgtttaccggtttaaccgggtaaccgggttacgggaacccgttaacggggttaacccttacccgggttacgttaccggacgtacccggaaccgtaccgaacccgtaacccggtactcccgtactacccg

SEQ ID NO: 40045 - DNA, 639 bp, Homo sapiens
  misc_feature: GYAE6OF02HD6D2.35.67.G01.1.454.CMB.1.raw
  modified_base (228)..(228): a, c, t, g, unknown or other
  misc_feature (228)..(228): n is a, c, g, or t
  modified_base (313)..(313): a, c, t, g, unknown or other
  misc_feature (313)..(313): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccngcagcgatggtgggtatgacttgtctctggtatcacagcaccagacaagcccctaactcttaattataagacactaacgcgaccncgaggtattctactcgcttctctgtctacaagtcgtcgctaacgtcgccctccgtgtacactctcgtcggtccgtccggctaggaggtacgacggtctgtaatttatttagttgttcgacttcaagttagtcggtacgtagggttacggtagtaccgtaaccgtttaagtcggtttaaccgttacccgggtaaacggttacggggtaacccgtaagggttaacccgtacccggtttacccggttaacgggttacccggacccggtaaccccggtaaaccgggtaccccctaaaccccggtaccgtttaccgggtaccccttacccg

SEQ ID NO: 40046 - DNA, 600 bp, Homo sapiens
  misc_feature: GYAE6OF02GWZGJ.35.67.G01.1.454.CMB.1.raw
  modified_base (159)..(159): a, c, t, g, unknown or other
  misc_feature (159)..(159): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (493)..(493): a, c, t, g, unknown or other
  misc_feature (493)..(493): n is a, c, g, or t
tcagtacagatcgtcacgaccggtgctcgatttagagtatacatattgggtttggggggagaggagcccagtcactagaagtcggcggtgtttccatccggtgatcagcactgaacacagaggactcaccatggagtttgggctgagctgggttttccncgttgctcttttaagaggtgtccagtgtcaggtgcagctggtgagtctgggggagcgtggtccagccgtgggaggtccctgagactctcctgtgaagcgtctggattcatcttcgagtagttatggctagtgctacgtgggtccgcgagctccgaggcaaggggctggagtgggtgcaggttanagtggtancgtatgggaactcgaataaacggactagtgacacgtactccggtaggaagggtccgtattaccacctactcctacccgaagacgacctaagttaccgaaacgaaccgacgtcctaggtactcgtacgaactaaagtcgaacncggtacctagaacggtacgaccgaccgacacgggtccttaggtcgttaacgttacccgtgttacgtacggaacgaacgtaccggtaacggaggtacgtcgggtaacc

SEQ ID NO: 40047 - DNA, 654 bp, Homo sapiens
  misc_feature: GYAE6OF02FOX3Y.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctgagactctcctgtgaagcgtctggacttcattcttcaaattaactatggcatgcacgtggggtcccgccgaggcctccgaggcgaaggggactgggagttgggttggctaggttggtggtggtatgagtggaaagttaagagaatactatgacaagtacgacggtaggaagggtccgtacttacgtaaccactacctaccgacgacgaacctaacgttacccaaagaaccttacgttttacgttacctacggtaacaaacgtacgaaaccgtacgaccgtacggaagaccgggccgtaacgggaaccgtacgggacgtacgttaagttaacgttaccgtaggttacggaacgtaaggaacggtacggtaggtacggggtaccggacccggttacccccggaggtaaccggg

SEQ ID NO: 40048 - DNA, 729 bp, Homo sapiens
  misc_feature: GYAE6OF02H8RLZ.35.67.G01.1.454.CMB.1.raw
  modified_base (287)..(287): a, c, t, g, unknown or other
  misc_feature (287)..(287): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctgggtggagtcggtgggggaggcgtggtccagccgtggggacggtccctgagacctctcctgtagaacgcgtctggattcattcttanaataacgtagtggcagtcgctacgtcgggtcccacgacggcctaccggaggacgaaacggggtctgggtacggtgggtttcggcgtaaggttggttggtaggtactaggtaagtaggtaaaacgttaagttagaacttacgtaagtcgacgtaacgaaccgtaccgggtaggaaacgggttccgaacgtttaccaaagtaccgttacgtaaccgaacggtaaacgtaaccttaaaaccgttaccgtaaaacgtaacccttaacgttttaccggttactaacgaacgtaaacgttaacgaaaccgtcgacctaggaacgtacgggaaccggaacggtaaccgaacgtacgtaactttagttacgtttaaccgtggtacgaacgggtaacgaacggtacggaggtaccggggtaccccaacccgggttaccccggagttaacgg

SEQ ID NO: 40049 - DNA, 691 bp, Homo sapiens
  misc_feature: GYAE6OF02I630I.35.67.G01.1.454.CMB.1.raw
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (487)..(487): a, c, t, g, unknown or other
  misc_feature (487)..(487): n is a, c, g, or t
  modified_base (635)..(635): a, c, t, g, unknown or other
  misc_feature (635)..(635): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgcttctttaagnggtgtccagtgtcaggtncagctggtgagtcgtgggggagcgtgtccagccgtgggagtccctgacgactctctgngagcgtctggtattcatcttacaattaactatcggcagtgacctacgtcggggtcccaccgtagggccctacccggaagggacgtaaacgggggtccttggggtaaggttcggggtttaggacctagggttttggtaggttggtaatggtaacgttaggaaacgttaatacgtacgtttaactagtcgaccgaagtaccgtacggtaggtaaccgggccgtaacttcaacccgtntacccgtacgaagacgtaactaaacgttaccgaaagtacctttacgtttcgtaccgtagtaacctaaagtccgaaaccgtggacccgttaggaaccgtaccggaaccggaccggaaccgaccgggtagtaattaacgttacgttacgnggtacgagaacgtacgaggttacggaccggacccgtaccccgtaccggagtaccgg

SEQ ID NO: 40050 - DNA, 560 bp, Homo sapiens
  misc_feature: GYAE6OF02HG20R.35.67.G01.1.454.CMB.1.raw
  modified_base (305)..(305): a, c, t, g, unknown or other
  misc_feature (305)..(305): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctctttaagaggtgtccagtgtcaggtgcagctggtggagtcgtgggggaggcgtgggtccagccgtggggacgtccctgagactctcctgtgaagcgtctggattcatcttcaataactatggcatgcacgtgggtccnccaggcctccgaggccaaggggactgggagtgggtgctaggttgtgtggtatgataggaatanagatactatnacagacacgtagaaggcattcacgtatcacagacactaactacaacgactactttcgtcctagactaaagtacgaacacgctagacgacgacggagacgacggacgatatagttcgtagtggaaccgaaggtaacgacggtaacggtacgggacggtaccccggtaccccggtagtaaccgg

SEQ ID NO: 40051 - DNA, 260 bp, Homo sapiens
  misc_feature: GYAE6OF02G21XC.35.67.G01.1.454.CMB.1.raw
  modified_base (244)..(244): a, c, t, g, unknown or other
  misc_feature (244)..(244): n is a, c, g, or t
  modified_base (249)..(260): a, c, t, g, unknown or other
  misc_feature (249)..(260): n is a, c, g, or t
tcagtacagatcgtcacgaccggtgctcgatttagagtatacatattgggtttgggggtttggtggtctccactcccgccttgacgaggctgattattattgttgctcatatgcaggtagtagcactaatgtcttcggaactgggaccaaggtcaccgtcctaggtcagcccaaggcccaaccccatgtccactctgttccccgccctcctacacgatctgtactgacgcggctggccaaggcnatagnnnnnnnnnnnn

SEQ ID NO: 40052 - DNA, 737 bp, Homo sapiens
  misc_feature: GYAE6OF02GKA1G.35.67.G01.1.454.CMB.1.raw
  modified_base (178)..(178): a, c, t, g, unknown or other
  misc_feature (178)..(178): n is a, c, g, or t
  modified_base (197)..(197): a, c, t, g, unknown or other
  misc_feature (197)..(197): n is a, c, g, or t
tcagtacagatcgtcacgaccggtgctcgatttagagtatacatattgggttttcctcgttgctcttttaagaggtgtccagtgtcaggtgcagctggtgagtctgggggagcgtggtccagcctgggaggtccctgagactctcctgtgaagcgtctggattcatcttcaataactntggcatggcactgggtccncaggctacaggcaagggactgggatgggttgactagttgtagtggtactggattcggaaagtatacgatactatgacagacaccgtgaagggcctattcgacgtatcctacaggacacaacgttccaagaactcgttttcgtacccgtagacctaaatcgaaccgtagtcctaggacggtaacggacccggtaggaaccgtacgggacgtaacttaggttactaccgtagtacggacgtaacggacgtacggagtacggggtaccgtacccgtaaccccgggtattaccggagtaccgaacgggttaccgggaccggaaccgggtaccgtacccggtacggttaacccggtcccggtttacccgttaccggttacccgtaccgtaccccgttaaccgtaaccccggaacgggaccccgttaccgttaccggttacccgtttacccccggtaacggtaccccgttaaccccgttccgtaacccgtaaccgtacgaaccgtaccggttccggttaccggtcgggaccttaccggtaacccgg

SEQ ID NO: 40053 - DNA, 712 bp, Homo sapiens
  misc_feature: GYAE6OF02FMQI2.35.67.G01.1.454.CMB.1.raw
  modified_base (179)..(179): a, c, t, g, unknown or other
  misc_feature (179)..(179): n is a, c, g, or t
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
  modified_base (336)..(336): a, c, t, g, unknown or other
  misc_feature (336)..(336): n is a, c, g, or t
  modified_base (376)..(376): a, c, t, g, unknown or other
  misc_feature (376)..(376): n is a, c, g, or t
  modified_base (404)..(404): a, c, t, g, unknown or other
  misc_feature (404)..(404): n is a, c, g, or t
  modified_base (588)..(588): a, c, t, g, unknown or other
  misc_feature (588)..(588): n is a, c, g, or t
  modified_base (647)..(647): a, c, t, g, unknown or other
  misc_feature (647)..(647): n is a, c, g, or t
  modified_base (683)..(683): a, c, t, g, unknown or other
  misc_feature (683)..(683): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagttgggctgagcgtggtttccgtcgtagctctttaagaggtntcagtgtcgaggtgcagtcgtgggtgagtcgtgggggtagcgtggtccagccgtgggacgtcccngagacctctccgtgtagaacgtccggtcnggtattccattcttactaaactaaacgtagtcggactagtacgactacggttcggggtacccnccgtaggtcctccgagggtacgaaacgggtcgttaggggngttggggttcggacgttaggttttaggnggttaggttatacgggtaagtagggtaaatttaaggaagttaacttaaactgtacggtacgtaaaggccctaacggggttaacggtaaacgggccgttaacgtaccctaactcgtaaccgtccggaaagtccaaacgttaacttaaccgaaactaccgttcttttaccgaaccgtacgttaaanaaacggttcgaaacgtccgtaacgacgggtaaacgacggtccggaagtaccgcggtaanactttaaggtacctggtaccgttacgagaaggtccngggtaaggtaccgaccggtacccctacgg

SEQ ID NO: 40054 - DNA, 585 bp, Homo sapiens
  misc_feature: GYAE6OF02F0MQX.35.67.G01.1.454.CMB.1.raw
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (340)..(340): a, c, t, g, unknown or other
  misc_feature (340)..(340): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (520)..(520): a, c, t, g, unknown or other
  misc_feature (520)..(520): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccgaggcaagggactgggagtgggttggcagttgtgtggtatgatggaagtaatagattactatgcagacaccgtggaacggccgattcacatcnccanagacaattccaagaactactttgtcctgacaaatnaacagcctagacgagccgaggacacggacatatattacngtgcgagagcgagngggacncccgtaacccggatggacgccgtaacggtcggggaccacgggactccggttcgggcccgtccgttcgttcctacgccgtccctccgaaccgacgggccctacgttccgtcccttccccggngtccccaccctccctaccgaacgtccgaccgtcccgtacggtccgggaccaccggccggtcccgg

SEQ ID NO: 40055 - DNA, 753 bp, Homo sapiens
  misc_feature: GYAE6OF02F73DR.35.67.G01.1.454.CMB.1.raw
  modified_base (263)..(263): a, c, t, g, unknown or other
  misc_feature (263)..(263): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccaggcctgggacgtccctgagactctcctgtgaagcgtntggattcatcttcaaataacctatggacatgcacgtggggtcccgccgaggcctcccgagggacgaaacggggtcgtagggaggttaggggttcgggacgttaggttttcggttggttgggttaatgggtaacgtttaggggtaaaaggttaaattaaggtaatttaaccgttaagtagtaccgaaacgggtaacctaacccgggttaggaaacggggacccgttacgttacccaaccgtacttacccgtaccaaaggaacgaaaccttaacgttaacccgaaacgtaaaccttacgtttttccgtacctacgtaactaaacgttacggaacctaacgtaccgtaaggacgtaaccgaccgggaaacggaaccgaccgggtataacgttaaccgttaagtttaccgtaggttacgggaacggtaacggaacggtaccggtaacgggaaccggggtacccgtacccccggtaccccgggtagtaaccgggg

SEQ ID NO: 40056 - DNA, 664 bp, Homo sapiens
  misc_feature: GYAE6OF02IVM2M.35.67.G01.1.454.CMB.1.raw
  modified_base (367)..(367): a, c, t, g, unknown or other
  misc_feature (367)..(367): n is a, c, g, or t
  modified_base (523)..(523): a, c, t, g, unknown or other
  misc_feature (523)..(523): n is a, c, g, or t
tcagtacagatcgtcacgaccggtgctcgatttagagtatacatattgggtttggggggggagaggagcccagcactagaagtcggcggtgtttccatccgtgatcagcactgaacacagaggactcaccatggagtttgggctgagctgggtttttcctcgttgctctttttaagaggtgtccagtgtcaggtgcagctggtggagtcgtgggggaggcgtggtccagccgtgggacggtccctgagactcctcctgtgaagcgtctggattcatccttctaaataactagtggacagtgcacgtcgggtccgccgaggcgtccgaggacgaaggggcttagggaggttcggttggctaggttcgngtggtatgagtaggtaatagtaagtatacgtagtgacgtagacgtaccggtaggacgggtcctaacgtactacacttcgtaccgaagacgtaaccaacttaccgaaacttaacctacgttttacgttacccgtacgaaccttaaatacggtaaacnccggaaccgttacggaacggaccggacccggtaggaacccggaacgaacgtacgttaattacgttaccgttaggtacgtacgaaggtaacggacggtaaggtccggggtaaccgtaccccggtacccccgggtgtaccggg

SEQ ID NO: 40057 - DNA, 645 bp, Homo sapiens
  misc_feature: GYAE6OF02ITUPA.35.67.G01.1.454.CMB.1.raw
  modified_base (312)..(312): a, c, t, g, unknown or other
  misc_feature (312)..(312): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatgggagtttgggctgagctgggttttcctcgttgcttcttttaagaggtgtccagtgtcaggtgcagctggtggagtcgtgggggaggcgtggtccagccgtgggacggtccctgacgactcctcctgtgagcgtctggattcatcttcaataactatggcatcgctacgtcgggtcccncgaggcctaccgaggacgaacgggctgggaggtggttggctaggttgtggtggttatggagttaggaaagttaatacgtaatactagtgacacgacgtacggtaggaagggacccgtattacccaacctactcctaccgaagtaacgactaacttaaccgaaagtaaccttacgttttacgttaccctagtaacctaaatacgaacctacgtaccgtaggaacgacggtaccggacggaacccgacggacgtaacttaagtacgtttaccgtggtacggacggtaaggacgacggaggtagggacccgaccccggtaaccccggagtaccggg

SEQ ID NO: 40058 - DNA, 739 bp, Homo sapiens
  misc_feature: GYAE6OF02ILLP9.35.67.G01.1.454.CMB.1.raw
  modified_base (220)..(220): a, c, t, g, unknown or other
  misc_feature (220)..(220): n is a, c, g, or t
  modified_base (293)..(293): a, c, t, g, unknown or other
  misc_feature (293)..(293): n is a, c, g, or t
  modified_base (539)..(539): a, c, t, g, unknown or other
  misc_feature (539)..(539): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagcgtgggttttcctcgttgcttacttttaaaaggtgtaccagtgtgaggtgcagctgtcggagtcgtgggggngcttggtacagcgtggggggtccctaggagacgttctccgtgtacgcacgcctctggactcaccttgaagtanctagtgcatgagcgtggtccgccaggtcgtcgagggcgggcgtgggtacgtggtcttcgttactagttagtcgcgttacgttgggtgtacctgtactaagttaccgtaacgccaagtcttacgttcggtaacgggtaacgggttccccgttacccgtacgttaccccgtacgaacggtaaacgtaacgtaaaccgtttaccaaaacgtaaaccctaccgttaaggtaacttcgtaataacgtaaanacgtaaccagtccgtaatacgggaccgtacgaaccggaacgtacccggaacgttaaacgttaacttaacgggttacggtaacggttaacgtaaaaacgttacggggtaaaccggttaaacggtacggggttaaacggttcggttaaccggtttaaaccggaacgtttacccgggtttcgggacccggggttaccccgggg

SEQ ID NO: 40059 - DNA, 733 bp, Homo sapiens
  misc_feature: GYAE6OF02H8G3N.35.67.G01.1.454.CMB.1.raw
  modified_base (200)..(200): a, c, t, g, unknown or other
  misc_feature (200)..(200): n is a, c, g, or t
  modified_base (277)..(277): a, c, t, g, unknown or other
  misc_feature (277)..(277): n is a, c, g, or t
  modified_base (592)..(592): a, c, t, g, unknown or other
  misc_feature (592)..(592): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttcgggctgagcttgggttttcctcgttgcttcttttaagaggtcgtccagtgtcgaggtncagctggtggagtcggtgggggagcgtggtcccagccgtgggacggtcctgacgcgttcacctgagaacgcgttcgnggacttcgattcttacgaattaacctagtggcatgacgtacgtcggggacctccgaaggcctaccgaggtaccgtaacggcgtagggtacggttggtacggtacgtaggtttcgtaggttaggtagtaccggtgtaaacggtaaagttaacgttaacggaactttaaagtgttacggaaacgaccggtaacggtaaccggttagggaaacggtcccggtaaatttacccgaacctaacgtacccgttaaccgaacggtaaccgtaaacttaaccgttaaccgaaacggttaaccttcgtttaacgaccccgttanaaccgtaaattaccggaacgtaccgtacgtacggaacgacggtacgaacggtacacgggtactaacgtaattaccgttagacggtcgtaaaccggaggtacgggaccgtaagggtacccggaccctcccgtaaacccgggg

SEQ ID NO: 40060 - DNA, 530 bp, Homo sapiens
  misc_feature: GYAE6OF02HCTQ3.35.67.G01.1.454.CMB.1.raw
  modified_base (306)..(306): a, c, t, g, unknown or other
  misc_feature (306)..(306): n is a, c, g, or t
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
  modified_base (471)..(471): a, c, t, g, unknown or other
  misc_feature (471)..(471): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgaagcgtctggattcatcttacaataactatggcatgcacgtgggtccnccaggctccgagggcaaagggctgggagtggttggctaggttgtgtggtatgaatggaataatacgatactaatgacagacacgtgaacggcgatcgacatcacagagacaacttacaagtactactttgtcanacaaatcgaacncgctagagacgacgagacnggacagtataactacgtagtagcgaagtaacgacgagtacgggacgtcccgtaacccgg

SEQ ID NO: 40061 - DNA, 620 bp, Homo sapiens
  misc_feature: GYAE6OF02HQSME.35.67.G01.1.454.CMB.1.raw
  modified_base (285)..(285): a, c, t, g, unknown or other
  misc_feature (285)..(285): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgcttcttttaagaggtgtccagtgtcaggtgcagctggtggagtcgtgggggagcgtggtccagccgtggggacgtccctgagcctctcctgtgagcgtctggattcatcttcaataactanggcatgctacgtcgggtcccgccaggcctaccgagggcaaaggggtctgggaggttgggttggctaggttgtgtggtatgagttggaattaagtgaatctagtgacagaccgaccggtggaacgggtccgtaattccgacctactaccgtaccgaagacgaactaaacgttaccgaaacgtaaccttaccttttcgttcctagactaaagtacgaacacggacctaggacgtaccgccggaacgaaccgaccgggtacgtagttagtaacgttaccgtaggtaggacggaagacggacgtaggtacggacccggtacccgtaccccggataccgg

SEQ ID NO: 40062 - DNA, 940 bp, Homo sapiens
  misc_feature: GYAE6OF02HYKL9.35.67.G01.1.454.CMB.1.raw
  modified_base (124)..(124): a, c, t, g, unknown or other
  misc_feature (124)..(124): n is a, c, g, or t
  modified_base (205)..(205): a, c, t, g, unknown or other
  misc_feature (205)..(205): n is a, c, g, or t
tcagtacagatcgtcacgaccggtgctcgatttagagtatacatattgggggaggcgtggtccagcctgggaggtccctgagactctcctgtgaagcgtctggattcatcttcaagtaactagnggcatgcacgtcgggtcccgccaagggtctcccgagggcaaacggggtctgggagttggttggctaggttgtggtaggtanggtagttgggaaagttaataggataaccgttagtggcaaggtacgacccggttaggaacggggtcctaagttacccaacctaagttccctacgaaaacgggtataaaccgtaacgtttaacccgaaacggtaaaacctaacgtttttacggttaccccgttaacggaacctaaaacgttaccggttaaaaccgacggtaacccgttagggaaacgaccggaccccggtaaagggaaacctaccggggtaccgtaacgttaacttaacgtttaacgtgggtacgtacggaaaggtacggaacgtaggtaaccgggtaccggtacccggtaaccccggaagttacggaacgtcggtaaccggtcggggaacccgtacggggaccgtacccggtggttaccggtcccgtacgttccggtttccgaaccgtccccgtaacccgaaccggttaaccggggcccttaaccggtcccgggtttaccccttacccccggtaagggacccccttacccgttccccgtaacggtaccgaaccggttccgtaaccccggttccgggttaccgggggacctaacccgaccgggtcccgggtaaccccgttacggggtacctccgggtaccctacggggttacccggaaccggtttaaccccgtttaccggttacccgaaaacccggttcgttacccggttacgaaccggtttccggaacggggttccggtcccgtacggggaaccgg

SEQ ID NO: 40063 - DNA, 615 bp, Homo sapiens
  misc_feature: GYAE6OF02FQNZ6.35.67.G01.1.454.CMB.1.raw
  modified_base (273)..(273): a, c, t, g, unknown or other
  misc_feature (273)..(273): n is a, c, g, or t
  modified_base (493)..(493): a, c, t, g, unknown or other
  misc_feature (493)..(493): n is a, c, g, or t
tcagtacagatcgtcacgaccggtgctcgatttagagtatacatattgggtttgggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagtcgtggtccagcctgggaggtccctggagactctcctggtgaagcgtctggattcatcttnaataactatggcatgacacgttcgggtcccgacctagggcctccgaggcgaagggactggaggttgggttggctaggttggtggtaggtagtcgagttagggaagttaagtaggaattactatgacagccgaacggtggaacgggcgacttaccaccgtataccgtccgaggaagaaccaattaaccgaaacgaaccttacttttcgttaccgtacgaanaaacgttcgaaaccgtacgccgttagaggtacggaccgaaggacgacggacgtataactacgttacgtaggtagacggtagaacgcggtaggtacgggacgaccccgtaccccggagtacgg

SEQ ID NO: 40064 - DNA, 639 bp, Homo sapiens
  misc_feature: GYAE6OF02JR5D9.35.67.G01.1.454.CMB.1.raw
  modified_base (200)..(200): a, c, t, g, unknown or other
  misc_feature (200)..(200): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (415)..(415): a, c, t, g, unknown or other
  misc_feature (415)..(415): n is a, c, g, or t
  modified_base (465)..(465): a, c, t, g, unknown or other
  misc_feature (465)..(465): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactagtggcatgcacgtgggtccnccaggctccaggcaagggactggagttggtaggcagttgtgtggtatgactggaagtatgaatactatgacgagaccacggtggaacgggcctattaccaacatccgtccaagtacgaacctaacttaccaaacgtaactacgtttcgtctacganaaacgtaggaacngacctaggacgacgtacgaggtacgacggtagtattacgtatacgngtacgacgaggtaacgacgtaggtacgggacctaccccgttaacccgggnttacggaacgtctacgggtacggggaccacgggccctaccgtcgggtccgtccttcctcgtcgccgtaccctcgaaccgaccgggctaccttcccggtacctccccgtggccctacccggtacacccgaacgtcacccgtacccggtacggcgggacctaccggcgtccccggg

SEQ ID NO: 40065 - DNA, 849 bp, Homo sapiens
  misc_feature: GYAE6OF02FHH33.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagcgtgggtggagtcggtgggggagcggttggtccaggccgtgggacgtccctggactactctcgtgtacgagtccgtacgtggtacttcgacttccttacaaacttaactcgttcggactacgttcgcctaaccggggttcgggtcccccgacgtacggtccgtaaccggacggacggtaaacgggtccgtaggggttacggttcgggttacggccgttaaggttcggtaggtacgggttagacgggtacggttaagggtaaaacgttaagtacggttaacttaaaccgtgttaccggaacgtaaccggtaacgtacccggggtaaggggaacccggttaccgtaactttaccccgaaacccgttattaccccgaacgtaaaggtaaaccccgaactttaaacccgttaaccggtaaaaaccttacccgttttacgttttaccgacccgtaacggtaaaccttaaagttaccggaaacccgtcgttaaccgaagggaccggtaaaccgtaccgggaaacgtaacccggacgggtaacttacgtaaacggtttccgttaacggtcgggtaaacgtacgggtaaaccgggtaaggtacccgggtaagggttacccgggaacccccggttaccccggtaaccgggaggttacccggg

SEQ ID NO: 40066 - DNA, 728 bp, Homo sapiens
  misc_feature: GYAE6OF02GPT8D.35.67.G01.1.454.CMB.1.raw
  modified_base (298)..(298): a, c, t, g, unknown or other
  misc_feature (298)..(298): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagtacagatcgtcacgaccggtgctcgatttagagtatacatattggggggagggcgtggtccagcctgggaggtccctgagactctcctgtgaagcgtctggattcatcttcaataactatggcatgcactgggtccgcccaggctcccaggcaaagggactgggagtgggttggcaggttgtggtggtatgatggaagtaatagatactatgcagacaccgtggaagggccgattcaccatctaccagagacaacttaccaaagaactacctttgttcctgactaatagaacanccgtgagacgcggagacgacggcgatatacttacgtgtgacgaagaagngagtgggacgccgtaaccccggntagancgacgtcgggcgacggccgaccgtcggccgtacgtccttccgtacaccgtccctacccgtaacccgaccgggtaccccacggttccccggtccccgtttcccccgtaccggcccctaccccgttccccgttaacccaaccggtaaccgtccctcccggttaccgggccggggtaccctaaccgggaccggtacccgggtacccccggttcggggtcccgtccggtacccggttaccgggtaacccggtaaacgggttaccccttaacccgttccccgtaaccggttaacccgtttcctaccgggtttaaccgtccgggtaacgggtcccgggtacggtaccgggtaacccggg

SEQ ID NO: 40067 - DNA, 744 bp, Homo sapiens
  misc_feature: GYAE6OF02G9T0B.35.67.G01.1.454.CMB.1.raw
  modified_base (324)..(324): a, c, t, g, unknown or other
  misc_feature (324)..(324): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcggtggtccagccgtggggacggtcccctgagtacctctcctggtgaagtcgtctggattccattcttcaaattaactatggcattgacctacgttcggggtaccnccgaggcctccggaggacgaagggcgtgggaggttgggtggcgtagttggtggtaggtatgagtaggaaagttaagagtactacgtagtacgacgtaacgaccgtacggtacggaacgggacccgttacttaccaacccgtacgtacccgtacgaagaaccgtaacctaaaccttaccgaaacgtaaaccgtttaccgtttttaccgttacccttaacgtaacgtaaaacttacggtaaaccagtaccccgtagggtaaccggaacccgggtacccgggaaacggtaaccggaaccgggtacgttaacggttaacgttttacttaacggttcggttacggaacggttaacggtaacggtacgggaacgggttacccggggaacccggtacccccggttacccccggtaaggttacccggg

SEQ ID NO: 40068 - DNA, 672 bp, Homo sapiens
  misc_feature: GYAE6OF02G4DK1.35.67.G01.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (457)..(457): a, c, t, g, unknown or other
  misc_feature (457)..(457): n is a, c, g, or t
tcagtacagatcgtcacgaccggtgctcgatttagagtatacatattgggtttgggggggggtcacaagaggcagcgctctcgggacgtctccaccatggcctgggctctgctgctcctcactctcctcactcaggacacagggtcctgggcacagtctgccctgactcagcctgcctcgtgtctgggtctccgtggacngtcgactcaccattcctcctgcacgtaggaaccagcagcgtagtgggttagggggttatcggtaccttgttcctctaggtatcaacngacctaccaggaccaacgaccccctaaatacttaattacaacgacactaacggccaccgtcgagtcttactatccgtntctcngccacgtagttcgcgtacctaccgttccgaccttccgacgaaccttacgtctccgggtggtcccgtcgggtctaggaccgagcggtntacggttatttaccgttgtttcgcgtacttgaattagtcgtaggtacggttacgtaacgtaccgtaatttacgttcgttaaccgggtacttaaccgggtacgggtaaaacttcccgggtaacgttaccccgtttaggttaacccgggaaccgtaccggtaacccccgtaaccggaaacccccgtaccccgtaagttcccgggtaccttaaccccg

SEQ ID NO: 40069 - DNA, 774 bp, Homo sapiens
  misc_feature: GYAE6OF02HHH2V.35.67.G01.1.454.CMB.1.raw
  modified_base (202)..(202): a, c, t, g, unknown or other
  misc_feature (202)..(202): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcacgtcgggtcccnccaggcctaccgaggcgaagggactgggagtgggtgctaggttgtgtggtatgagtaggaatatagatactatgacagaccacggtagaacgggccgtacttcaaccgatcctacgagaacgaactaacttaccgaaaagtaaccttacttttacgtacctgaactaaacgtgaaacagccgtagacggacggacccgtaaggaccgacggactaattataacgttacgtggtacgacggtaaggaacggcggtaaggtaccggggaccgtaccccggtaaccccgggagtacggacggtaccgaaccgggttcggggacccgacggggaccccttacccggtccggggtcccgtcccgttaccgttccgttacccgaccggtaccccgtacccgaaaccccggtaaccgggtcccccgttaacggttcccccggtttcccccgtttacccccggtacccggggtaaccccctacccccggtttaccccgtaaacccggtaaccgacccgtacccggtaccccggtcccggggttaccgggggaccccttaccgggacccgggtcccccggg

SEQ ID NO: 40070 - DNA, 527 bp, Homo sapiens
  misc_feature: GYAE6OF02HYL4J.35.67.G01.1.454.CMB.1.raw
  modified_base (304)..(304): a, c, t, g, unknown or other
  misc_feature (304)..(304): n is a, c, g, or t
  modified_base (368)..(368): a, c, t, g, unknown or other
  misc_feature (368)..(368): n is a, c, g, or t
  modified_base (405)..(405): a, c, t, g, unknown or other
  misc_feature (405)..(405): n is a, c, g, or t
  modified_base (484)..(484): a, c, t, g, unknown or other
  misc_feature (484)..(484): n is a, c, g, or t
  modified_base (495)..(495): a, c, t, g, unknown or other
  misc_feature (495)..(495): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtcctgagctctctgtgaagcgtctggattcatcttcaaataactagtgcagtgcacgtgggtaccnccgaggcctccgaggccgaaagggctggagtgggttggctagttgtggtgtatgataggaatanagatactatgacagacacgtagagggcatacacatcncagacgacaataccaagaactcttagtcagacaaatcgaacagctgagacgacgagacgacgacatactagtaacgtgngacgagaacgngtacgtcggacgacccggtacccgtagtacgg

SEQ ID NO: 40071 - DNA, 670 bp, Homo sapiens
  misc_feature: GYAE6OF02FPMRN.35.67.G01.1.454.CMB.1.raw
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
  modified_base (351)..(351): a, c, t, g, unknown or other
  misc_feature (351)..(351): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctgggagtccctgagactctcctgtgaagcgtctggattcatcttcaaataactatggcatgcacgtgggtccaccaggcctccaggcaaagggctggagtggttgcagttgngtggtatgatggaataatagaatacangacaagacacgtgaaggccatcacatctacaagacgacaactaccaaagaactacttttgtacctgaacctaaagtcgaaactanaccgttagaacgacgacgaacggacctaggacgtaattataacttacgagtcgacgaagaaggacgaaggtacgggacgtacccgtaacccccggatacggacgacgtacggtacgggtaccgaacgggccgaacccgttcgggtaccgtcccgtaccgttaccgttaccgtacgtaccctacccgaaacccgtaaccggaccctacgtacccggttcccttacccccggtcggtaccctaccccgtaacccgtacccgtaaaccgaccggtaccgtacccgtccggttaacccgggggacctacggaccggacccggg

SEQ ID NO: 40072 - DNA, 258 bp, Homo sapiens
  misc_feature: GYAE6OF02JAOEW.35.67.G01.1.454.CMB.1.raw
  modified_base (248)..(258): a, c, t, g, unknown or other
  misc_feature (248)..(258): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggcccaaccccatgtcactctcgtcccgccctcctcacgatctgtactgacgcggctggcaaggcgcatagcnnnnnnnnnnn

SEQ ID NO: 40073 - DNA, 620 bp, Homo sapiens
  misc_feature: GYAE6OF02FJU3M.35.67.G01.1.454.CMB.1.raw
  modified_base (496)..(496): a, c, t, g, unknown or other
  misc_feature (496)..(496): n is a, c, g, or t
  modified_base (611)..(611): a, c, t, g, unknown or other
  misc_feature (611)..(611): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagctgggttttcctcgttgctctttaagaggtgtccagtgtcaggtgcagcgtggtggagtcgtgggggagcggtggtccagccgtgggacgtccctgagactctcctgtgaagcgtctggattcattcttcaaattacctatggcagtgccacgtcgggtccgccagggcctaccgaggcgaagggcctgggacgttggtggctaggttagtggtggtagtgtagtggaatatagagtacatgacagacgacgtaggaacgggtcgacgtacgacctactctaccgagaacggaactaaacgttaccgaaagaaccgttactttacgttctacgactaaagtacgaacncgacctggacgcgacgacggaaccgacggactattaacgtacgttaacgtaggtcggtacggaacggtaggacggttacggtacggggaaccggtaccccggttaacccccgggnttaaccggg

SEQ ID NO: 40074 - DNA, 796 bp, Homo sapiens
  misc_feature: GYAE6OF02JZ37Q.35.67.G01.1.454.CMB.1.raw
  modified_base (74)..(74): a, c, t, g, unknown or other
  misc_feature (74)..(74): n is a, c, g, or t
  modified_base (177)..(177): a, c, t, g, unknown or other
  misc_feature (177)..(177): n is a, c, g, or t
tcagtacagatcgtcacgaccggtgctcgatttagagtatacatattgggtttgggtctggagaggagcccagnactagaagtcggcggtgtttccatccggtgatcagcactgaacacagaggactcaccatggagtttgggctgagctgggttttcctcgttgcttacttttagnggtgtccagtgtcaggtgcagctggtggagtcgtggggggagccgtaggtcccgagtcccgtaggggacgtcccgtaggacgccttcgtccgtagtcggtaacgcccgttgtacgggtactttcgaagttcttacaaacttaactgttcgggacctatcgacgacgttccggccgaccgaggttcccacccggtgggaccaaaccggggtattacggggacggtttaggttccggggataacggtttcgggtttaggttacggaagtttaccgtaaggttaaggggaaattaaaacgtaggtttaattacgggttataccggtaccgaaaggttcccggtaacggttacgggaaaaccgggtccgttaaccggttaccctaacgtaaacccgtcttaccggaacgtaacggtaaaccttaaccttaacccgaaacgttacgttaaccttttacggttacccgtagtaaaccgtaaccgttacgaaccgtaaccggtacctaaggaacgtaacccggaccgaggggtaaccaccggtaagtaaacggttcgtaactccggttaacgtacggtacgaaggttaccgaagtacggttaccggacccgtacccggtaacccgg

SEQ ID NO: 40075 - DNA, 602 bp, Homo sapiens
  misc_feature: GYAE6OF02FWO0Y.35.67.G01.1.454.CMB.1.raw
  modified_base (367)..(367): a, c, t, g, unknown or other
  misc_feature (367)..(367): n is a, c, g, or t
  modified_base (548)..(548): a, c, t, g, unknown or other
  misc_feature (548)..(548): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgacgactctcctgtgaagtcgtctggattcatcttacaataactatggcatgcactgggtcccgcaggctccgaggcaagggctggagtggttgctaggttgtgtaggtatgatggaagtatagtanacgtatgacagaccacggtaggaacgggccgtattccgaaccctcttacctacccgaagaacgaacctaacgttaccaaagaacccttacgtttgttaccctaggaaccaaagttaccgaaactacgtaccgtaggaacgtaccgacgaacggacgaccggagtagttatacgtttaacgngtacgtcggaagaaggcgaacggtcgggaacctaccccggtacccggatacggg

SEQ ID NO: 40076 - DNA, 769 bp, Homo sapiens
  misc_feature: GYAE6OF02IKMBC.35.67.G01.1.454.CMB.1.raw
  modified_base (294)..(294): a, c, t, g, unknown or other
  misc_feature (294)..(294): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcacgtgggtccgccagggcctccgaggccgaagggacgtgggaggttgggttggctaggttgtaggtggtagtggataggaaagtatagtaatactagtgcagaacnccggtaggacggccgtactcacctacgtctaccgaaggacgtaactaacgttaccaaaagtaaccttaacgttttcgttaccgtaagtaacctaaagtacgaacgtacggccttagaacggtacggacccggaaagggtaccgaaccgggtacgtaagttaacgttaccgtttaacgtggtaccggtaaggaacggaacgggtaacggtacgggtacggggtaaccccgtaacccgtacccccggggattaccgggacgtaccggtaacgggtccgggtaccgaccgggtacccgtacccggtcgggttacccgtcccgttaccgttcccgttacacccggtcccttaacccgacccggtaacggccccgtaccgttcccggtcccgttaccccgtcggtacccctccccttcccgtaaccgaacgtaccggtaccgtaccggtccggccgggtacgcccggaccgtaccccggg

SEQ ID NO: 40077 - DNA, 771 bp, Homo sapiens
  misc_feature: GYAE6OF02HK5T6.35.67.G01.1.454.CMB.1.raw
  modified_base (656)..(656): a, c, t, g, unknown or other
  misc_feature (656)..(656): n is a, c, g, or t
  modified_base (695)..(695): a, c, t, g, unknown or other
  misc_feature (695)..(695): n is a, c, g, or t
tcagtacagatcgtcacgaccggtgctcgatttagagtatacatattgggttgggggggagaggagcccagcactagaagtcggcggtgtttccatccggtgatcagcactgaacacagaggactcaccatggagtttgggctgagcgtggtttcctgtgctctttaagaggtgtccagtcgtacaggtgcagcgtgggtggacgtcggtagggggagtcgtaggtccagccgtagggacgtccctagacgacctcgtacctggagacgtcgtctggacttcgacttactactaaatacctagtcggacaagttcgactaccggtcggggtacccacgtacggtacctacggaacgaccggaaggggtacctggggtacgtacggttaggctaaggttggtgtacggtatacgtagtagaaacgtttagagtaacgttaactaggtcgaacgaaccgtaactaccgggaaggtaacgggtaccctataaccgaaccgtacttacccgtaacgtaagtaaccgtaaaccgttaactaacccggtaaaacgttaacccttaccggttttacgccgtttaacgaaaaccttaacggttaaacgtacccggtacgtaccgaaacgggtaaacgaccgggtaacggaaaccgggtaaaccnccggggttaactaaacgtttacgttaaccggtttaaccngggttaacaacggtaaggaacggttcccgaagggttaaccccgggtacctacccccggtaaccggtataacccggg

SEQ ID NO: 40078 - DNA, 840 bp, Homo sapiens
  misc_feature: GYAE6OF02FU5AB.35.67.G01.1.454.CMB.1.raw
  modified_base (242)..(242): a, c, t, g, unknown or other
  misc_feature (242)..(242): n is a, c, g, or t
tcagtacagatcgtcacgaccggtgctcgatttagagtatacatattgggtttggggggagaggagcccagcactagaagtcggcggtgttccatccggtgatcagcactgaacacagaggactcaccatggagtttagggctgagctgggttttcctcgttgcttcttttaagaggtgtccagtgtcaaggtgcagcgtggtgagtcgtgggggagcgtgccagcctgggagtccctgacncgtctccgtgtacgaacgtcctgtacggatttccgtcctttacgaaggtaaccttagttggcgtaattcggcctaagtcggggtccccgaccgaggtccctccggaaggaccggtaacgggggtctacggggtaggttgggggtacggtccgtaagggttcgaacgttaacgttccgtaaggttttaccgaaggttaccgggtaaaaagtttaaacgtaaaacgttacgttaaaccggtaccgtacggttaacccgttaccggtaacggggtaacgggtacccgttacgtttaaccgaacccgtaacttacccgtacccgtaacggtaaacgtaacgttaaacgttacccgtaaaacggtacctaaaccgttccgttacggttacccttaacgtaccggtaccgaaacgttacgtaacggtaaccgtacggttaccgtaaccgggtacccgtacggaacccggtaaccgtaccgggttaccctttacggttaccgtttaacgtttaaccggttaccgggttggtaacccggtaaggtaaccggtaacgttaaacccggttaaagtttacggtttacggtagttacccggttaaacggg

SEQ ID NO: 40079 - DNA, 689 bp, Homo sapiens
  misc_feature: GYAE6OF02HULVW.35.67.G01.1.454.CMB.1.raw
  modified_base (444)..(444): a, c, t, g, unknown or other
  misc_feature (444)..(444): n is a, c, g, or t
  modified_base (493)..(493): a, c, t, g, unknown or other
  misc_feature (493)..(493): n is a, c, g, or t
  modified_base (541)..(541): a, c, t, g, unknown or other
  misc_feature (541)..(541): n is a, c, g, or t
  modified_base (577)..(577): a, c, t, g, unknown or other
  misc_feature (577)..(577): n is a, c, g, or t
  modified_base (627)..(627): a, c, t, g, unknown or other
  misc_feature (627)..(627): n is a, c, g, or t
tcagtacagatcgtcacgaccggtgctcgatttagagtatacatattgggtttgggggggagaggagcccagcactagaagtcggcggtgtttccatccggtgatcagcactgaacacagaggctcaccatggagtttggggctggagcgtttcgggttttcctcgttgcttactttttaaggaggttcgtcctagttgtcgtaggtgacaggtccgttgggtaggtacggttcggtagggggggagggtccgtttgggtacccaggtccgttagggggacgttcccgtggacgtacctccgttctggtacgacggcgttcgaggtacttacgtacttcttaacgtaaaataaccgtagtcggacctattaccggctacggttcgggtaccccgcgacggtccgtacgacgggtacgaacgggtcgtaggtcggttggtacggnttaggttgtggtttagtagtagtagttaagggaattaatagtaacgttnagttcgacacgacgttacggcggaacggacgtacgtaccacgcttacnctaagactactaactacgtaacgtacttaccgtttntacgtactacgaatagaacgtacgacgtagacgacgtacggacgcgtagntactattagtagtgtacggaagtacgaacggtgacggccggacgtacccggtaccgagtacg

SEQ ID NO: 40080 - DNA, 869 bp, Homo sapiens
  misc_feature: GYAE6OF02H7YB1.35.67.G01.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggtttttcctcgttgcttacttttaagaggtgtccagtgtcaggtncagctggtggagtcgtgggggagcgtgtccagccgtgggagtccctgagactctcctgngacgcgtctggattcattccttanaaactactagtcggacagtcgctacgtcggggtccaccgaggtcctaccggtacgggaccgaacgggtacgtaggggtaggtttcgggtttacggacgttaggtttcggtggtttacggtaagttacggttaaggtaggggtaaacgttaaattaacggtaactttaacggtaaacgtggaaccgaacgtaaccggtaaccgggttaggggaaaccggggtacccgttaacgtttacccgaaaccgttacgtttacccggtaccgtaaaggtaaccggtaacccttaaaccgtttacccgaaaaacggtttaacccgtttaccgtttttaaccggtttacccgttaaggtaacccgttaaacggtaacggtaaaccctacgggttacctaaggtaacccgggaacccggttacccgggaaacgggtaaacccgtaccgggggttaaacctacgtttaaaccggttttaacgtttaaccggttcgggtttaggaaacccgggttaagggttaaccgggttaaccggttaccgggtaaccggggtaacccccggggttacccccgttaaccccggggtagttaaccccgggg

SEQ ID NO: 40081 - DNA, 271 bp, Homo sapiens
  misc_feature: GYAE6OF02GN1WO.35.67.G01.1.454.CMB.1.raw
  modified_base (254)..(271): a, c, t, g, unknown or other
  misc_feature (254)..(271): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaaggtcaccgtcctaggtcagcccaaaggcccaaacccccactgtcactctgttccccgccctcctcacgatctgtactgagcgggctggcaaggcgacatagnnnnnnnnnnnnnnnnnn

SEQ ID NO: 40082 - DNA, 752 bp, Homo sapiens
  misc_feature: GYAE6OF02I4DA3.35.67.G01.1.454.CMB.1.raw
  modified_base (375)..(375): a, c, t, g, unknown or other
  misc_feature (375)..(375): n is a, c, g, or t
  modified_base (700)..(700): a, c, t, g, unknown or other
  misc_feature (700)..(700): n is a, c, g, or t
  modified_base (746)..(746): a, c, t, g, unknown or other
  misc_feature (746)..(746): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttcctcgttgcttacttttaagaggtgtccagtgtcaggtgcagctggtggagtcgtggggaggcggtcggccagcgtgggacggtccgtgagactctcctgtgagcgtctggattcactcttactaataatactggcagtcgctacgtcggtccgccaggtcctaccgaggacgtaaacgggcgtagggaggttgggttacggtacggtaggtttcggnggttaggttagtagaaggttaggtaaagttaacggtagaacgttacgtagttcgaacggtaaagaacccgtaaccggtaggggtaacccgggtacccgtttaagttaaccccacccggtaaaagttcccccgaaacgttaacgggaaacgttaaaaccctaaacgtttaaccccgaaaaggttaaacccttttccggtttttacttaaccccggagtaaacctaaaacgttaccgaaacgtccgtacgggtaagtaacggacccgggccggaaacggacccgtacgggaacttattacgtaaccgttgtacggacgtacggaaanacggtacgtacgggtaccgggaccccgtaccccggtaacccgggtntaacgg

SEQ ID NO: 40083 - DNA, 740 bp, Homo sapiens
  misc_feature: GYAE6OF02JPJEC.35.67.G01.1.454.CMB.1.raw
  modified_base (260)..(260): a, c, t, g, unknown or other
  misc_feature (260)..(260): n is a, c, g, or t
  modified_base (331)..(331): a, c, t, g, unknown or other
  misc_feature (331)..(331): n is a, c, g, or t
  modified_base (732)..(732): a, c, t, g, unknown or other
  misc_feature (732)..(732): n is a, c, g, or t
tcagtacagatcgtcacgaccggtgctcgatttagagtatacatattgggtttggggggaggaggagcccagcactagaagtcggcggtgtttccatccggtgatcagcactgaacacagaggactcaccatggagtttgggctgagcgtggtttcctcgttgctctttaagaggtcgtcagtgtcgaggtgcagctggtgagtcgtggggagcgtggtccagccgtgggacggtccctagacgtacttccgtccttggngaacgtccgttcgtcggacttcgacttcgttacaaattaacctgtcggacagtgccaacgttcggggtccncgacgtccgtccgaaggtacgaaacgggttctaggggaggtttcggttcggctagggttttgggtggtcggttaagtacggggaacttaggggtaaaacgttaaagttacggtacgtttaaagaacgttcggttaaaccgaaagggtaacccgtaacccggggtttaagggaaccgggtaccgtagtttaacccgaacgttaccgttaccgtaacgaaacggtaacgtaacctaaccgttaacaaacgtaaccgttacttttacggttaaccgtacgtaacgtaaagtacgtaacctacgtaccgagtacgtaacgaccggacggaacgaccgtagtacttaacgttacgtaacgtggtaacgtcgaagtaccgcgtacggtacggacgtaccccggtacncggtaacg

SEQ ID NO: 40084 - DNA, 725 bp, Homo sapiens
  misc_feature: GYAE6OF02HMVDU.35.67.G01.1.454.CMB.1.raw
  modified_base (407)..(407): a, c, t, g, unknown or other
  misc_feature (407)..(407): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacggtccctggacgtacctctcctgtgaacgtcgtctggattcagttcttacaaataactagtggcatgcacgtcgggtcccgaccacggcctccgaggcgaaagggcgttggacgtgggttggcgtaggttggtgtggtatggagtaggaataagtagaatacgtatcganacggacaccggtaggaacgggtccagttccaacgtatccctacgaagtacgaactaactaccgaaacgtaccttacgttttcgttaccctagtaaacgtaacgtaacgaaaccgtacgtacccgtagggaaccgaccgggtaaccgggaaacggtaaaccggaaccgggtaaccgtaacgtttaaacgtttaccgtttaacggtacccggtttaagggaaccggtaaacgggttaacgggaaccggtaacggggttaccggggaaacccccgggtttacccccccgggttaacccccggggtaagttaaccccggggg

SEQ ID NO: 40085 - DNA, 775 bp, Homo sapiens
  misc_feature: GYAE6OF02GQGJ4.35.67.G01.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgactcagcctgccctcgtgtctgggtctcctggacagtcgatcaccactctcctgcacgtgaaccngcagcgattgggttaggggtntggtaccttgtctccgtaggtatcaacgcgacacccgaggacccaaaacgcccccaaaacgttctttaaaacgtttagtaaacggacctaaccgttaacgccgtaacccgtcgtaaaggggtaccttttactaacgttaccgtcctttacctcgttcgggtaccttaccgaacgttccggtacggacccttaaccgtacccggggttccccttacccgttacggaacccttaacgttaccgttccgggttaccggggtacccgtcccgggtctacgggtaacgggaacggtaccggtacttacggtatttaacgtttcgtttacgtccgtacttacggtacttaacggtcggacgttaagggtacgtaacgttacgtacgtttaagtccgttacgttaaccgggaaccgttaccggggaacccgtaaggttcccgttaacccggttacggttaaccgggttccgtaaccggacccgttaacccgggaacccctaacccggttacttaccggttacccgtaacccg

SEQ ID NO: 40086 - DNA, 778 bp, Homo sapiens
  misc_feature: GYAE6OF02I7CBD.35.67.G01.1.454.CMB.1.raw
  modified_base (156)..(156): a, c, t, g, unknown or other
  misc_feature (156)..(156): n is a, c, g, or t
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (310)..(310): a, c, t, g, unknown or other
  misc_feature (310)..(310): n is a, c, g, or t
  modified_base (402)..(402): a, c, t, g, unknown or other
  misc_feature (402)..(402): n is a, c, g, or t
tcagtacagatcgtcacgaccggtgctcgatttagagtatacatattgggtttgggctcaactttcttgtccaccttggtgttgctgagcttgggttttcctcgttgcttcttttaaggaggttgtccagttgtcaggtgcagctggtggagtcgnggggagcgtggtccagcctgggacggtccctgagacctctcctgtgaagcgtntaggattcatcttacaaataacttagnggtactagtnaccgtacgtcggggtccaccgtaggtcctcgacggacgaaaggtcgtgggacggttggttgganggtttcggtaggtgtagtgtaacgtaggaaattaagacgtataacgtgtacgtcgaacgactacggtacggacgggctattaccaacttacncgtacaagacgtactaacttaacgactaaacttcgtttcgtaccgattacgaaaagtctaacgacgtaccgtacggagtaaaccgtccgggtaaacgaccggtacgtaaacgttaacggtaaactttacgtaccggttaccggttaggaacggtaaacgggtaacgtaccgggtaaaacgggtttccgggggaacccttaaccccgggaccccggtttaggaacccgggttaccgtacggggtacgtccggggttaaccgacgggttacccggtttccccggtaggtcccgggtttacccgtacgtacccgttcaccccggtacggttaccccgaccggtaacccgggttaccgtacccggttacccgtcccccgg

SEQ ID NO: 40087 - DNA, 587 bp, Homo sapiens
  misc_feature: GYAE6OF02F8KKJ.35.67.G01.1.454.CMB.1.raw
  modified_base (172)..(172): a, c, t, g, unknown or other
  misc_feature (172)..(172): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (194)..(196): a, c, t, g, unknown or other
  misc_feature (194)..(196): n is a, c, g, or t
  modified_base (199)..(199): a, c, t, g, unknown or other
  misc_feature (199)..(199): n is a, c, g, or t
  modified_base (201)..(202): a, c, t, g, unknown or other
  misc_feature (201)..(202): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (212)..(213): a, c, t, g, unknown or other
  misc_feature (212)..(213): n is a, c, g, or t
  modified_base (217)..(218): a, c, t, g, unknown or other
  misc_feature (217)..(218): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttggctgagcggtcgttcgctaggctctatagncatgcngncngctgggngnggnnngcngnngngcngngcnncgtnncngcntgtctcntnatntacngctancganacgtcgcgcgacgtcacgagacgaggtgtaggcgtggtacgtgtagtagttatagtatgtagtagtaagtaacgtaaattaacgactacgtagtacgcgtacgtacggtaacggaacggaccgtacgtaaccgtaccgtacgtaacctactacgtaaccgtaacgtaacgtaaccgaaactaaccgtacgtacgtacgtacgtacgtacgtaacgtaacgtaacgtacgtagtacgtacacggaacgtaaccgtacgtactacgtacggtacgttacgttaagtaacgtacgtaccgtaccggtaaccgtaaaccggtaacgtaacggtagtagtaacg

SEQ ID NO: 40088 - DNA, 701 bp, Homo sapiens
  misc_feature: GYAE6OF02I8URT.35.67.G01.1.454.CMB.1.raw
  modified_base (291)..(291): a, c, t, g, unknown or other
  misc_feature (291)..(291): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaaggaggtgtccagtgtcaggtgcagctggtggagtcgtgggggaggcggtggtccagccgtgggacgtccctgagactctcctgtagagcgtcgtggtattcattcttacaataacttnggcatgctacgtcggggtcccgccacgggcctaccgagggacgaagggacgtgggaggttgggttcggacgtaggtttgtaggttggtacgtaggagtagggtaaaataagtacgtattaacgtagtgaccgtaacgaccgtacgggtagggaaccgggaccgttacgtacccgacccgtactaccgtaccgaacgaacggtaaccaaaccgtttaccgaaacgtaaccttacgtttccgttacctacgtactaaagtaacgaacgacgtaccgtaggaaccgaacgggtaccggacggaaccgtaccgggtacgtaaacgttagtttaccgttacggtaggtaccgacggtaagaaccggtaggaggtaccgggtaccggtacccccggtaccccggtaggtaaccggg

SEQ ID NO: 40089 - DNA, 691 bp, Homo sapiens
  misc_feature: GYAE6OF02ICJ7J.35.67.G01.1.454.CMB.1.raw
  modified_base (327)..(327): a, c, t, g, unknown or other
  misc_feature (327)..(327): n is a, c, g, or t
  modified_base (681)..(681): a, c, t, g, unknown or other
  misc_feature (681)..(681): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagcgtgggtggagttcggtggggggacggcggtcggtccaggccgtggggaggtcccctggacgctcctctaggtgaacgcgttctggtacttcattcttacaaattaacatggcatgcacgtcgggtccnccgacggcctccgaggacgaaggggtctgggtagtggttcggcgttaggttggtaggttaggtatggtaagtagggtaaataagtaagtaattacgtagtcgacaacggacgtaccggtaaggacgggtctacttaccgactcgtacctacgaacgaacgaactaacttaaccaaagtaaccttacgtttcgttaccagtaacaaacgttacgaactacgcgtaagaacggtaaccgccggaaagggacctaacgggactaacgttaacgtttaacgtttcggacggtacggaacggtaaacgacgggtcggtaacgggtaccggggaaccccgtacccccggttaacccgggngttaacccgg

SEQ ID NO: 40090 - DNA, 766 bp, Homo sapiens
  misc_feature: GYAE6OF02JFGCK.35.67.G01.1.454.CMB.1.raw
  modified_base (61)..(61): a, c, t, g, unknown or other
  misc_feature (61)..(61): n is a, c, g, or t
  modified_base (380)..(380): a, c, t, g, unknown or other
  misc_feature (380)..(380): n is a, c, g, or t
tcagtacagatcgtcacgaccggtgctcgatttagagtatacatattgggttggggggganaggagcccagcactagaagtcggcggtgtttccagtccggtgatcagcactgaacacagaggactcaccatggagtttgggcctagagtcgttggggttttcctcgtttagcttacgtttttaaaggagggttctacccgtaggtcggttaccgaagggttcgctaggccgttagggtcggaggtcggtggggggacgtcggttcggtacccgaggtcccgtgggggtaccgttccctaggacgtccttccttcgtaggtgaacggtcgttcgttggtacttactacgtcctttaacaaagttaacgtgtacccggtanacgtacgtaccgtaaccggtcggggtaccccacgtaccggtcctacggaggacgtacgggtcgtagggtgtcgggttgacgttgttgggtgtagtacgtgaggtaggtaatagacgtaatagtcgtagacagtaacccggtggaacgggtcgtacccgtacttaccgaacttcccgtacctagtagtaactaccgtaattaacccggaaagtaccctttacgtcggtaacttacggaattaacgtacgaacgtgtactaggaccggtaaggacccgtacggtaggtacccgtacggtataacgttcggttaacggtgtaaccggttacgaacggtaaccgtacggggtagaaccgttaccccggacccggtttacgggccttaggg

SEQ ID NO: 40091 - DNA, 743 bp, Homo sapiens
  misc_feature: GYAE6OF02GIM43.35.67.G01.1.454.CMB.1.raw
  modified_base (140)..(140): a, c, t, g, unknown or other
  misc_feature (140)..(140): n is a, c, g, or t
  modified_base (449)..(449): a, c, t, g, unknown or other
  misc_feature (449)..(449): n is a, c, g, or t
tcagtacagatcgtcacgaccggtgctcgatttagagtatacatattgggtttgggggggggtcacaagaggcagcgctctcgggacgtctccaccatggcctgggctctgctgctcctcactctcctcactcgaggacncaggtgacgcctccgaggggtagggtcgttggggacctcgtggactgactccgttggtcctcccgctcccgtcgacggtcctaccggacccggggcccaggccacgtgacctcgaggtcggctagttcggtttacgtttccctcccgtttccgttttacccggacgggggttcccgtgggggaccctaacgtacggttcgtccgtcccgtggaccttcgacgtcctcggtcccgttaccgtgttccggtggtcccgtcggtaggaccgtgtccacgtccaactcgtccgtcctgacctaggtacgaacngacaggtcgtagtgggttacggtctcgtacgtttcgtacctcgttagtactaccgaacgtcgtacccgaccgtacgaacccaaacccggtacccctaatttaacgttaaacttaacgaacgtacttaacgaaccgtccgtaaccgttcgtaagttaccttactaacgttccgtccgttacgtcggtacgtacctacgttagttaccgtcgggtaaccttaccggtcccgtaccctaccgtaactaccgttaccgttcgttaccgggcccggtacgtacccgggtggtaaccggg

SEQ ID NO: 40092 - DNA, 265 bp, Homo sapiens
  misc_feature: GYAE6OF02JE353.35.67.G01.1.454.CMB.1.raw
  modified_base (246)..(246): a, c, t, g, unknown or other
  misc_feature (246)..(246): n is a, c, g, or t
  modified_base (252)..(265): a, c, t, g, unknown or other
  misc_feature (252)..(265): n is a, c, g, or t
tcagtacagatcgtcacgaccggtgctcgatttagagtatacatattgggtttggggggtttggtggtctccactcccgccttgacgaggctgattattattgttgctcatatgcaggtagtagcactaatgtcttcggaactgggaccaaggtcaccgtcctaggtcagcccaaggccaacccccactgtccactctcgttcccaccctcctcgacactctgtactggacgcggctggcaaggcncatagnnnnnnnnnnnnnn

SEQ ID NO: 40093 - DNA, 720 bp, Homo sapiens
  misc_feature: GYAE6OF02G2CN3.35.67.G01.1.454.CMB.1.raw
  modified_base (206)..(206): a, c, t, g, unknown or other
  misc_feature (206)..(206): n is a, c, g, or t
  modified_base (286)..(286): a, c, t, g, unknown or other
  misc_feature (286)..(286): n is a, c, g, or t
  modified_base (374)..(374): a, c, t, g, unknown or other
  misc_feature (374)..(374): n is a, c, g, or t
  modified_base (425)..(425): a, c, t, g, unknown or other
  misc_feature (425)..(425): n is a, c, g, or t
tcagtacagatcgtcacgaccggtgctcgatttagagtatacatattgggttttcctcgttgctcttttaagaggtgtccagtgtcaggtgcagctggtggagtcgtggggggaggcgtggtccaggccgtggggagtccctggagactctcctgtagagcgtctggattcattcttcaaatactatggcatgcacgtgggtcccncaggtcctcgaggccgaagggactgggaggttcggtaggctaggttgtggtgtagtgagtggaaagttacgtagacttanaacgtcgacagacctcggagggaacggctacgtcaacgtctacgacgagtagaactaacttcaaaacgactttactttccgtaccgtnaaccgtaagtaccgaacgtgaccgtaggacgacggtacgggaacgaaccgngggtaaactattacgttacgtagtcgagtacggaagaacggtggtaacgtcgggaaccgtaccgttacccgggttagaccgggtacgaccggttacggggaccgggacggtaaccgggcccgtaccgggtacggtccccggtacgttcccgttacgtccgtaccggtaccctaccgaacccggacggtcccacgggttcccctcccggttacccgtaacggtcccctaacccgtccttaacccggaaccgtctacccggttccgaccgggttcggaacgtccgacgggtccccgg

SEQ ID NO: 40094 - DNA, 618 bp, Homo sapiens
  misc_feature: GYAE6OF02JN1FH.35.67.G01.1.454.CMB.1.raw
  modified_base (170)..(170): a, c, t, g, unknown or other
  misc_feature (170)..(170): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (412)..(412): a, c, t, g, unknown or other
  misc_feature (412)..(412): n is a, c, g, or t
  modified_base (463)..(463): a, c, t, g, unknown or other
  misc_feature (463)..(463): n is a, c, g, or t
  modified_base (606)..(606): a, c, t, g, unknown or other
  misc_feature (606)..(606): n is a, c, g, or t
tcagtacagatcgtcacgaccggtgctcgatttagagtatacatattgggtttgggggggggtcacaagaggcagcgctctcgggacgtctccaccatggcctgggctctgctgctcctcactctcctcactcaggacacgagggtcctgggcacagtctgccctgactnacgcctgcctcgtgtctgggtctcctggacagtcatccacctatcctccgtgccacgtacggaaccgngaccgngtcggtagttgggttaggggttatcggttaccctttgtccttccgtagttactacaacgacgcccaaccgtaggaaccaacccgtacccctaacgttactttaacttaagacgtaacacgtacgcctaccgtgagtacttatactcgtctcgctcggctacgtagtcngactacgtccgcctccgatactactctcgtcgcgtcgcgcggagacgacgngtacgtatttacgttagttcgtcgtactactagttacgtgtacgtaggtacgtacgtactacgttagtcgttaacgtacgtacgtacgtaactccggtcgtaccgtcgtaacgtacctaccggacgacccgacctaacccgtntaccgtctaccg

SEQ ID NO: 40095 - DNA, 720 bp, Homo sapiens
  misc_feature: GYAE6OF02G94H3.35.67.G01.1.454.CMB.1.raw
  modified_base (173)..(173): a, c, t, g, unknown or other
  misc_feature (173)..(173): n is a, c, g, or t
  modified_base (200)..(200): a, c, t, g, unknown or other
  misc_feature (200)..(200): n is a, c, g, or t
  modified_base (365)..(365): a, c, t, g, unknown or other
  misc_feature (365)..(365): n is a, c, g, or t
tcagtacagatcgtcacgaccggtgctcgatttagagtatacatattgggttttcctcgttgctcttttaagaggtgtccagtgtcaggtgcagctggtgcagtctggggggcggcgtggtccagcctgggaggtccctgagactctcctgtgaagcctctggattctccttnaagaactatggcatgcacgtgggtccnccaggcctccgaggcaaggggctggagtgggtgcagtgatatcatttgatggaagtaataaacattacgcaagactccatggaacgggccgtattccaccatcctaccaggagactaattaccgaaagaaccactctcgtacctctgaccgacaagtacgaaacncgtacgtcgggaccttggacggaccgacggactgttactaagttactggtcgacggaagacgtaagtaaacgtaaattaacgttgtagtacgttaaggtacgtactaggttaggtaccgtttacggttttaccgttttttacgacgtttacgttacgtaaccgttaaccgggttcgggggtacccgtaaacgggtaaccccggttagggttacctacggttacccgttcccgtttaacccgtaccgtaacccggttacccctaacccggtaacccggtaacccggggtccccttaacccgggtttccggtttaccccccgttcccccggttacccggtaccccgttaccccccgg

SEQ ID NO: 40096 - DNA, 667 bp, Homo sapiens
  misc_feature: GYAE6OF02JBVKS.35.67.G01.1.454.CMB.1.raw
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (475)..(475): a, c, t, g, unknown or other
  misc_feature (475)..(475): n is a, c, g, or t
  modified_base (595)..(595): a, c, t, g, unknown or other
  misc_feature (595)..(595): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcgtggtttcgcgttggctcgtttaagaggtncagtgtcgaggtgcngctggtggacgtgtgggggaggcgtggtcnggtccgtggggacgtcccgtggagctctacctggtcgagccgtntcgggatttccattcctacaattaaactntcggtcagtgctaggtcgggtcccgcggngcctcgacggnggaacgggctgggtcggttggtcggntaggtttgnggtttaaggtgagtaaggttggaaatttaaagtaggtaactttaaacgttcgtagtacggaagtaccgggaaccgttaggaaccgggtccgtacttacgaaccnccttaccgtacgacgtaaccgtaacaaccttaacgaacgtacttacccgttttacgttacttcagaaacgttacgtacacgacgtgaacggacgacgggcgaaaccggaggacgtagttntaagtaccttggacgtcgaaggtaccgacgggtcgtagggtaccccgtaccgtacccccggtagtaaccggg

SEQ ID NO: 40097 - DNA, 841 bp, Homo sapiens
  misc_feature: GYAE6OF02ISUSK.35.67.G01.1.454.CMB.1.raw
  modified_base (750)..(750): a, c, t, g, unknown or other
  misc_feature (750)..(750): n is a, c, g, or t
  modified_base (833)..(833): a, c, t, g, unknown or other
  misc_feature (833)..(833): n is a, c, g, or t
tcagtacagatcgtcacgaccggtgctcgatttagagtatacatattggggtttgggggggagaggagcccagcactagaagtcggcggtgtttccatccggtgatcagcactgaacacagaggactcacatgggagtttgggctgagtcttgggttttccctgttgcttcgttttaaggaggttgtccaggttgtacgagggtgcaggcgtgggtcggtaggtcggtaggggggaggcggttcgggtaccaggtccggtggggtacggtccctaggaacgtcttctccggtaggtaggaacgtcgttcgtaggtacttactacttacgttactaaaataacgttaggtcggactaagtcggaccgtacggttcggggtacccgtccgtaacgggtcccacccggtaaaggtacccggaaagggtaccggtgggtagggttcgggttacggaacggttaggtttcgggttaggttcggtaacgttaggacgtaaggggtaaagtaagtacggaactttaggtacgttacgaaccggtacgtaaaccgtacggttaacggggaaaccgggtcccttaacttaccgaaaccgtctaacccggttacgaacggtaaacgtaaaccttaaacggtaaccctaaaagtacttaccggtttacgtaccccgtaaagaaccgttaaacgttacggaaaccgtacgtaccgtaaaccggtaacggaccgaaccgggaaaggtaacccgtacgggtaanaacgtttaacgttaaacggttcgtagggcgaaccgtaaagggccacggggttaacgacgggttcccgaacccccggttacggngttaccgg

SEQ ID NO: 40098 - DNA, 798 bp, Homo sapiens
  misc_feature: GYAE6OF02GDYP3.35.67.G01.1.454.CMB.1.raw
  modified_base (298)..(298): a, c, t, g, unknown or other
  misc_feature (298)..(298): n is a, c, g, or t
tcagtacagatcgtcacgaccggtgctcgatttagagtatacatattgggttttcctcgttgctcttttaagaggtgtccagtgtcaggtgcagctggtggagtctggggggaggcgtggtccagcctggggaggtccctgagactctcctgtgaagcgtctggattcatcttcaataactatggcatgcacgttcgggtcccgccgaggcctccgagggacgaaggggctgggagttgggttggctaggttgtggtggtatggagtggaaagtaatagtatactagtgacagaaccncggtaggaacgggaccgtattccaactacttccctaccgaagaacgaacctaaacttaccgaaaacgtaccttacgttttacgttcctagaactaaagtacgaacgacgtccgtagaggaacgccggaagggaacgacgggtactaattaacttagttaccgtggtacggaacggtaaggaacggtcgtaagggttcgggggaaccccgtcccccggtaaccgggtagtacggggaacctcccggtaacgggtccggggggaacccacggggtacccctaccccgggttcgggttaccccgggtcctttccgtttaccgtacccgaccgttaccccgtacccggtaaacccggtaacccgggccccttacccgggttcccgggtttaccccccttacccccggggtaccgtaccccctaaccccggtccctaacccggacggtacccgtcccgtaccggttacccggggccggggtacccaccgggacccggtccccggg

SEQ ID NO: 40099 - DNA, 676 bp, Homo sapiens
  misc_feature: GYAE6OF02H77KR.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggttttccctcgttgcttcttttaagaggtgtccagtgtcaggtgcagctggtggagtcggtgggggagcgtggtccaggccgtgggacggtcctgagactctctgtagaggcgtctggattcgatcttacaatactagtggacctagtcgcacgttcggggtcccgccgagggtcctaccgaggtaccgaagggctgggaggttgggttggacgtggtttggtgttggtatgagtcggaaagttagtagaacttactagtcgacgtaagaccgtacggtaaggacgggtaccgtacttccaaccgtactacgtaccgaaggaacgtaaccgtaaacttaaccggaaactaaccgttaccttttacggttaccctaggtaaaccaaacgttacgaaaccgtacggtaccttagacgacggaccgacggaccgaacggataacgtattaacgttactggttacggaacggtaagaacggtcggtacggtaaccgggtacgtaccccggtaccccggtagtacccgg

SEQ ID NO: 40100 - DNA, 574 bp, Homo sapiens
  misc_feature: GYAE6OF02F838W.35.67.G01.1.454.CMB.1.raw
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (254)..(255): a, c, t, g, unknown or other
  misc_feature (254)..(255): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagtacagatcgtcacgaccggtgctcgatttagagtatacatattgggtttgggggtttggtggtctccactccgccttgacgaggctgattattattgttgctcatatgcaggtagtagcactaatgtcttcggaactgggacctaaggtcaccgtctaggtcacgtcccaaggccaaccccatgcactctgttcccgccctcctcacgatctgtactgagcggctggacaaggcacgagtacgagncngnngngcactnagtcagtatcatgncgntccgngtgctactcgtcgtacgcgtcgagtcgcgcgtagtctactcacgtacgtagcgtctagtcgactcgtagtacgtacgtacgacgacgtacgtacgtacgtacgtacgtacgtacgtacgtactagtacgtacgtagacgtacgtacgtacgtacgacgtactacgtactacgtacgacgtaacgtacgtacgacgtacgacgtacgacgtacgacgtacgtacgtacgtacgtacgtacgtacgtacgtacgtacgtacgtcggtcgtacggtacggtacgtagtacgg

SEQ ID NO: 40101 - DNA, 632 bp, Homo sapiens
  misc_feature: GYAE6OF02GNT0H.35.67.G01.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (511)..(511): a, c, t, g, unknown or other
  misc_feature (511)..(511): n is a, c, g, or t
tcagtacagatcgtcacgaccggtgctcgatttagagtatacatattggggtttgggtctgggagaggagcccagcactagaagtcggcggtgtttccatccggtgatcagcactgaacacagaggactcaccatgggagtttgggctgagctgggttttcctcgttgctcttttaagaggtgtccagtgtcaggtncagctggtggagtcgtgggggagcgtggtccagccgtgggacggtccctgagactctcctgtgaagcgttctggattcatcttacaataactntggacatgcacgtggtacccgcaggcctaccgaggcgtaagggctgggagtggtggctagttgtggtgtatgaagtggaaatagtagattactagtgactaaggaccaccggtaggaacgggtcctagtaccaccgtatccgactaaggacgaaccgttaacttaccgaacgtaaccgttacttttacggttacctaggtaacctaaacgttacgaaaccncggtaacctagggtaacgaaccggaccgtaaggaccgtacggagtaacgttaacttacgttaactaggtacgacggtaagaacggtggtaacggtacgggtccgaaccccgttaacccggg

SEQ ID NO: 40102 - DNA, 652 bp, Homo sapiens
  misc_feature: GYAE6OF02IAI70.35.67.G01.1.454.CMB.1.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
tcagtacagatcgtcacgaccggtgctcgatttagagtatacatattgggtttgggagaggagcccagcactagaagtcggcggtgtttccatccggtgatcagcactgaacacagaggactcaccatggagtttgggctgagcttgggttttcctcgttgcttacttttaaggaggttgtccaggttgtcgaggtgcagcgtggtggagtcggtgggggagcgtggtccagccgtgggacgtccgngagactctctgtgacgngtctggatcatctanaataactntgactatcgactcggtcggtccgaccgacggtcctaccggaggacgaaagggtcgtagggtaggtgggttcggngttaggttggtggtaggttagtggtaagtaggtaagttaagtagtaattcgtanacgacacgtacgtaaccggtacggaacgggtacctacgtaccgactactccgtacaacgaataactaacgtaaccaacgtaatttccttacgttacgtacgtaacaagtacgaacgtcgacgtaggaccgtacgaccggaacggacgaccggtataacgtattcgtacgtacggtacgacgttaagaccggtaacggacggtaccgggtaacccgtccccggtaaccggtgtacggg

SEQ ID NO: 40103 - DNA, 733 bp, Homo sapiens
  misc_feature: GYAE6OF02H2EHD.35.67.G01.1.454.CMB.1.raw
  modified_base (161)..(161): a, c, t, g, unknown or other
  misc_feature (161)..(161): n is a, c, g, or t
  modified_base (333)..(333): a, c, t, g, unknown or other
  misc_feature (333)..(333): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcttgggtttttccncgttgtccttactttttaagaggtgtccagttgtcaggtgcagctgggtggagttcgtgggggagcgtcggtccagccgttggggacggttccctggagtaccttccgtcctgtagaagcgtcgtggacttcattcttacaaatactatggcattgcctacgtcggggtccncgacggcctaccgaggacgaagggacttgggagtggttcgctaggttgngttaggntggataggaagttaatagattacgtatgacgtagaacgtaccggtaggacggccgtacttaccgacctacgttaccgtaccgaaaggtaaccgtaacgtaacttaaccgaaacgtaaccgttaacgttttaccgtttacccgtaacggtaaacctaaacgttaccggaaaacccgacgtacccgttacggaacgtaaccggacccgggtaaacggaaccggtaacggtaccgtaacggttaacttaacggttaccgttacggtacgtaacggtaaacggaaccggtaccgggtaacggtaccggggtaaccccgtacccccggtaaccccggtagtaacccggg

SEQ ID NO: 40104 - DNA, 801 bp, Homo sapiens
  misc_feature: GYAE6OF02I2FZ0.35.67.G01.1.454.CMB.1.raw
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactccaaccatgggagtttggctgagcttgggttttccncgttgcttacttttaaggaggtgtccagtgtcaggtncaggctgggtagagtcgtgggggagtcgtggccaggccgttagggacggtccctaggacgtcctcgtcctggtagaacgtcgttgtggacttcgaattccttacaagttaactagtggtacatcggactacggtccgggacccgaccgtacggtcccgtaccggaacgggaccggtaaacggggtacgttaggggtacgggttggggttaccggtacgttagggtttacgggtacgttagggtttaggtacggaaagggtttaggggtaaaagttaaacggttaacgtacgtttaaattaggtacgaaccgttaaaccggccggtaaccgggtagggtaaacccgggtcccgtaacgtaccgtaaccctgttaccgtaaccgtacggaacctaacgttaacgtaaccgtaaacgttacttaccgtttcgtaccttaagactaaacggttaccaaaccgtcggtaccgaaggacgtaaccggaaccggaacggtaaccacgggttaactagttaaccggttaaaccttggtaccggttaacggacggtaaacggaccggtacggtaacggtacggggtaccctacccccgggtaaaccggg

SEQ ID NO: 40105 - DNA, 663 bp, Homo sapiens
  misc_feature: GYAE6OF02GP365.35.67.G01.1.454.CMB.1.raw
  modified_base (153)..(153): a, c, t, g, unknown or other
  misc_feature (153)..(153): n is a, c, g, or t
  modified_base (551)..(551): a, c, t, g, unknown or other
  misc_feature (551)..(551): n is a, c, g, or t
  modified_base (597)..(597): a, c, t, g, unknown or other
  misc_feature (597)..(597): n is a, c, g, or t
tcagtacagatcgtcacgaccggtgctcgatttagagtatacatattgggtttgggagaggagcccagcactagaagtcggtggtgtttccatccggtgatcagcactgaacacagaggactcaccatggagtttgggctgagcgtggtttcncgttagctctttaagaggtgtcagtgtcaggtgcagctgggtggacggtccggggggagtcgttagttcgagccggtcggggggtccctggagcctctccgtgtcgcacgccgtcgtaggacttccacttacgagtagtactacgtggactcgcgtacgttcgggtcctacgtaacggttaccggaggggagggtcgttacggggtggtttcggttacacggttagtacgtaggttgaggttaggacgtacgactaactaaggtcctacgggacccgtacggtacggttaggggaaccgggcccttaaccggtacccctaaccccgtcgaaacgggacgaacccgaacccggaacgaaaccgtaaccactaactaactatacgagaactaatcgaacnggtacagtaagcggacggagaccgacgtcgtacgtctaatcgtagngacgaggtgtcgaactacgatagtgtttacggttagacgtcgttacgggacggttacgaggtaacg

SEQ ID NO: 40106 - DNA, 850 bp, Homo sapiens
  misc_feature: GYAE6OF02IGVGH.35.67.G01.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
tcagtacagatcgtcacgaccggtgctcgatttagagtatacatattgggtttggggggggtcacaagaggcagcgctctcgggacgtctccaccatggcctgggctctgctgctcctcactctcctcactcaggacacagggtcctgggcacagtctgccctgacctcagcctgcctccgtgtctgggttctcctggacngtcatcacctatcctcctgctacgtacggaaccngcagcgtattggggttagggggttatcgtaccgttcgttccgttccgttggtactaccgaaactaccgacccgaaccccgaggtaacccaaaacccggtaccccccctaaaacgttttaccgttttaaaagttttaaaccgtaaacggtaccctaacgtaaaccggtcccggtaaccccgtacgtaacgggttacttttaccgtaactccggttacctttccttacgttcggacccttaacccgtaggttaccgaacggtaccgtaacccggttcccggtaccccttacccggtaaccgtaccgtaaccttccgttcccgggtagggtccccggttccgggacgttacggggaacggacgggtaggaccgttttagtaacgtttttagtttacggtttgttacccgtcgtaacgtaacttcggtacggacgttaggtaacgttacgacttaacgtttaagttccggttaccgggtttaccggtaaggtacccggggtaacgtttaccgggtacccgttaacccggtttacccggtaaggttacccgaaccggtaccccggtaagggtcccccgtacccccggttcccccgtttaccgggttcccttaaccccggg

SEQ ID NO: 40107 - DNA, 765 bp, Homo sapiens
  misc_feature: GYAE6OF02I0GQA.35.67.G01.1.454.CMB.1.raw
  modified_base (260)..(260): a, c, t, g, unknown or other
  misc_feature (260)..(260): n is a, c, g, or t
  modified_base (356)..(356): a, c, t, g, unknown or other
  misc_feature (356)..(356): n is a, c, g, or t
tcagtacagatcgtcacgaccggtgctcgatttagagtatacatattgggtttgggctcaactttcttgtccaccttggtgttgctgagcttgggttttcctcgttgctcttttaagaggtgtccagtgtcaggtgcagctgggtggagtcgtgggggaggcgtggtccagcctggggaggtccctgagactctcctggtgaagcgttcgtggtattcgattcttacaaattaactatggacatgcacgtcggggtaccnccgaggtctaccgaggccgaaagggctggtagtgggttggactaggtttggtaggttggttaatggaagtagggtaaaacgtaagtagtaacttanaagtgaccaagaccgtaaccggtggaacggggacctattaccaccgaactccgtacaaaggtacgaccttaaacttaccaaaacggtaaactttaccgttttcgttaacccgtagtaaacccgaaagtttaacgaaaccgtcgtacccgttaggaaaaccggcggaacgggtaaacgaccgtaacggggtaacgtaaactttaacgtttaaccgttaacgttcggtaacggacgaagggtaaccgtacggttaagggtaacgggtaacccgtacccccggtaaccgggagtaccggacggtacgtacggggtcggaccgagggtcccaccgggtacggtccgttcccgtacttacccgtcgacccggtcctaccgaacccgggtacgcccttacggtccccgttccccg

SEQ ID NO: 40108 - DNA, 709 bp, Homo sapiens
  misc_feature: GYAE6OF02HTA3O.35.67.G01.1.454.CMB.1.raw
  modified_base (174)..(174): a, c, t, g, unknown or other
  misc_feature (174)..(174): n is a, c, g, or t
  modified_base (192)..(192): a, c, t, g, unknown or other
  misc_feature (192)..(192): n is a, c, g, or t
tcagtacagatcgtcacgaccggtgctcgatttagagtatacatattggggtttgggggggagaggagcccagcactagaagtcggcggtgtttccatccggtgatcagcactgaacacagaggactcaccatggagtttgggctgagctgggtttcctcgttgctctttaagnggtgtccagtgtcaggtncagctggtgagtcgtggggagcgtggtccagccgtgggacggtcctggacgactctcctggtagaacgtcgtctaggactttcgaattccgttacaaattaactgtcggacctatcggactacgttcgggtcccgacgacgggtcctaccgagggaccgaaagggtcctggggacgttgggttacggcttaggttggtaggttacggtagttaggagtagggaaaacgtttataacgaagttacctagtcgaaccgtagtacccgtaacgggtacggaacgggtcctacgttaccgaacctacggtcctaaccgagaacgaacgtaaactaccaaaacggtaacttaccgttttacgacgttacgaacctaaagtaccgaaacgtacgacgttaaggaacgtacgaaccggacgtaacgaccgggactacgtacgttaacgtacgtacggtacgaccggtaagtaaccggaccgtagggtacccggaaccggtaccccgtaccccggtaggtaacgg

SEQ ID NO: 40109 - DNA, 606 bp, Homo sapiens
  misc_feature: GYAE6OF02F6IVQ.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctggggggaggcgtggtccagcctgggaggtccctgagactctcctgtgaagcgtctggattcatcttcaataactatggcatgcactgggtccgccaggctccaggcaagggactggagtggttggcagttgtgtggtatgagtggaagtaatagatactatgcagacacgtagaagggccatcaccatctccagagacaattaccaagaacctactttgtcctagacaaaatcgaacagcctagacgacggccgaaggaccacgggctaattatacttactgtgcgaagaagcgagtgggacacccgtaccccggatcggacgacgtacggcgggaccgacgggcctacccggtggtccgcccgttactccgtccgaccgtcctacccgaccggaacggccctacgttcccgtcccgttacccccgcggtcccctacccgttccctacccgaacgtccgccctaccggtccggtacggggacctaccggacggtccccgg

SEQ ID NO: 40110 - DNA, 823 bp, Homo sapiens
  misc_feature: GYAE6OF02HAZWE.35.67.G01.1.454.CMB.1.raw
  modified_base (251)..(251): a, c, t, g, unknown or other
  misc_feature (251)..(251): n is a, c, g, or t
tcagtacagatcgtcacgaccggtgctcgatttagagtatacatattgggttttcctcgttgctcttttaagaggtgtccagtgtcaggtgcagctggtggagtctgggggaggcgtggtccagcctggggggtccctgagactctcctgtgcagcctctggattcagttttagcacctatggcatgagctggctccgccggctccgagggagggctggagtggtctacaactattgagtggtagtgctanataacactagtcggtacgacgagtacctccggtaggaacgggtccggttacaaccgtacttccgtacccaaggacgtaacctaaacgtttccgaaggaaccacgtcttaataacgttccgtagaactaaaagtacggaaaccacggtcctaggaacgaccggaccggtaacggaaccggtaaccggttactttaagttaaacgtttacgtaggttcggtaaacgttaaaacgggtttccggtaaggttttcgggtacggtacggttacggggttaacgggtaacggggttcgggtaaacgttaaggtacgggtaaaccgttacgggtaccgggggtaccggtaacgggggtacccgtcccggttacgggtaccccgtacccggtcccttcccgtaccgtacccgtccccgtaaccgtacccggaaaccggccccgttaacggtccccggttcccctttaccccggcccggtacccttacccccggttccttaacccgaaccggtaccggtaccccgtacccggttaccggggtaccgggggacccctaacgggaccccggttcccccggggg

SEQ ID NO: 40111 - DNA, 790 bp, Homo sapiens
  misc_feature: GYAE6OF02JNTWJ.35.67.G01.1.454.CMB.1.raw
  modified_base (164)..(164): a, c, t, g, unknown or other
  misc_feature (164)..(164): n is a, c, g, or t
  modified_base (233)..(233): a, c, t, g, unknown or other
  misc_feature (233)..(233): n is a, c, g, or t
  modified_base (308)..(308): a, c, t, g, unknown or other
  misc_feature (308)..(308): n is a, c, g, or t
  modified_base (435)..(435): a, c, t, g, unknown or other
  misc_feature (435)..(435): n is a, c, g, or t
tcagtacagatcgtcacgaccggtgctcgatttagagtatacatattgggtttggggggagaggagcccagcactagaagtcggcggtgtttccatccggtgatcagcactgaacacagagactcaccatggagtttgggctgagcgttgggttttcctcgttncttacgtttttaaggaggttcgtccgaagttcgtcgaggtgacagcgttgggtaggtgtcggtgggggngcggttggtaccagccgttgggaaccggtcccctaggcgtactccgtcctagacggacgtctagtcggtacttcngtcttacaagttaacttgcgactagtcgcgttaacggtccgggttcccgaaccgtgggtccccctaaggtaggtaccgggaaacggtacgtgggggttaacgtcgggtttacggcgtttggtttcgnggggttacgttagtacggtaagttaaggtaacgttagttaacgtactaacttacggtcggtataaacccggtcgtacccgggttaggtaaaccggtaccggtataaccccgtaacgtcttaccggaaccgtaagaccggttaactaaacccgttcgaaaacgttacgtttaccgtttacgttacccgtacgttaactaaagggtaccccgttaacgaaccgttaacggtaccgttaacgggaaccgtcccgggaaaacgtcggaacgtaaccgttagtacctagtacggttacgacggaacgtaaccggtaagccgtaagggtaccggacgttaccccgggaccggagtaaccgg

SEQ ID NO: 40112 - DNA, 689 bp, Homo sapiens
  misc_feature: GYAE6OF02GXENH.35.67.G01.1.454.CMB.1.raw
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
  modified_base (636)..(636): a, c, t, g, unknown or other
  misc_feature (636)..(636): n is a, c, g, or t
tcagtacagatcgtcacgaccggtgctcgatttagagtatacatattgggtttgggtctgggagaggagcccagcactagaagtcggcggtgtttccatccggtgatcagcactgaacacagaggactcaccatggagtttgggctgagctgggttttcctcgttgccttcgttttaagaggtgtccagtgtcgaggtgcagcgtggtggagtcggtgggggaggcgtggtccagccgtgggacgtccctgacgtactctcctggngagtcgtcgtggtattcatcttacaatactatcggnatgcncgtcgggtccnccgaggcctccgaggacgaagggtacgtgggtaggttgggtcggcgttaggtttggttggtaggttacgtaggtaaggttaggtaaacgttaagtaagtaacgttaccttagttcgaacgacgaaccgtacggtaggaacgggtaccgtaattaccgaacctacgttccgaaccgaaggtaaccaaacgttaaccgttaacccgtaacgtaaaccttacgttttacgttacccgtagtaaacgtaaacgttaccgaaacgtacgtcgttacggaagacggtaccgaaggaccgacggacgtaagttaacgtattacgnggtacggtacgaagaacggtcgtaagggtaccggccgtaccccgtaacccggg

SEQ ID NO: 40113 - DNA, 791 bp, Homo sapiens
  misc_feature: GYAE6OF02IX9I3.35.67.G01.1.454.CMB.1.raw
tcagtacagatcgtcacgaccggtgctcgatttagagtatacatattggggtttgggggggagaggagcccagcactagaagtcggcggtgtttccatccggtgatcagcaactgaacacgagacggactcaccatggagtttgggctgagcgttgggttttcctcggttgcttacgttttaagaggtatccagtagtcaggtcgcagcgtaggtggagttacggtgggggaggtcggttaggccgacggtccgtgggacgtcccgtagacgtacctccgtccgtagtaggagtcgtcgtaggtattcaattcttaacgtaaataactagtagactaatcgacgtacgtcgggtcccgacggtaaggccgtaccgagggtacgaacgggtacctagggtacggttgggttacggacgtaggtttcggttaggtaggttaacaaggttaaggtaacggtaaaaggtttaagtaaggtaacttaacgttaaggcggaacctaaacggaaccgtaaggaacggaacggtaactaccgtaacttacacccgtactaccgactaacgaacgtaactaacgtaaccctaacgtaaaccttacgtttaccgttaccgacgttaacaaacgttagaaccgtaacgtaccgtagtaaccggaaccgaacgggaaacgtaaccgaaaccggggtactaaacgttaaccgtttaattaacccggtagtaacggaacggtaacggtaacgggtagggtaaccgttaaccggggtaaccccgtacccccgggtaagggtaaccc

SEQ ID NO: 40114 - DNA, 768 bp, Homo sapiens
  misc_feature: GYAE6OF02H3F9R.35.67.G01.1.454.CMB.1.raw
  modified_base (279)..(279): a, c, t, g, unknown or other
  misc_feature (279)..(279): n is a, c, g, or t
tcagtacagatcgtcacgaccggtgctcgatttagagtatacatattgggtttggggggggagaggagcccagcactagaagtcggcggtgtttccatccggtgatcagcacgtgaacacagaggactcacatggtagtttgggctgagtctgggttttcctcgttgctacgtttttaagaggttgtccaggttgtcgtaggtcgcgagtcgtgggtcggtagtcggtggggaggcggtcggtctggtccgtgggacggtcctggacgtacctctccgngtcgtaccgaggtcgtcgtaggtacttaccgttaccgttcgtaacggttacgttaggtcggtacttagtcggtaccgtaacggtccgggtacccgacggtaacggtccgtaccggacgggtacgaaccgggggtgtggggtagggttgggtacggaccggttaagttacgtacggtacgtagttgggtaacgtaggtaacgtacgtaaagtaaacgtacgtaagtccgaacgtaacggtacccgtacgggtaggaccgggtccgtaacgtacctaacccgtagttaccggtaacgaacgttaccgaaactaccgttaaacgaaccgttacgaccttagttacgtactcgtaacgaactaacgttacgaacgtcgaccgttaagacggtaccgaccgtaacgtaccggtagccggttacgtaacggttagttacggacgttaggtaacccgtaggtaaccgtacgtaaggtaacggtcggttacgtaacg

SEQ ID NO: 40115 - DNA, 935 bp, Homo sapiens
  misc_feature: GYAE6OF02JAPEL.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatgggagtttgggctgacgcttgggttttcctcgttgcttacgttttaagaggtgtccagtgtcgaggtgcagtcgtgggtggtacggtcggttaggggggaggtcgttgggtcccaggtccgtggggacggtcccctggacgtacgttcctccgtaggtagaacgtcgtacgtggtactttcgtaacttcttaacaaaacttaacttagtaggcctaagttgaccgttaaccgttcgggggtaccccgaccgacggtccctaacccgaagggtaccgaaggggtacgtcgggtaggtttcgggttacgggactttaagggttttcggtaggttacggttagttaggttaacggtagggggttaaaacttaaggttaaacggttaatttaaaccgttggtaacgggaacccgttaaagggaacccggtttaaccggggacggggtaaaccggggtaacccggtttaacgttaaccccggttaaaccttaaaccgttaccgttaaccggttaaaccgaacgggtaaacctaaaaccgttaaccccgtaaaaacgtttaaacccgtttaacccgttttccgtttaacccgttagttaaaccctaaaggtttaaaccggaaaccgtaacggtaacccgttaacgggttaaccgaaccggggtaaccggtaaaccgggaacccggtaacggaacgtaacgtttaacgtttaacgttaaccggttaggttaaccggaaccgtaaacggtaacggacggtaacgggtaccggaccccggttaaaccccggtaccccgggtaagtaaccggg

SEQ ID NO: 40116 - DNA, 275 bp, Homo sapiens
  misc_feature: GYAE6OF02HISR5.35.67.G01.1.454.CMB.1.raw
  modified_base (258)..(275): a, c, t, g, unknown or other
  misc_feature (258)..(275): n is a, c, g, or t
tcagtacagatcgtcacgaccggtgctcgatttagagtatacatattggggtttgggggggtttggtggtctccactcccgccttgacgaggctgattattattgttgctcatatgcaggtagtagcactaatgtcttcggaactgggaccaaggtcaccgtcctaggtcagccaaggccaaccccactgtcactctcgttcccaccctcctcacgatctgtactggacgcgggtctggcgaacggcgtacataggcnnnnnnnnnnnnnnnnnn

SEQ ID NO: 40117 - DNA, 753 bp, Homo sapiens
  misc_feature: GYAE6OF02HCFY0.35.67.G01.1.454.CMB.1.raw
  modified_base (176)..(176): a, c, t, g, unknown or other
  misc_feature (176)..(176): n is a, c, g, or t
tcagtacagatcgtcacgaccggtgctcgatttagagtatacatattgggttttcctcgttgctcttttaagaggtgtccagtgtcaggtgcagctggtggagtcgtggggggaggcgtggtccagccgtgggaggtccctgagactctcctgtgaagcgtctggattcatcttanaaataactagtggcagtgccacgttgggcccgcacggcctccgaagggcaaggggactgggtagttcgggttggctaggttggtggttagtataggagtaagggaaaagttaagaacgtaattagttagtacggacgaacggtaacctaacccgggtagggaaaccggggccctaattaccgaacattaccgacctaagacgtaactaaaccttacgaaaccttaagttcccttttaggtacctacgaaaccgaagttaacaaaccgacgtcccgtaaggacgacggtacccgaaggacccgaggaacgtataacgttacgttacgtgtacggacaaacggtacgacggtaggtaacggacccgtacccgttaaccggacggtagacgacgtacgggtacccggacgggacggaccgtaccgggtaccggtcccggtcgttacgttcgtacgaccgtacccgtacccgaaaccgaccggacccgttaccgccggtttaccctcccggtcaacccctcccgtactaacccggagaaccgcccgtaccggtccggtcgggacctaccggacgtccccgg

SEQ ID NO: 40118 - DNA, 427 bp, Homo sapiens
  misc_feature: GYAE6OF02H0C8B.35.67.G01.1.454.CMB.1.raw
  modified_base (304)..(304): a, c, t, g, unknown or other
  misc_feature (304)..(304): n is a, c, g, or t
  modified_base (343)..(348): a, c, t, g, unknown or other
  misc_feature (343)..(348): n is a, c, g, or t
  modified_base (351)..(351): a, c, t, g, unknown or other
  misc_feature (351)..(351): n is a, c, g, or t
  modified_base (353)..(355): a, c, t, g, unknown or other
  misc_feature (353)..(355): n is a, c, g, or t
  modified_base (358)..(358): a, c, t, g, unknown or other
  misc_feature (358)..(358): n is a, c, g, or t
  modified_base (360)..(361): a, c, t, g, unknown or other
  misc_feature (360)..(361): n is a, c, g, or t
  modified_base (363)..(363): a, c, t, g, unknown or other
  misc_feature (363)..(363): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (380)..(381): a, c, t, g, unknown or other
  misc_feature (380)..(381): n is a, c, g, or t
  modified_base (385)..(427): a, c, t, g, unknown or other
  misc_feature (385)..(427): n is a, c, g, or t
tcagtacagatcgtcacgaccggtgctcgatttagagtatacatattgggtttgggaacctatgaacattctgtaggggccactgtcttctccacggtgctcccttcatgcgtgacctggcaactcggcctccctgacaatctctgggctccgggctgaggacgaggctgatttattattgttgctcatatgcgaggtagtagcaactaatgtcgttacggaactgggaaccaggtcaccgtcctaggtcacgcccaacggcccaacccatcgccactcctcgttcccccacccttcctcactntctgtacctggacggtcgggctggccgaaggcactatgnnnnnntancnnngancnntncngnagntcngntagcnntcgnnnnnnnnnnnnnnnnnnnnnnnnnnnnnnnnnnnnnnnnnnn

SEQ ID NO: 40119 - DNA, 675 bp, Homo sapiens
  misc_feature: GYAE6OF02I8USA.35.67.G01.1.454.CMB.1.raw
  modified_base (229)..(229): a, c, t, g, unknown or other
  misc_feature (229)..(229): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgcttcttttaaggaggtgtccagtgtcaggtgcagctggtggagtcggtgggggaggcgtggtccnggccgtggggacggtccctgagactctcctgtagagtcgtctggattcatcttacaaataacttatcggacatgctacgtcggggtccccgccgagggcctaccgagggacgaacggggacgttacggggaggttcgggttggacgttaggtttggtggttaggtagtcggtaagtagggtaaagttaataagaattacgtatcggacacgtaccgtacggtaggaacgggtccgtacttacacctatccgtaccgagtaactacgtaactacgtaaacgtacttacgttaccgttaccgtataactaacgtagaaccgtcgacgtaggaagtaccggaacggaacggtaaccgacgtacgtaacgttagttacgttaacggtagtacgaacggtaacgacggtaggacggttcggaacccggtccccggtacccggtagtacggg

SEQ ID NO: 40120 - DNA, 891 bp, Homo sapiens
  misc_feature: GYAE6OF02GS13X.35.67.G01.1.454.CMB.1.raw
tcagtacagatcgtcacgaccggtgctcgatttagagtatacatattgggttttcctcgttgctcttttaagaggtgtccagtgtcaggtgcagctggtggagtctgggggaggcgtggtccagcctgggaggtccctgagactctcctgtgaagcgtctggtattcatcttcaataactatggcatgcacgtcgggtcccgccgaggcctccgaggaccgaaagggactgggtaggttggttggctaggttggtggtggtatgagtaggaagtaatagatactatgacaagaccgaccggtaggaacgggtccgtaacttaccgaacccgacttcccgtaccgaagaacgtaaccgtaaactttacccgaaaacgtaaaaccttaccgtttttacgttaccccgttaagtaaccctaaaaacgttacgaaaaccgtacgtacccgtaggaacggtaccggacccggaaacggaacccggtaacgggaacgtaaacgttaattaacgtttaacgtacggttacggacgtaaaggaacgacgggtaaggttacggggaaccccgtaccccggtaaaccccgggtagtacggaaccggtaaccgtaccgggtacggggtaacccgaccggggtaacccgtaccccgggtttccgggtccccggtccccgtttaccgttccgtaccccgacccgttcccccgtaaccccgtaaccccgggtaaacccggtaccccgttaacggttcccccgggtttcccccgttaccccccgttccgggtacccccttaaccccccgttacccggttaacccccgaaacggtaccccgtccccggtaaccccggttccggggtacccggggtacccgtaacccggcccggggttaacccccggg

SEQ ID NO: 40121 - DNA, 772 bp, Homo sapiens
  misc_feature: GYAE6OF02INWV5.35.67.G01.1.454.CMB.1.raw
  modified_base (159)..(159): a, c, t, g, unknown or other
  misc_feature (159)..(159): n is a, c, g, or t
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
  modified_base (428)..(428): a, c, t, g, unknown or other
  misc_feature (428)..(428): n is a, c, g, or t
  modified_base (488)..(488): a, c, t, g, unknown or other
  misc_feature (488)..(488): n is a, c, g, or t
tcagtacagatcgtcacgaccggtgctcgatttagagtatacatattgggtttggggggggagaggagcccagcactagaagtcggcggtgtttccatccggtgatcagcactgaacacagaggactcaccatgggagtttgggctgagcgtggtttcncgttagctactttaagnggtctccagtgtcaggtncagcgtgggtggagttcggtgggggaggccgtggtccgagccgtgggacgtccctgacgtacctcctccgtggtagacgtcgtctaggactttacgactccgttaacaaattaacgttagtcgggtactagttaccgccggttaacggtccggggtaccccgtccgtaaggtccgtaccggaggacccgtaaggggacgtgggtacggtttggtacggtcgttaggtttacggnggttacggttagtacgttaggtacgggtaaaatagtaacgtaaagttactacgtacgtanaaccggtaccgtaaccgggtacgggtaaccgggtaccgtaaacgtttacccaaagttaaccttccgtaaaccgaacggtaacctaaacgtaacgttaaccgtaaagtaaccctttacgtttccgtaacgttacggtaacaaacgttacgaaactcggtacaaggtaacgtaccggtccgaaggtaaccgtcggtagtaacttaggtacgttggtacggaacgtacggaacggtaacgtacggagggtaccggaaccctttccccgggaacccgttgtaaccggg

SEQ ID NO: 40122 - DNA, 755 bp, Homo sapiens
  misc_feature: GYAE6OF02GX9L2.35.67.G01.1.454.CMB.1.raw
  modified_base (331)..(331): a, c, t, g, unknown or other
  misc_feature (331)..(331): n is a, c, g, or t
  modified_base (593)..(593): a, c, t, g, unknown or other
  misc_feature (593)..(593): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagcgtggtggacgtcgtgggggagtcgtggtccagccgtggggacgtcctgacgactctcctgtagaagtcgttcgtggactttcattcttacaaattaactagtcggactagttcggccttacggtcggggtcccnccgtaacggtcctaccggagggtaccgaaggggaccttgggaggtttggttacgggacgtagggttttggtcggttaggttagtaggtagttagggtaaaagtttagtaacggtatttaacgtagtacggtacgagtaacccgtaccgggttaggaacgggtcccttaacgttacccgaaccgtacttacccgtaccgaaggtaacgtaaaccgttaaccgttaaccgaaacgttaaccgtttacgtttccgttacccgtanaaccttaaagtaccgaaacgtcggtaccgtaggtaacggtaaccggacggtaacgaaccggaccgtacggtattaacgtttacgttacgtcgggttacgaccggtaagtaaccggtcgttaacgggaccggtacccgtaccccggttacccggagtacccgg

SEQ ID NO: 40123 - DNA, 968 bp, Homo sapiens
  misc_feature: GYAE6OF02F1XGC.35.67.G01.1.454.CMB.1.raw
tcagtacagatcgtcacgaccggtgctcgatttagagtatacatattgggtttgaggggggtcacaagaggcagcgctctcgggacgtctccaccatggcctgggctctgctgctcctcactctcctcactcgaggacacgaggtgacgcctccgaggggttacggggtcttcgggacctctaggactgactccgttcggtcctcccggtctcctcgagtccgtaccggacccggggcccagacctacgtacgaccgttacgaggtcggtacctaagtttggtttccgttttcccttccccgttttccgtttaccggaacggggtttcccgtacggggtaccctaacgttacggtttccgttccggtcccccgtaggttacctaccgtacggccccgtttaccggccccggtttccgggttcggtttccgggttaccgggttccccttccggtaacggggtaccttacgggtaccgttacctaaccctaacccttaccgttccctacccggtcgtaccgtaacccggtaaccgtaaccgaccggtacgaacggtcggtttacgggttacgggggttttaagggggttaccttaccggttaccggtttaccgttcccggttaccgtacggtttactaacccgaacggtacccgtaacccaaccgggtaaccgaacccgaaaacccccgttaaccccttaaacggttttaacgtttaaaacgttaaccgtaaacggttaacctaaacgtaccggtaacccgttaccgttacggtaacgggtttacctttaaacgttaccggttctttacccgttacgttccggttaacggtttacccgtaaccgtttacggtaccccggttaacgtcccggttaaaccgttcccccggttaaccccgtttaccggtaccttaacccggttaccgttacccggtttcccgggaaccgggttcccggtaccgggttaccggg

SEQ ID NO: 40124 - DNA, 676 bp, Homo sapiens
  misc_feature: GYAE6OF02G0VLW.35.67.G01.1.454.CMB.1.raw
  modified_base (447)..(447): a, c, t, g, unknown or other
  misc_feature (447)..(447): n is a, c, g, or t
  modified_base (474)..(474): a, c, t, g, unknown or other
  misc_feature (474)..(474): n is a, c, g, or t
  modified_base (535)..(535): a, c, t, g, unknown or other
  misc_feature (535)..(535): n is a, c, g, or t
tcagtacagatcgtcacgaccggtgctcgatttagagtatacatattgggtttgggggggggtcacaagaggcagcgctctcgggacgtctccaccatggcctgggctctgctcctcctcacctctcactcagggcacaggctcttcgggccagtctcgccctgattcacgccctccctccgtgtccgggtcctcctggacagtcagtccacactctcctcgctacgtcggaacctgactagtgagttggttaggtaattactgtactagttcgtcttacccgtaggtaaccctaaccttacccaaccgtacgacaacccgtaccgtaacccccaaaccatacgaccttactaaccgtacgtactacctaacttccggtacccgacccgtagtacggtaccttacccgttaacgttccgtttcgtcgtcgtacctaccgtaattcgngtcctagcgccgtactccgtcaccctntcgtcgtacgtcctcggtacgcggtacgacgggacgtacgtcgtagtgttacgtaggtacncgttacgtaacttagtacgtaagtctacgtactacgccgttaacgtaccgttaacgttacgtccgggtacgcggtaacggactaacgttcggactaccggtacgacgtaccggccgccggtaaccggtctaccccggtccg

SEQ ID NO: 40125 - DNA, 714 bp, Homo sapiens
  misc_feature: GYAE6OF02HS1F0.35.67.G01.1.454.CMB.1.raw
  modified_base (234)..(234): a, c, t, g, unknown or other
  misc_feature (234)..(234): n is a, c, g, or t
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagcgttgggttttcctcgttgcttacgttttaagaggttcgtccaggtcgtcgagggtgccgagtcgtgggtggtggtcggtggggggnggtcggtggtccagccggtggggacgtcctggacgactcgtctagtgaacgtcgtgtggattcagtcttacaaatactagnggactagtcgaccgtacggttcgggacccncgtacggtcctaccgaggacgaagggtacttgggagttgggtcggtactggttggttggtaggtataggtacgtaagggtaagttaatacggtaagtacttagacgaccgtaagaaacccgtaccggggttaggaacgggtacccgtactttaacccgagaccttcgacgaaggtaaccggaccttaaagtaccgaaaacgtttacgttcgtttacggtactacgaataaacgttacgaacgttcgaccgttaggacgtacgggaacccggaggaacgaccggataacgttattaacgcggttcggagaacccgggtaagaccggtagtaccgggttacggaccccgtacccggtaccggtgtaccggg

SEQ ID NO: 40126 - DNA, 839 bp, Homo sapiens
  misc_feature: GYAE6OF02HSYNP.35.67.G01.1.454.CMB.1.raw
  modified_base (190)..(190): a, c, t, g, unknown or other
  misc_feature (190)..(190): n is a, c, g, or t
  modified_base (436)..(436): a, c, t, g, unknown or other
  misc_feature (436)..(436): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcacatggagtttgggctgacgcttgggtttcctcgttgctcttttaaggaggtgtccagtcgtnaggtgcaggctggtggagtcggtgggggacggcgttggtaccaggccgtggggtacggtccctaggagacctcgttcctggttacggaacggtcgtcgtagggtaactttcgaacttctttactaaattaaccgttagtacgggctaacgtcggtccaacggttcgggtaccgcggaacggtccgtcccaagggacgaacggggtacctaggggtacgttcggggtacggtaccgttaggttacgngggttaaggtgtaggtaagttgggggtaaataagtaacggtaactttacgtaatacggaccgtaacggacggtaccggttaacggtaacggggtaccttaacggttaaccttaacccgtaacgttaacccgtaaccgtaaaacggtacgtaaacccggtaaacttttacccggaaaacggttaacctttaccgttttacgttacccttaggtaaaccttaaagttaaaccggaaccttaccggtaccgtaacggaacggaccgtaaccgggtaaacgacccggtaaccgtacggtaacgttaccgttaaacggttcggtaccggtacgggtaagtaaccggaaccggtacggtaaccgggtgggtaaccccggcccggtttaaccccgggacttaacccgggg

SEQ ID NO: 40127 - DNA, 751 bp, Homo sapiens
  misc_feature: GYAE6OF02GTLTT.35.67.G01.1.454.CMB.1.raw
tcagtacagatcgtcacgaccggtgctcgatttagagtatacatattgggtttgggggggagaggagcccagcactagaagtcggcggtgtttccatccggtgatcagcactgaacacagaggactcaccatggagtttgggctgagctgggttttcctcgttgtctcttttaagaggtgtccagtgtcaggtgcagctggtggagtcgtgggggaggcgtggtccgagccgtgggacgtcccgtgacgactctcctgtgaagcgtctggattcatcttacaataactatgactatgcacgttcgggtcccgccgacggtcctaccgacggaccgaacgggacgtagggtacggttgggttcggtcgtagggtttgtaggttggtagtggtagtaggtaaagttaagtagtaacttacgtagtcgtacgacgtaacgtaccggtagggaacgggacccgtaacgttacccaaccgtaccttaccgtaaccgaacggtaacgtaacctaaaccgttaaccgtaaacggtaaaccctttaaccgttttcgtttacccgtaacgtaaccgtaaacgttaaccggaaactacgtaccggtaagaacggaaccggtaccggaaaccgggtaacgaacccgggaacgttaccttaaacgtttacggttacggtacggttacggaaggtaacggtaaggtaccggtaacgggtaccggggtaacccgtacccccgggttaaccccggaggttacccgg

SEQ ID NO: 40128 - DNA, 846 bp, Homo sapiens
  misc_feature: GYAE6OF02GNWYV.35.67.G01.1.454.CMB.1.raw
  modified_base (499)..(499): a, c, t, g, unknown or other
  misc_feature (499)..(499): n is a, c, g, or t
  modified_base (791)..(791): a, c, t, g, unknown or other
  misc_feature (791)..(791): n is a, c, g, or t
  modified_base (840)..(840): a, c, t, g, unknown or other
  misc_feature (840)..(840): n is a, c, g, or t
tcagtacagatcgtcacgaccggtgctcgatttagagtatacatattgggtttgggggggagaggagcccagcactagaagtcggcggtgtttccatccggtgatcagcactgaacacagaggactcaccatggagtttggctgagcttcgggttttcctcgttgcttacgttttaagaggtgtccagtcgtcaggtgcagtcgtgggtggagttccggtaggggggacggtcggttcgggtcccaggtacccgttggggaccggttccccgtaggaacgtaccgttcctacccgttaggtacggaacggtccgttacgtcggttactttacccgaatttccgttaacctaaaacgtttaacgtacgttcgggaccgtaattcccggaccgttaaccggttccgggggtacccccggaccggttaaccggggtccctaccgggaacgggtacccggtaaacggggtcgggttagggtacgggtttcggggtttacgggngtttaagggttcgggttaggttaggttagtaacggtaggtaagggtaaaggtactaaaggtacttacgtatacggacgtaaacggcccggttagtaacggggtaccgggtaaccgttactaccgtaacccgtacttacccggtataaacggaactaacccgtaaacgttaccgaaaacggtttacctttaacgggttcctttacgtaacgaacgttaacgtaacggacgtaaccgcgtaaggaaccggacgggacgtaacggaactaccgtatagttacgttacgtacggtntacgggacgtaagaggaggttccgacgggacccgtaacccgccggttanaacggg

SEQ ID NO: 40129 - DNA, 173 bp, Homo sapiens
  misc_feature: GYAE6OF01D1XXN.30.27.C05.1.454.CMB.1.raw
  modified_base (172)..(173): a, c, t, g, unknown or other
  misc_feature (172)..(173): n is a, c, g, or t
tcagcacgctacgtcacgaccggtgctcgatttagacgcgatcgaagggtttggggaagaggaagactgacggtcctcccaggagttcaggtgctgggcacagcggccctgggctgcctggtcaaggactacttccacgtagcgtgctgagcgggctggcaaggcgcatagnn

SEQ ID NO: 40130 - DNA, 173 bp, Homo sapiens; identical to SEQ ID NO: 40129
  misc_feature: GYAE6OF01BM2PV.30.27.C05.1.454.CMB.1.raw
  modified_base (172)..(173): a, c, t, g, unknown or other
  misc_feature (172)..(173): n is a, c, g, or t

SEQ ID NO: 40131 - DNA, 171 bp, Homo sapiens
  misc_feature: GYAE6OF01BEC3G.30.27.C05.1.454.CMB.1.raw
  modified_base (171)..(171): a, c, t, g, unknown or other
  misc_feature (171)..(171): n is a, c, g, or t
tcagcacgctacgtcacgaccggtgctcgatttagacgcgatcgaagggtttgggaagaggaagactgacggtcctcccaggagttcaggtgctgggcacagcggccctgggctgcctggtcaaggactacttccacgtagcgtgctgagcgggctggcaaggcgcatagn

SEQ ID NO: 40132 - DNA, 172 bp, Homo sapiens
  misc_feature: GYAE6OF01AW5LH.30.27.C05.1.454.CMB.1.raw
  modified_base (172)..(172): a, c, t, g, unknown or other
  misc_feature (172)..(172): n is a, c, g, or t
tcagcacgctacgtcacgaccggtgctcgatttagacgcgatcgaagggtttggggaagaggaagactgacggtcctcccaggagttcaggtgctgggcacagcggccctgggctgcctggtcaaggactacttccacgtagcgtgctgagcgggctggcaaggcgcatagn

SEQ ID NO: 40133 - DNA, 174 bp, Homo sapiens
  misc_feature: GYAE6OF01BTU0Q.30.27.C05.1.454.CMB.1.raw
  modified_base (173)..(174): a, c, t, g, unknown or other
  misc_feature (173)..(174): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnn

SEQ ID NO: 40134 - DNA, 173 bp, Homo sapiens
  misc_feature: GYAE6OF01EEM7B.30.27.C05.1.454.CMB.1.raw
  modified_base (173)..(173): a, c, t, g, unknown or other
  misc_feature (173)..(173): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagn

SEQ ID NO: 40135 - DNA, 180 bp, Homo sapiens
  misc_feature: GYAE6OF01E3G6W.30.27.C05.1.454.CMB.1.raw
  modified_base (168)..(180): a, c, t, g, unknown or other
  misc_feature (168)..(180): n is a, c, g, or t
tcagcacgctacgtcacgaccggtgctcgatttagacgcgatcgaagggttgggaagaggaagactgacggtcctccaggagttcaggtgctgggcacagcggcctgggctgcctggtcaaggactacttccacgtagcgtgctgagcgggctggcaaggcgcatagnnnnnnnnnnnnn

SEQ ID NO: 40136 - DNA, 173 bp, Homo sapiens
  misc_feature: GYAE6OF01B70AJ.30.27.C05.1.454.CMB.1.raw
  modified_base (171)..(173): a, c, t, g, unknown or other
  misc_feature (171)..(173): n is a, c, g, or t
tcagcacgctacgtcacgaccggtgctcgatttagacgcgatcgaagggtttgggaagaggaagactgacggtcctcccaggagttcaggtgctgggcacagcggccctgggctgcctggtcaaggactacttccacgtagcgtgctgagcgggctggcaaggcgcatagnnn

SEQ ID NO: 40137 - DNA, 194 bp, Homo sapiens
  misc_feature: GYAE6OF01E40FO.30.27.C05.1.454.CMB.1.raw
  modified_base (170)..(194): a, c, t, g, unknown or other
  misc_feature (170)..(194): n is a, c, g, or t
tcagcacgctacgtcacgaccggtgctcgatttagacgcgatcgaagggtttgggaaggaggaagactgacggtcctccaggagttcaggtgctgggcacagcggcctgggctgcctggtcaaggactacttccacgtagcgtgctgagcgggctggcaaggcgcatagnnnnnnnnnnnnnnnnnnnnnnnnn

SEQ ID NO: 40138 - DNA, 173 bp, Homo sapiens; identical to SEQ ID NO: 40129
  misc_feature: GYAE6OF01BHBKK.30.27.C05.1.454.CMB.1.raw
  modified_base (172)..(173): a, c, t, g, unknown or other
  misc_feature (172)..(173): n is a, c, g, or t

SEQ ID NO: 40139 - DNA, 187 bp, Homo sapiens
  misc_feature: GYAE6OF01A0XN2.30.27.C05.1.454.CMB.1.raw
  modified_base (173)..(187): a, c, t, g, unknown or other
  misc_feature (173)..(187): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnnnnnnnnnnnnnnn

SEQ ID NO: 40140 - DNA, 174 bp, Homo sapiens; identical to SEQ ID NO: 40133
  misc_feature: GYAE6OF01AXRGY.30.27.C05.1.454.CMB.1.raw
  modified_base (173)..(174): a, c, t, g, unknown or other
  misc_feature (173)..(174): n is a, c, g, or t

SEQ ID NO: 40141 - DNA, 173 bp, Homo sapiens; identical to SEQ ID NO: 40134
  misc_feature: GYAE6OF01CS0TN.30.27.C05.1.454.CMB.1.raw
  modified_base (173)..(173): a, c, t, g, unknown or other
  misc_feature (173)..(173): n is a, c, g, or t

SEQ ID NO: 40142 - DNA, 172 bp, Homo sapiens; identical to SEQ ID NO: 40132
  misc_feature: GYAE6OF01B3BJR.30.27.C05.1.454.CMB.1.raw
  modified_base (172)..(172): a, c, t, g, unknown or other
  misc_feature (172)..(172): n is a, c, g, or t

SEQ ID NO: 40143 - DNA, 173 bp, Homo sapiens; identical to SEQ ID NO: 40134
  misc_feature: GYAE6OF01BBJLC.30.27.C05.1.454.CMB.1.raw
  modified_base (173)..(173): a, c, t, g, unknown or other
  misc_feature (173)..(173): n is a, c, g, or t

SEQ ID NO: 40144 - DNA, 174 bp, Homo sapiens; identical to SEQ ID NO: 40133
  misc_feature: GYAE6OF01CLDQJ.30.27.C05.1.454.CMB.1.raw
  modified_base (173)..(174): a, c, t, g, unknown or other
  misc_feature (173)..(174): n is a, c, g, or t

SEQ ID NO: 40145 - DNA, 173 bp, Homo sapiens; identical to SEQ ID NO: 40129
  misc_feature: GYAE6OF01D3M70.30.27.C05.1.454.CMB.1.raw
  modified_base (172)..(173): a, c, t, g, unknown or other
  misc_feature (172)..(173): n is a, c, g, or t

SEQ ID NO: 40146 - DNA, 173 bp, Homo sapiens; identical to SEQ ID NO: 40134
  misc_feature: GYAE6OF01AZIZ2.30.27.C05.1.454.CMB.1.raw
  modified_base (173)..(173): a, c, t, g, unknown or other
  misc_feature (173)..(173): n is a, c, g, or t

SEQ ID NO: 40147 - DNA, 177 bp, Homo sapiens
  misc_feature: GYAE6OF01CG4MU.30.27.C05.1.454.CMB.1.raw
  modified_base (173)..(177): a, c, t, g, unknown or other
  misc_feature (173)..(177): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnnnnn

SEQ ID NO: 40148 - DNA, 175 bp, Homo sapiens
  misc_feature: GYAE6OF01CEJ8U.30.27.C05.1.454.CMB.1.raw
  modified_base (173)..(175): a, c, t, g, unknown or other
  misc_feature (173)..(175): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnnn

SEQ ID NO: 40149 - DNA, 176 bp, Homo sapiens
  misc_feature: GYAE6OF01BJE1P.30.27.C05.1.454.CMB.1.raw
  modified_base (173)..(176): a, c, t, g, unknown or other
  misc_feature (173)..(176): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnnnn

SEQ ID NO: 40150 - DNA, 200 bp, Homo sapiens
  misc_feature: GYAE6OF01C5359.30.27.C05.1.454.CMB.1.raw
  modified_base (177)..(200): a, c, t, g, unknown or other
  misc_feature (177)..(200): n is a, c, g, or t
tcagcacgctacgtcacgaccggtgctcgatttagacgcgatcgaagggtttgggggaaggaggaagactgacggtcctcccaggagttcgaggtgctgggccacagcggccctgggctgcctggtcaaggactacttccacgtagcgtgctgaagcgggctggcaaggcgcatagnnnnnnnnnnnnnnnnnnnnnnnn

SEQ ID NO: 40151 - DNA, 183 bp, Homo sapiens
  misc_feature: GYAE6OF01EWSXS.30.27.C05.1.454.CMB.1.raw
  modified_base (172)..(183): a, c, t, g, unknown or other
  misc_feature (172)..(183): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggctacttccacgtagcgtgctgagcgggctggcaaggcgcatagnnnnnnnnnnnn

SEQ ID NO: 40152 - DNA, 200 bp, Homo sapiens
  misc_feature: GYAE6OF01BB4SY.30.27.C05.1.454.CMB.1.raw
  modified_base (174)..(200): a, c, t, g, unknown or other
  misc_feature (174)..(200): n is a, c, g, or t
tcagcacgctacgtcacgaccggtgctcgatttagacgcgatcgaagggtttgggggaaggaggaagactgacggtcctcccaggagttcaggtgctgggcacagcggccctgggcctgcctggtcaaggactacttccacgtagcgtgctgagcggctggcaaggcgcatagnnnnnnnnnnnnnnnnnnnnnnnnnnn

SEQ ID NO: 40153 - DNA, 174 bp, Homo sapiens; identical to SEQ ID NO: 40133
  misc_feature: GYAE6OF01BKF2V.30.27.C05.1.454.CMB.1.raw
  modified_base (173)..(174): a, c, t, g, unknown or other
  misc_feature (173)..(174): n is a, c, g, or t

SEQ ID NO: 40154 - DNA, 174 bp, Homo sapiens; identical to SEQ ID NO: 40133
  misc_feature: GYAE6OF01CP2YS.30.27.C05.1.454.CMB.1.raw
  modified_base (173)..(174): a, c, t, g, unknown or other
  misc_feature (173)..(174): n is a, c, g, or t

SEQ ID NO: 40155 - DNA, 192 bp, Homo sapiens
  misc_feature: GYAE6OF01B3I4L.30.27.C05.1.454.CMB.1.raw
  modified_base (174)..(192): a, c, t, g, unknown or other
  misc_feature (174)..(192): n is a, c, g, or t
tcagcacgctacgtcacgaccggtgctcgatttagacgcgatcgaagggtttgggggaaggaggaagactgacggtcctcccaggagttcaggtgctgggcacagcggccctgggctgcctggtcaaggactacttccacgtagcgtgctgagcgggctggcaaggcgcatagnnnnnnnnnnnnnnnnnnn

SEQ ID NO: 40156 - DNA, 172 bp, Homo sapiens; identical to SEQ ID NO: 40132
  misc_feature: GYAE6OF01A1CDE.30.27.C05.1.454.CMB.1.raw
  modified_base (172)..(172): a, c, t, g, unknown or other
  misc_feature (172)..(172): n is a, c, g, or t

SEQ ID NO: 40157 - DNA, 173 bp, Homo sapiens; identical to SEQ ID NO: 40134
  misc_feature: GYAE6OF01CZY4J.30.27.C05.1.454.CMB.1.raw
  modified_base (173)..(173): a, c, t, g, unknown or other
  misc_feature (173)..(173): n is a, c, g, or t

SEQ ID NO: 40158 - DNA, 207 bp, Homo sapiens
  misc_feature: GYAE6OF01APMLB.30.27.C05.1.454.CMB.1.raw
  modified_base (175)..(207): a, c, t, g, unknown or other
  misc_feature (175)..(207): n is a, c, g, or t
tcagcacgctacgtcacgaccggtgctcgatttagacgcgatcgaagggtttgggggaagagggaagactgacggtcctcccaggagttcaggtgctgggcacagcggccctgggctggcctggtcaaggactacttccacgtagcgtgctgagcgggctggcaaggcgcatagnnnnnnnnnnnnnnnnnnnnnnnnnnnnnnnnn

SEQ ID NO: 40159 - DNA, 201 bp, Homo sapiens
  misc_feature: GYAE6OF01BGX85.30.27.C05.1.454.CMB.1.raw
  modified_base (174)..(201): a, c, t, g, unknown or other
  misc_feature (174)..(201): n is a, c, g, or t
tcagcacgctacgtcacgaccggtgctcgatttagacgcgatcgaagggtttgggggaagaggaagactgacggtcctcccaggagttcaggtgctgggcacagcggccctgggcctgcctggtcaacggactactccacgtagcgtgctgagcgggctggcaaggcgcatagnnnnnnnnnnnnnnnnnnnnnnnnnnnn

SEQ ID NO: 40160 - DNA, 185 bp, Homo sapiens
  misc_feature: GYAE6OF01CYWXT.30.27.C05.1.454.CMB.1.raw
  modified_base (173)..(185): a, c, t, g, unknown or other
  misc_feature (173)..(185): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnnnnnnnnnnnnn

SEQ ID NO: 40161 - DNA, 219 bp, Homo sapiens
  misc_feature: GYAE6OF01BKI66.30.27.C05.1.454.CMB.1.raw
  modified_base (176)..(219): a, c, t, g, unknown or other
  misc_feature (176)..(219): n is a, c, g, or t
tcagcacgctacgtcacgaccggtgctcgatttagacgcgatcgaagggtttgggggaaggagggaagacgtgacggtcctcccaggagttcaggtgctgggcacagcggccctgggctgcctggtccaaggctacttccacgtagcgtgctgagcgggctggcaaggcgcatagnnnnnnnnnnnnnnnnnnnnnnnnnnnnnnnnnnnnnnnnnnnn

SEQ ID NO: 40162 - DNA, 174 bp, Homo sapiens; identical to SEQ ID NO: 40133
  misc_feature: GYAE6OF01EBDZH.30.27.C05.1.454.CMB.1.raw
  modified_base (173)..(174): a, c, t, g, unknown or other
  misc_feature (173)..(174): n is a, c, g, or t

SEQ ID NO: 40163 - DNA, 179 bp, Homo sapiens
  misc_feature: GYAE6OF01BBPQT.30.27.C05.1.454.CMB.1.raw
  modified_base (172)..(179): a, c, t, g, unknown or other
  misc_feature (172)..(179): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggctacttccacgtagcgtgctgagcgggctggcaaggcgcatagnnnnnnnn

SEQ ID NO: 40164 - DNA, 192 bp, Homo sapiens
  misc_feature: GYAE6OF01B6V04.30.27.C05.1.454.CMB.1.raw
  modified_base (172)..(192): a, c, t, g, unknown or other
  misc_feature (172)..(192): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggctacttccacgtagcgtgctgagcgggctggcaaggcgcatagnnnnnnnnnnnnnnnnnnnnn

SEQ ID NO: 40165 - DNA, 173 bp, Homo sapiens; identical to SEQ ID NO: 40134
  misc_feature: GYAE6OF01AD1J4.30.27.C05.1.454.CMB.1.raw
  modified_base (173)..(173): a, c, t, g, unknown or other
  misc_feature (173)..(173): n is a, c, g, or t

SEQ ID NO: 40166 - DNA, 172 bp, Homo sapiens
  misc_feature: GYAE6OF01ANXOB.30.27.C05.1.454.CMB.1.raw
  modified_base (172)..(172): a, c, t, g, unknown or other
  misc_feature (172)..(172): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactactttcacgtaggtgctgagcgggctggcaaggcgcatagn

SEQ ID NO: 40167 - DNA, 175 bp, Homo sapiens
  misc_feature: GYAE6OF01D69FX.30.27.C05.1.454.CMB.1.raw
  modified_base (174)..(175): a, c, t, g, unknown or other
  misc_feature (174)..(175): n is a, c, g, or t
tcagcacgctacgtcacgaccggtgctcgatttagacgcgatcgaagggtttgggggaagaaggaagactgacggtcctcccaggagttcaggtgctgggcacagcggccctgggctgcctggtcaaggactacttccacgtagcgtgctgagcgggctggcaaggcgcatagnn

SEQ ID NO: 40168 - DNA, 173 bp, Homo sapiens; identical to SEQ ID NO: 40134
  misc_feature: GYAE6OF01CF6QE.30.27.C05.1.454.CMB.1.raw
  modified_base (173)..(173): a, c, t, g, unknown or other
  misc_feature (173)..(173): n is a, c, g, or t

SEQ ID NO: 40169 - DNA, 173 bp, Homo sapiens; identical to SEQ ID NO: 40134
  misc_feature: GYAE6OF01BQZJ1.30.27.C05.1.454.CMB.1.raw
  modified_base (173)..(173): a, c, t, g, unknown or other
  misc_feature (173)..(173): n is a, c, g, or t

SEQ ID NO: 40170 - DNA, 175 bp, Homo sapiens; identical to SEQ ID NO: 40148
  misc_feature: GYAE6OF01DCNSK.30.27.C05.1.454.CMB.1.raw
  modified_base (173)..(175): a, c, t, g, unknown or other
  misc_feature (173)..(175): n is a, c, g, or t

SEQ ID NO: 40171 - DNA, 213 bp, Homo sapiens
  misc_feature: GYAE6OF01A8K0L.30.27.C05.1.454.CMB.1.raw
  modified_base (179)..(213): a, c, t, g, unknown or other
  misc_feature (179)..(213): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtaggtgtctgagcggggctgggtccaaggcgcattaggnnnnnnnnnnnnnnnnnnnnnnnnnnnnnnnnnnn

SEQ ID NO: 40172 - DNA, 504 bp, Homo sapiens
  misc_feature: GYAE6OF01C3T6U.30.27.C05.1.454.CMB.1.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaanagccacttctcctgcagggccagtcagagtgttggcacctacatagcctggtaccaanagaaacctggccaggctcccaggctcctcatctatgatgcatccaaaagggcctctggcatcccagccaggttcagtggcagtgggtctgggacagacttcactctcaccatcagtagcctagagcctgaagattttgctagtttattactgtcagcagcgtagcgactggcgtgggctcgacgtttcggcggagggaccaaagggtagagatcgaaacgatgtggctgcacatctgtcttctac

SEQ ID NO: 40173 - DNA, 176 bp, Homo sapiens
  misc_feature: GYAE6OF01BDCUH.30.27.C05.1.454.CMB.1.raw
  modified_base (173)..(176): a, c, t, g, unknown or other
  misc_feature (173)..(176): n is a, c, g, or t
tcagcacgctacgtcacgaccggtgctcgatttagacgcgatcgaagggtttgggggaagaggaagactgacggtcctcctaggagttcaggtgctgggcacagcggccctgggctgcctggtcaaggactacttccacgtagcgtgctgagcgggctggcaaggcgcatagnnnn

SEQ ID NO: 40174 - DNA, 175 bp, Homo sapiens; identical to SEQ ID NO: 40148
  misc_feature: GYAE6OF01D20LL.30.27.C05.1.454.CMB.1.raw
  modified_base (173)..(175): a, c, t, g, unknown or other
  misc_feature (173)..(175): n is a, c, g, or t

SEQ ID NO: 40175 - DNA, 174 bp, Homo sapiens; identical to SEQ ID NO: 40133
  misc_feature: GYAE6OF01EFJ6Y.30.27.C05.1.454.CMB.1.raw
  modified_base (173)..(174): a, c, t, g, unknown or other
  misc_feature (173)..(174): n is a, c, g, or t

SEQ ID NO: 40176 - DNA, 192 bp, Homo sapiens
  misc_feature: GYAE6OF01ENUJ3.30.27.C05.1.454.CMB.1.raw
  modified_base (173)..(192): a, c, t, g, unknown or other
  misc_feature (173)..(192): n is a, c, g, or t
tcagcacgctacgtcacgaccggtgctcgatttagacgcgatcgaagggtttgggggaaggaggaagactgacggtcctcccaggagttcaggtgctgggcacagcggccctgggctgcctggtcaaggctacttccacgtagcgtgctgagcgggctggcaaggcgcatagnnnnnnnnnnnnnnnnnnnn

SEQ ID NO: 40177 - DNA, 173 bp, Homo sapiens; identical to SEQ ID NO: 40134
  misc_feature: GYAE6OF01D9Y74.30.27.C05.1.454.CMB.1.raw
  modified_base (173)..(173): a, c, t, g, unknown or other
  misc_feature (173)..(173): n is a, c, g, or t

SEQ ID NO: 40178 - DNA, 173 bp, Homo sapiens
  misc_feature: GYAE6OF01DD7EZ.30.27.C05.1.454.CMB.1.raw
  modified_base (172)..(173): a, c, t, g, unknown or other
  misc_feature (172)..(173): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggctacttccacgtagcgtgctgagcgggctggcaaggcgcatagnn

SEQ ID NO: 40179 - DNA, 229 bp, Homo sapiens
  misc_feature: GYAE6OF01ATECX.30.27.C05.1.454.CMB.1.raw
  modified_base (179)..(229): a, c, t, g, unknown or other
  misc_feature (179)..(229): n is a, c, g, or t
tcagcacgctacgtcacgaccggtgctcgatttagacgcgatcgaaggggtttggggaagaggaagactgacggtcctcccagggagttcaggtgctgggccacgagcggccctgggcctgcctggtccaaggactacttccacggtagcgtgctgagcggctggcaaggccgcatagnnnnnnnnnnnnnnnnnnnnnnnnnnnnnnnnnnnnnnnnnnnnnnnnnnn

SEQ ID NO: 40180 - DNA, 173 bp, Homo sapiens; identical to SEQ ID NO: 40134
  misc_feature: GYAE6OF01COFJ6.30.27.C05.1.454.CMB.1.raw
  modified_base (173)..(173): a, c, t, g, unknown or other
  misc_feature (173)..(173): n is a, c, g, or t

SEQ ID NO: 40181 - DNA, 175 bp, Homo sapiens; identical to SEQ ID NO: 40148
  misc_feature: GYAE6OF01BIRXL.30.27.C05.1.454.CMB.1.raw
  modified_base (173)..(175): a, c, t, g, unknown or other
  misc_feature (173)..(175): n is a, c, g, or t

SEQ ID NO: 40182 - DNA, 507 bp, Homo sapiens
  misc_feature: GYAE6OF01D95JM.30.27.C05.1.454.CMB.1.raw
  modified_base (202)..(202): a, c, t, g, unknown or other
  misc_feature (202)..(202): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagattttgctagtttattactgtcagcagcgtagcgactggcgtgggctcgactttcgggcggagggaccgaaggtagagatcgaaacgatggtggctgacacatntgtcttntac

SEQ ID NO: 40183 - DNA, 521 bp, Homo sapiens
  misc_feature: GYAE6OF01C8E34.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggcctcccaggctcctcatctatgatgcatccaaagggcctctggcatcccagccaggttcagtggcagtgggtctgggacagacttcactctcaccatcagtacgcctagcgcctgaagtattttgctagtttattactgtcagcagcgtagcgacgtggcgtggctcgtacgttcgggcggagggaccgaagggtagagacgtacgaaacgtacgtggtcggctgactacatctgtcttctaccg

SEQ ID NO: 40184 - DNA, 175 bp, Homo sapiens; identical to SEQ ID NO: 40148
  misc_feature: GYAE6OF01CYY7I.30.27.C05.1.454.CMB.1.raw
  modified_base (173)..(175): a, c, t, g, unknown or other
  misc_feature (173)..(175): n is a, c, g, or t

SEQ ID NO: 40185 - DNA, 175 bp, Homo sapiens; identical to SEQ ID NO: 40148
  misc_feature: GYAE6OF01AU4SE.30.27.C05.1.454.CMB.1.raw
  modified_base (173)..(175): a, c, t, g, unknown or other
  misc_feature (173)..(175): n is a, c, g, or t

SEQ ID NO: 40186 - DNA, 173 bp, Homo sapiens; identical to SEQ ID NO: 40134
  misc_feature: GYAE6OF01CPMX7.30.27.C05.1.454.CMB.1.raw
  modified_base (173)..(173): a, c, t, g, unknown or other
  misc_feature (173)..(173): n is a, c, g, or t

SEQ ID NO: 40187 - DNA, 503 bp, Homo sapiens
  misc_feature: GYAE6OF01BNJNP.30.27.C05.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
tcagcacgctacgtcacgaccggtgctcgatttagacgcgatcgaaggatttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctanatagcctggtaccaacagaaacctggccaggctcccaggctcctcatctatgatgcatccaaaagggcctctggcatcccagccaggttcagtggcagtgggtctgggacaggacttcactctcaccatcagtagcctagagcctgaagtattttgactagtttattactgtcagtcagcgtagcgactggcgtgggctcgactttcggcggagggaccaaggtagagatcgaaacgatgngcngcacatctgtcttac

SEQ ID NO: 40188 - DNA, 173 bp, Homo sapiens; identical to SEQ ID NO: 40134
  misc_feature: GYAE6OF01D80JI.30.27.C05.1.454.CMB.1.raw
  modified_base (173)..(173): a, c, t, g, unknown or other
  misc_feature (173)..(173): n is a, c, g, or t

SEQ ID NO: 40189 - DNA, 559 bp, Homo sapiens
  misc_feature: GYAE6OF01DODHH.30.27.C05.1.454.CMB.1.raw
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgcccaccggagaaagtgtgttgacacagtctccagccaccctgtctttgtctccgaggggaaagngccaccttctcctgcagggccagtcagagtgttggcacctacatagcctggtaccaanagaacctggccaggctcccaggctcctcatctatgatgcatccaaaagggcctctggcatcccagccaggttcagtggcagtgggtctgggacagcttcactctcaccatcagtagcctagacgcctgaaagtattttgacttagtttattactgtcagcagcgtagcgtacgtggcggtgggctcgtacgtttcgggacgggtacgggaccgtaagggtaggaggtaactaccgtaaaacggtaacgtcggtgggacctggacctaaccctataccttcggtctttccgtacccg

SEQ ID NO: 40190 - DNA, 664 bp, Homo sapiens
  misc_feature: GYAE6OF01BUXMH.30.27.C05.1.454.CMB.1.raw
  modified_base (199)..(199): a, c, t, g, unknown or other
  misc_feature (199)..(199): n is a, c, g, or t
tcagcacgctacgtcacgaccggtgctcgatttagacgcgatcgaagggtttgggggaggaactgctcagttaggacccaggagggaaccatggaagccccagctcagcttctcttcctcctgctactctggctccagatgccacggagaaagtgtgttgacacagtctccagccacctgtcttgtctccgaggggaangccacttctcctgcaggccagtcagagtgtggcactacatagcctggtaaccaacaacgaaaccgtcggaccaggcctcccgaggcctcctacactctatcgatgactaactaccgaaaacgggtcctacgtcggacactcccacgccgtaggttcaggtcggcgtaggtcgggtcgtcgggacgagtacgttacacgtctacgacctacgtacaacggtacgtacctagacgtaccgtaggtaaacgttagttttacgacttaacggttttattacgtcgttacaacgtacgacggtacgtacggtacgtacgttcgggcggttcgggtccgttacgtacgtttcggggacgggtaacgggaacgtaagggtaacggaacggtaacgtaacgaaaaccggtacgtacgggtacggacgttacggaccgttaaccgtattaccgttcgttccgtaccgttacccg

SEQ ID NO: 40191 - DNA, 174 bp, Homo sapiens; identical to SEQ ID NO: 40133
  misc_feature: GYAE6OF01C9192.30.27.C05.1.454.CMB.1.raw
  modified_base (173)..(174): a, c, t, g, unknown or other
  misc_feature (173)..(174): n is a, c, g, or t

SEQ ID NO: 40192 - DNA, 531 bp, Homo sapiens
  misc_feature: GYAE6OF01DDTOQ.30.27.C05.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (450)..(450): a, c, t, g, unknown or other
  misc_feature (450)..(450): n is a, c, g, or t
  modified_base (517)..(517): a, c, t, g, unknown or other
  misc_feature (517)..(517): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaanagaaacctggccaggctcccaggctcctcatctatgatgcatccaaaagggcctactggcatcccagcagttcagtgcagtgggtctgggacagacgttcactctcaccatcagtacgcctagacgacctgaagtattttgactaagtttatactgtctagcagcgtagcgacgtggcgtagggccttnacgtttcggacgggtagggaccgaaggtagagagtacgaaaacgtaactggtggactgaccaccatntcggtcttctaccg

SEQ ID NO: 40193 - DNA, 507 bp, Homo sapiens
  misc_feature: GYAE6OF01EX3YZ.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagtattttgctagtttattactgtcagcagcgtagcgactggcgtgggctcgacgtttcggcggaggaccgaaggtagagatcgaaacgactggtgctgcaccatctgtctcgtac

SEQ ID NO: 40194 - DNA, 506 bp, Homo sapiens
  misc_feature: GYAE6OF01EH3GL.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatagcctggtaccaacagaaacctggccaggctcccaggctcctcatctatgatgcatccaaaaggcctctggcatcccagccaggttcagtggcagtgggtctgggacagacttcactctcaccatcagtagcctagagcctgaagattttgctagtttatactgtcagcagcgtagcgactggcgtgggctcactttcggcggagggaccaagggtagagatcgaaacgtactggtggctgctaccatctgtcttcgtac

SEQ ID NO: 40195 - DNA, 535 bp, Homo sapiens
  misc_feature: GYAE6OF01C84ZU.30.27.C05.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (326)..(326): a, c, t, g, unknown or other
  misc_feature (326)..(326): n is a, c, g, or t
  modified_base (530)..(530): a, c, t, g, unknown or other
  misc_feature (530)..(530): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcactacatagcctggtaccaanagaaacctggccaggctccaggctcctcatctatgatgcataccgaaaaggcctctggcactcccanccaggttcagtgcaggtgggtcgtgggacagacttcgactcctcacctatctacgtacgtcctagagccgtagaacgtattttgactagtttattactgtcagtcagtcgtagcgacgtggacgtggctcgtacgtttcggcggagggaccgtaaggagaagatacgaaacgtatggtcggactcggactacgatcgtcgtctntcccg

SEQ ID NO: 40196 - DNA, 173 bp, Homo sapiens; identical to SEQ ID NO: 40134
  misc_feature: GYAE6OF01EU8FH.30.27.C05.1.454.CMB.1.raw
  modified_base (173)..(173): a, c, t, g, unknown or other
  misc_feature (173)..(173): n is a, c, g, or t

SEQ ID NO: 40197 - DNA, 173 bp, Homo sapiens; identical to SEQ ID NO: 40134
  misc_feature: GYAE6OF01ARHHD.30.27.C05.1.454.CMB.1.raw
  modified_base (173)..(173): a, c, t, g, unknown or other
  misc_feature (173)..(173): n is a, c, g, or t

SEQ ID NO: 40198 - DNA, 513 bp, Homo sapiens
  misc_feature: GYAE6OF01CGUQL.30.27.C05.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttcncctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctagaagattttgctagtttacttactgtcagcagcgtagcgactggcgtgggctcgacgtttcggcggagggaccgaagggtacgagatacgaaacgatggtggctgcacatctgtcttctaccg

SEQ ID NO: 40199 - DNA, 540 bp, Homo sapiens
  misc_feature: GYAE6OF01E6BL7.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatacgcctggtaaccaacagaaacctggccaggctcccaggctcctcatctatgatgcataccgaaaaggcctctggcactcccagccaggttcagtggctaggtgggtcgtgggacagacttcactctacaccatcagtacgcctagacgcctagaagtattttgacttagttttacttacgtgtcagtcgagtcgtagcgacgtggcgtcgggctcgtacgttcggcggaggacgaaggtagagagtacgaacgtatggtcgcgtcgacctactatactcgttctcgttacccg

SEQ ID NO: 40200 - DNA, 176 bp, Homo sapiens; identical to SEQ ID NO: 40149
  misc_feature: GYAE6OF01ARTMA.30.27.C05.1.454.CMB.1.raw
  modified_base (173)..(176): a, c, t, g, unknown or other
  misc_feature (173)..(176): n is a, c, g, or t

SEQ ID NO: 40201 - DNA, 536 bp, Homo sapiens
  misc_feature: GYAE6OF01BTBAX.30.27.C05.1.454.CMB.1.raw
  modified_base (203)..(203): a, c, t, g, unknown or other
  misc_feature (203)..(203): n is a, c, g, or t
tcagcacgctacgtcacgaccggtgctcgatttagacgcgatcgaagggtttgggggaggaactgctcagttaggacccagagggaaccatggaagcccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcataccaaaagggtcctctggcatcccagccaggttcagtggcaggtgggtcgtgggacaggtacttcactctcaccatcagtacgccgtagacgtcctagtaagtatttgactagtttacttacttgtacagtcagcgtagcgacgtggcgtggctcgtacgtttcggacggtaggaccgtaaggtagagagtacgaaacgtagtggtggctgactacagtctcgtcttctacc

SEQ ID NO: 40202 - DNA, 192 bp, Homo sapiens
  misc_feature: GYAE6OF01EYNQO.30.27.C05.1.454.CMB.1.raw
  modified_base (174)..(192): a, c, t, g, unknown or other
  misc_feature (174)..(192): n is a, c, g, or t
tcagcacgctacgtcacgaccggtgctcgatttagacgcgatcgaagggtttgggggaagaggaacgactgacggtcctcccaggagttcaggtgctgggcacagcggccctgggctgcctggtcaaggactacttccacgtagcgtgctgagcgggctggcaaggcgcatagnnnnnnnnnnnnnnnnnnn

SEQ ID NO: 40203 - DNA, 190 bp, Homo sapiens
  misc_feature: GYAE6OF01D2EXE.30.27.C05.1.454.CMB.1.raw
  modified_base (172)..(190): a, c, t, g, unknown or other
  misc_feature (172)..(190): n is a, c, g, or t
tcagcacgctacgtcacgaccggtgctcgatttagacgcgatcgaagggtttgggggaagagggaagactgacggtcctcccaggagttcaggtgctgggcacagcggccctggctgcctggtcaaggctacttccacgtagcgtgctgagcgggctggcaaggcgcatagnnnnnnnnnnnnnnnnnnn

SEQ ID NO: 40204 - DNA, 512 bp, Homo sapiens
  misc_feature: GYAE6OF01A5LYD.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagacgcctgaagtattttgctagttttattactgtcagcagcgtagcgactggcgtgggctcacgtttcggcgggtagggaccgaaggtagagatacgaaacgatggtggctgcaccatctgtcttctac

SEQ ID NO: 40205 - DNA, 817 bp, Homo sapiens
  misc_feature: GYAE6OF01CTL0E.30.27.C05.1.454.CMB.1.raw
  modified_base (200)..(200): a, c, t, g, unknown or other
  misc_feature (200)..(200): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtcttgtctcaggggaaangccaccttctcctgcagggccagtcagagtgttggcacctacatacgcctaggtaaccaaacacgaaacctggccaaggctcccgaggcctcctacatctatgatgcactaccgaaaaggcctacgtcggcaacgtccccagcccgtagggttaccaggttcggacgtaagggtcggggttcgtacggggaactacggtacctttaccgacttaccgttacaacccctattacccggtaaggttaccgtacccgttaacggaaccggtacccgttaaggaaaaggtttaacgtttttcggaacgttttaacggtttttaacttaaccgtttagttaacccgaaggtacccgtaagggtccgggtttaaacggccgggtaacgttacgggggtaccgggttccgggggtcccgtttacccggtaaccgggtttttacccgggggaaccggggggttaacgggaaacccccggttaaaagggggttaaaccgggaaaccggtaaaccggtaaaccggtaaaaaacccggttaacgggttacggtttccgggaaccggtttacggaccccgttaaaccgtaacgttccgtttaccggttcccgttttaccttaaccccgg

SEQ ID NO: 40206 - DNA, 555 bp, Homo sapiens
  misc_feature: GYAE6OF01EL3PF.30.27.C05.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatagcctggtaccaanagaaacctggccaggcctcccaggcctcctcatctatgatgcataccaaagggcctctggcactcccagccaggttcagtggcaggtgggtctgggacagacttcactctcacatcagtacgcctagacgcctagaagtattttagacttagttttattactgtacagtcacggcgtacggcgtacgttggacggttgggcttcgtacgtttcgggcgggtacggaaccgtaagggtaagaggtaactaacgaaacgtagtggtggcgtgacctactatcttcgtccttctaccg

SEQ ID NO: 40207 - DNA, 171 bp, Homo sapiens
  misc_feature: GYAE6OF01EK7O0.30.27.C05.1.454.CMB.1.raw
  modified_base (171)..(171): a, c, t, g, unknown or other
  misc_feature (171)..(171): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggctacttcacgtagcgtgctgagcgggctggcaaggcgcatagn

SEQ ID NO: 40208 - DNA, 538 bp, Homo sapiens
  misc_feature: GYAE6OF01EPO4O.30.27.C05.1.454.CMB.1.raw
  modified_base (203)..(203): a, c, t, g, unknown or other
  misc_feature (203)..(203): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaaangccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcgagtacgcctagacgccgtagtaagtattttgactagttttattactgtcagcagcgtagcgacgtggcggtgggcctcgtacgtttcgggcggagggaccgaagggtacgagactacgaaacgtaagtggtggacgtgacaccattcgtcgttcttcgtaccg

SEQ ID NO: 40209 - DNA, 544 bp, Homo sapiens
  misc_feature: GYAE6OF01C8E3D.30.27.C05.1.454.CMB.1.raw
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcataccaaaagggccctactggcactcccagcccaggttcagtggcgaggtgggtctgggacagacttcactccacaccatccagtacgcctagacgccgtagaagtagttttgacttagtttatttacgtgtcagtcagtcgtagcgtacgtggcggtcgggcttcgtacgttcgggacggacgggaccgaagggtagagatacgaaacgngtggnggctgctaccatccttcgtcttctacc

SEQ ID NO: 40210 - DNA, 527 bp, Homo sapiens
  misc_feature: GYAE6OF01ECU8R.30.27.C05.1.454.CMB.1.raw
  modified_base (202)..(202): a, c, t, g, unknown or other
  misc_feature (202)..(202): n is a, c, g, or t
  modified_base (513)..(513): a, c, t, g, unknown or other
  misc_feature (513)..(513): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcatccaaaagggcctactggcatcccagccaggttcagtggcagtggtctgggacagacgttcatctcaccatcagttagacctagacgccgtagtaagtattttgactagttttattactgtcagtcagtcgtagcgacgtggcggtggctcgtacgtttcggcggagggaccaagggtagagagtacgaaacgtatggtggctgacacatntcgttctcgtaccg

SEQ ID NO: 40211 - DNA, 700 bp, Homo sapiens
  misc_feature: GYAE6OF01CHBSS.30.27.C05.1.454.CMB.1.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaaggggaaanagcccaccttctcctgcagggccagtcagagtgttgcacctanatagcctggtaccacaagaactacgcgacgactcccacggctcctcatctatgatgcactaccgtaaaacgggaccgtctggcactacccacgccgtacggttctacggtggcggtaggtaggggttcggtacgggacgaactaccgtttactcccgtactactacccaacttcgaacggttagcccgtaagacggccttacggtaaaggttagtttttacgacgtaacgtttttaatttaacctgttcgaacgtcgacggtacggtaacgaccggttacgtcgggtaccgggtcggggtaccgttaccctccgggtttttacgggaccggggaacggggtaccgaaacgggttaaagggtcgaacgttaaacccgaaaacccggtaagggttcggttcgggtaccgtacgaccgtaaccctaaggttcgttaccgttccgtttacctaaccc

SEQ ID NO: 40212 - DNA, 607 bp, Homo sapiens
  misc_feature: GYAE6OF01EMKO6.30.27.C05.1.454.CMB.1.raw
  modified_base (203)..(203): a, c, t, g, unknown or other
  misc_feature (203)..(203): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaaangccaccttctcctgcagggccagtcagagtgttggcacctacatacgccttaggtaccaacagaaacctggccaggcctcccaggctcctcatctatgatgcataccgaaaagggccctacgtggacactccccagtcccaggttccaggtggcgaggtgggtctgggacagacgttcactctacaccatcagtacgacctagacgcctagaacgttattttcgacttaagttttacttacttgtactagactaggtcgtagcgtacgtggtacggtcgggtccttaccgtacgtttccgggacgggtaacgggtaccgtaagggtaggacgtaacgtacgaaaaccggtagttaggtcggtactcggacctaaccgacttacgtcgttccgttccgttacccg

SEQ ID NO: 40213 - DNA, 687 bp, Homo sapiens
  misc_feature: GYAE6OF01EY2YV.30.27.C05.1.454.CMB.1.raw
  modified_base (206)..(206): a, c, t, g, unknown or other
  misc_feature (206)..(206): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgcctactctggctcccagatggccaccgggagaaagtgtgttgacacagtctccagccaccctgtctttgtctccaggggtaaangccaccttctcctgcagggccagtcagagtgttggcacctacatagcctggtaccaacagaaacctggccaggctcccaggcctcctcatctatcgatgctacgtaccgaaaagggtccctacgtcggacctactcccgagacccgtaggttacaggtcggactaggttcgggtcgtgggaacaggtaccttcaccgttcctaccgaaccactacgaacggttaccgaccgttaacggacgtaccgtaggtaaacgttagttttacgacgtttaagttttaacgttacgttgtacctaagaccgtaaggtcggtaacgcgtaacgtcgggtacggtcggtcttacgttacggtttcgggacgggtaacgggaccgtaagggtacgtaacgtaacgttaaccggaaaaccggtacgttacgggtcggtaccgtacggaccctaacccgttacgttccgttacggtttcccttccgttacccg

SEQ ID NO: 40214 - DNA, 177 bp, Homo sapiens
  misc_feature: GYAE6OF01CBEZV.30.27.C05.1.454.CMB.1.raw
  modified_base (168)..(177): a, c, t, g, unknown or other
  misc_feature (168)..(177): n is a, c, g, or t
tcagcacgctacgtcacgaccggtgctcgatttagacgcgatcgaagggttggggaagaggaagactgacggtctccaggagttcaggtgctgggcacagcggccctgggctgcctggtcaaggctacttccacgtagcgtgctgagcgggctggcaaggcgcatagnnnnnnnnnn

SEQ ID NO: 40215 - DNA, 837 bp, Homo sapiens
  misc_feature: GYAE6OF01BV49B.30.27.C05.1.454.CMB.1.raw
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
tcagcacgctacgtcacgaccggtgctcgatttagacgcgatcgaagggtttgggggacggaactgctccagttaggacccagacgggaaccatggaagccccagctcagcttctcgttcctctgctactctggctccagatgccaccggagaagtgtcgttgaccacgagtcctaccagccaccctgttcctttggtcctcgaaggggtaaagagcctaccttcgcctgctagggcctagtcagacgttgttggcacctanactacgcctaggtaaccaanacgtaaactggaccgtaggctcccgaaggcctcctacgactaccgtagtcgaagtgcgtaacgtaccgtaaaagggtcctacgtacggacctaacgtacccgacggtacccgtaaggttcgacggttcggacggtaaggtcgggtacgtacggggtaaccgttacgtaaccgtttcgtaacccgttcgtacccgtaacccgttagtacccgtaacggttaaccgtaccgtaaggtaaccggtacccgttaaggttaaacgtttacgttttacggtaacgttaaacggtttttaactaaccgttagggtacccgtaacggtaccgttaacgggtcggttacggggaccgtaacggttcgggtaccgggttccgggtctttaccggttacggtttccgggacggggtaacgggtaacccggtaagggtaacgggtaacggtaacggttaacccggaaaacgggttaccggttacgggtaccggggtacccgttagggtacccgtaaaccggttacgttacggttacccggtttaccggttaccgtttaacccccggg

SEQ ID NO: 40216 - DNA, 626 bp, Homo sapiens
  misc_feature: GYAE6OF01BM8SO.30.27.C05.1.454.CMB.1.raw
  modified_base (301)..(301): a, c, t, g, unknown or other
  misc_feature (301)..(301): n is a, c, g, or t
tcagcacgctacgtcacgaccggtgctcgatttagacgcgatcgaaggttgggggaggaactgctcagttaggacccagagggaaccatggaagccccagctcagcttctcttcctcctgctactctggctcccagatcgccacggagaaagtgttgtgacaacagtcctcacgcccacctgtctttgtctcccaaggggaaagagccaccttcctcctgtcagggccgacgtcagaggtgttggacacctagatagtcctcgtaccaacagaaacctggccaggcctaccgacgctcctnactctatgatgacactccgaaacggcctcgaggcactcccagccgtaggttcaggtcggcgtagggtcggtgtacggacacgtaccttacaccgtcctaccacctatccgagtacgacctagacgtacgtagtaacgtagtttacgtacgttacgtttaatttacgttagttcagtacgacgtacgtacgtacgtacgtcggtccggtcggtccgtacgtaccggtttacgggacggtaacggaaccgtaagggtacgaacggtaacgtaacgaaacgtagtggtcggcgtacgacctactacgtacttcgttccttcgtacccg

SEQ ID NO: 40217 - DNA, 174 bp, Homo sapiens; identical to SEQ ID NO: 40133
  misc_feature: GYAE6OF01DL162.30.27.C05.1.454.CMB.1.raw
  modified_base (173)..(174): a, c, t, g, unknown or other
  misc_feature (173)..(174): n is a, c, g, or t

SEQ ID NO: 40218 - DNA, 177 bp, Homo sapiens; identical to SEQ ID NO: 40147
  misc_feature: GYAE6OF01BAFB3.30.27.C05.1.454.CMB.1.raw
  modified_base (173)..(177): a, c, t, g, unknown or other
  misc_feature (173)..(177): n is a, c, g, or t

SEQ ID NO: 40219 - DNA, 589 bp, Homo sapiens
  misc_feature: GYAE6OF01EBQFV.30.27.C05.1.454.CMB.1.raw
  modified_base (261)..(261): a, c, t, g, unknown or other
  misc_feature (261)..(261): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgctccaggggaaagagccaccttctcctgcagggccagtcagagtgttggcacctacatagcctaggtaccaanagaaacctggccaggctcccgagctcctcatctatgatgcataccgaaaagggcctactggcatcccagccaggttcagtgcagtgggtcgtggacagacttcactctcacatcagtacgacctagagcctgaagtattttgacttaagttttacttacgtgttacgagtcgaagtccggtagccggtacgtgggtcggtcgggtccttcgtaccggtttcgggaccgggacggggtaaccgaaagggtacgagtaagtaaccgaaaacggtaacgtggtacgggacttcggaccctaaccgacttcgttacgttcttccgttaaccc

SEQ ID NO: 40220 - DNA, 522 bp, Homo sapiens
  misc_feature: GYAE6OF01BEJDU.30.27.C05.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctanatagcctggtaccaacagaaacctggccaggctcccaggctcctcatctatgatgcatccaaaagggcctctggcatcccagccaggttcagtggcagtgggtctgggacagtacttcactctcacatcagtagcctagacgcctagtaagtatttgctagtttattactgtcagcagcgtagcgacgtggcgtggctcgtacgtttcggcggaggaccgaggtacgagagtacgaaacgtagtggtcgacgtgactaccatcgtcgttctcgtaccg

SEQ ID NO: 40221 - DNA, 177 bp, Homo sapiens
  misc_feature: GYAE6OF01AB97N.30.27.C05.1.454.CMB.1.raw
  modified_base (172)..(177): a, c, t, g, unknown or other
  misc_feature (172)..(177): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggctacttccacgtagcgtgctgagcgggctggcaaggcgcatagnnnnnn

SEQ ID NO: 40222 - DNA, 555 bp, Homo sapiens
  misc_feature: GYAE6OF01BNSIA.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtacgcctagacgcctgaagtattttgctaagttttattactgtcagcagtcgtagcgactggcgtgggctcgtacgtttcgggcgggagggaccgaagggtacgaaggaactacgaaaaccggtaacgttggtacgggccgtaggacctaccgtacttccttcggttccttcgtaacccg

SEQ ID NO: 40223 - DNA, 530 bp, Homo sapiens
  misc_feature: GYAE6OF01EGMVZ.30.27.C05.1.454.CMB.1.raw
  modified_base (203)..(203): a, c, t, g, unknown or other
  misc_feature (203)..(203): n is a, c, g, or t
  modified_base (525)..(525): a, c, t, g, unknown or other
  misc_feature (525)..(525): n is a, c, g, or t
tcagcacgctacgtcacgaccggtgctcgatttagacgcgatcgaagggtttgggggaggaactgctcagttaggacccagagggaaccatggaagcccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatagcctggtaccaacagaaacctggccaggctcccaggctcctcatctatgatgcataccgaaaagggcctctggcactcccagccaggttcagtggcaggtgggtcgtgggacacgacttccactctcacatcagtacgctagagcctagaagtatttgacttagtttacttacttgtcagcagtcgtagcgagtggcgtggctctacgtttcggcggagggaccgaaggtagagaagtacgaaacggactggtcggcgtagcctacactctgttctntaccg

SEQ ID NO: 40224 - DNA, 240 bp, Homo sapiens
  misc_feature: GYAE6OF01B3IO1.30.27.C05.1.454.CMB.1.raw
  modified_base (202)..(240): a, c, t, g, unknown or other
  misc_feature (202)..(240): n is a, c, g, or t
tcagcacgctacgtcacgaccggtgctcgatttagacgcgatcgaagggtttgggggggaaggacggaaggactggtaccggtccttacccagggagttccaccgggtgcgtgggacaactgccggcccgtgggcctggcctgggtacaaggctacttccgaacgtaggcgtgcctagaggcgggctggacaaggctcatgnnnnnnnnnnnnnnnnnnnnnnnnnnnnnnnnnnnnnnn

SEQ ID NO: 40225 - DNA, 175 bp, Homo sapiens; identical to SEQ ID NO: 40148
  misc_feature: GYAE6OF01A8635.30.27.C05.1.454.CMB.1.raw
  modified_base (173)..(175): a, c, t, g, unknown or other
  misc_feature (173)..(175): n is a, c, g, or t

SEQ ID NO: 40226 - DNA, 178 bp, Homo sapiens
  misc_feature: GYAE6OF01BL499.30.27.C05.1.454.CMB.1.raw
  modified_base (169)..(178): a, c, t, g, unknown or other
  misc_feature (169)..(178): n is a, c, g, or t
tcagcacgctacgtcacgaccggtgctcgatttagacgcgatcgaagggtttgggggaagaggaagactgacggtcctcccaggagttcaggtgctgggcacagcgcctggctgcctggtcaaggactacttccacgtagcgtgctgagcggctggcaaggcgcatagnnnnnnnnnn

SEQ ID NO: 40227 - DNA, 564 bp, Homo sapiens
  misc_feature: GYAE6OF01AOWYS.30.27.C05.1.454.CMB.1.raw
  modified_base (203)..(203): a, c, t, g, unknown or other
  misc_feature (203)..(203): n is a, c, g, or t
  modified_base (554)..(554): a, c, t, g, unknown or other
  misc_feature (554)..(554): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaaanagccaccttctcctgcagggccagtcagagtgttgcacctacatagcctggtaaccaacagaaacctggaccaggctcccaggctcctcatctatgatgcactaccaaaacgggcctctggccactcccagccaggttcagtggctaggtgggtcgtgggacagtacttcactctacacctatcgagtacgcctagacgccgtagaagtattttgacttagtttattactgtcacgcgtaggtcgtacgcgtacgtggcggttcgggccttacgtaccgtttcgggacgggacgggtaccgaagggtagaggtactaacgaaacgtacgtaggtcgctagctacgatcgtntcttctaccg

SEQ ID NO: 40228 - DNA, 192 bp, Homo sapiens
  misc_feature: GYAE6OF01CXVEF.30.27.C05.1.454.CMB.1.raw
  modified_base (173)..(192): a, c, t, g, unknown or other
  misc_feature (173)..(192): n is a, c, g, or t
tcagcacgctacgtcacgaccggtgctcgatttagacgcgatcgaagggtttggggggaagaggaatactgacggtcctcccaggagttcaggtgctgggcacagcgccctgggctgcctggtcaaggactacttccacgtagcgtgctgagcgggctggcaaggcgcatagnnnnnnnnnnnnnnnnnnnn

SEQ ID NO: 40229 - DNA, 174 bp, Homo sapiens
  misc_feature: GYAE6OF01C5HDO.30.27.C05.1.454.CMB.1.raw
  modified_base (174)..(174): a, c, t, g, unknown or other
  misc_feature (174)..(174): n is a, c, g, or t
tcagcacgctacgtcacgaccggtgctcgatttagacgcgatcgaagggtttggggggaagaggaagactgacggtcctcccaggagttcaggtgctgggcacagcggccctgggctgactggtcaaggactacttccacgtagcgtgctgagcgggctggcaaggcgcatagn

SEQ ID NO: 40230 - DNA, 148 bp, Homo sapiens
  misc_feature: GYAE6OF01DVJXJ.30.27.C05.1.454.CMB.1.raw
tcagcacgctacgtcacgaccggtgctcgatttagacgcgatcgaagggtttgggggaagaggaagactgacggtcctcccaggagttcaggtgctgggcacagcggccctggactgcctggtcaaggactacttccagtagcgtgct

SEQ ID NO: 40231 - DNA, 536 bp, Homo sapiens
  misc_feature: GYAE6OF01EAERG.30.27.C05.1.454.CMB.1.raw
  modified_base (202)..(202): a, c, t, g, unknown or other
  misc_feature (202)..(202): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggcctcccaggctcctcatctatgatgcataccgaaaagggcctcgtggcactcccagccaggttcagtggcagtgggtctgggacagtacttcactctcaccatcagtacgcctagacgctagaagttatttgactagttttacttacttgtcagtcagcgtagcgtacgtggcggtggctcgtacgttcgggcgggacggacgaaggtgagactacgtaaacgtagtggtgcgtgacctacgtatcgtnttctnttaccc

SEQ ID NO: 40232 - DNA, 573 bp, Homo sapiens
  misc_feature: GYAE6OF01CI4QC.30.27.C05.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctanatagcctggtaccaacagaaacctggccaggctcccaggctcctcatctatgatgcataccaaaaggcctctggcactcccagccaggttccaggtcggcaggtcgggtcgtcgggacaggtacttcgactctccaccatcagtacgactagacgccgtagtaagtattttgactagtttacttacttgtcacgctagtcgtagcgtacgtggccggtggcctcgtacgtttcgggcggtacggaaccgtagggtagaaggtagacgtaaacgtaagtcggtcgggtaccttaggaccgtaacctcgtactcgttccgttacgtacccg

SEQ ID NO: 40233 - DNA, 174 bp, Homo sapiens; identical to SEQ ID NO: 40133
  misc_feature: GYAE6OF01EQJZN.30.27.C05.1.454.CMB.1.raw
  modified_base (173)..(174): a, c, t, g, unknown or other
  misc_feature (173)..(174): n is a, c, g, or t

SEQ ID NO: 40234 - DNA, 174 bp, Homo sapiens
  misc_feature: GYAE6OF01B4S6F.30.27.C05.1.454.CMB.1.raw
  modified_base (174)..(174): a, c, t, g, unknown or other
  misc_feature (174)..(174): n is a, c, g, or t
tcagcacgctacgtcacgaccggtgctcgatttagacgcgatcgaagggtttggggggaagaggaagactgacggtcctcccaggagttcaggtgctgggcacagcggccctgggctgcctggtcaaggactacttccacgtagcgtgctgagcgggctggcaaggcgcatagn

SEQ ID NO: 40235 - DNA, 176 bp, Homo sapiens; identical to SEQ ID NO: 40149
  misc_feature: GYAE6OF01EK0W9.30.27.C05.1.454.CMB.1.raw
  modified_base (173)..(176): a, c, t, g, unknown or other
  misc_feature (173)..(176): n is a, c, g, or t

SEQ ID NO: 40236 - DNA, 199 bp, Homo sapiens
  misc_feature: GYAE6OF01CX00H.30.27.C05.1.454.CMB.1.raw
  modified_base (176)..(199): a, c, t, g, unknown or other
  misc_feature (176)..(199): n is a, c, g, or t
tcagcacgctacgtcacgaccggtgctcgatttagacgcgatcgaagggtttggggggaagaggaagactgaccggtcctcccaggagttccaggtgctgggcacagcggccctggctgcctggtcaaggacttacttccacgtagcgtgctgagcgggctggcaaggcgcatagnnnnnnnnnnnnnnnnnnnnnnnn

SEQ ID NO: 40237 - DNA, 661 bp, Homo sapiens
  misc_feature: GYAE6OF01AYJ03.30.27.C05.1.454.CMB.1.raw
  modified_base (203)..(203): a, c, t, g, unknown or other
  misc_feature (203)..(203): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaaanagccaccttctcctgcaggccagtcagagtgtggcacctacatacgcctggtaaccaacagaaacctggaccaggcctcccgaggcctcctacatcctatgatgcactaccgaaaaggccctgtcggcactcccgagccaggtttccgaggtcgacgtaggtcgggtcgtacgggactaggaccttacgacttccgtaccacctagtacaacgtacgacccgttaaggaccgtccgtaaggtaacgttacgttttagtacgttaagttttacttacgtcgtacgacgtacgaggtaccgtaggccgtacggtcgggtacggttcggtaccgttaccgttccgggtttacggggaccgggtaacgggtaaccgtaagggtagtaacgtaacgtaaccggaaaccggtagtcggtggtactacgaccgtaacctcgttaccttcgtccgttcttaccccg

SEQ ID NO: 40238 - DNA, 174 bp, Homo sapiens; identical to SEQ ID NO: 40133
  misc_feature: GYAE6OF01BBZZX.30.27.C05.1.454.CMB.1.raw
  modified_base (173)..(174): a, c, t, g, unknown or other
  misc_feature (173)..(174): n is a, c, g, or t

SEQ ID NO: 40239 - DNA, 789 bp, Homo sapiens
  misc_feature: GYAE6OF01CT07Y.30.27.C05.1.454.CMB.1.raw
  modified_base (201)..(201): a, c, t, g, unknown or other
  misc_feature (201)..(201): n is a, c, g, or t
  modified_base (565)..(565): a, c, t, g, unknown or other
  misc_feature (565)..(565): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctccagatgccaaccggagaaagtgtgttgacacagtctccagccacctgtctttgctccgaaggggaangcccaccttctctgcgacggccagtcagagtgttcggacactacagtacgcctaggtaaccaaacgaacgaaaccgtcggaccgaacggacctacccgaacgggtcccttcccgttacactttaccgtaagttacggtaacgttacggaacctaaccgttaacccggaaaaaaccggggtcccttaccggttaccgggaccctaacccgttaccccggaacggttacccggtaacggggtttaccacggggtttaccgggacgtaaggggttcggggtacggtacgggaacgtacgtaccgttacgacttaccgtaccaactacgtaccgaaggtacgtacgtaacgacgtacgtagtaacgtnttttacgacttaaggtttacttacgttcgtacgagtaccgtagtacgtacgtacggtacgtcgggtacggttcggaccgtttccgtaacgggttcgggaaccgggtacgggtaaccggtaaaggtacgaaacggtaacgtaaccggaaacggtaaggtttcggacggtacccttacggaacccgtacgttaacttccgtacgttccgttaacccgttaccccgg

SEQ ID NO: 40240 - DNA, 848 bp, Homo sapiens
  misc_feature: GYAE6OF01DMS1W.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctccagatgccaccggagaagtgtgttgacacagtctccagccctaccctgttctttgtcctaccgaaggggaaacgacgccctaccttctcctggccgaacgggccagtcagtagtgttcggccaacctacagtacgccgtacggtaaccaaacgaacgaaaccgtcggacccgacgggaccctaccccgacggtcctaccctacgaactccgtaatcggattcggacctaacgtaacccggaaaacggggtcccttacggtacggacctaacccgttaccccgaacggtcccgtaaccgggtttacgaacgggttcgggacggtacggggttcggggtaccggttacggggaaccctaacggttaacccttcctaacccgtccgttaacccaaacccgttaacgttaccggtaaacggttaccggtaacccgttaacgggtacccgttaacccgttaaggtaaaacggttttacgttttacgggtaaccttttaaggttttactttacgttcgttaaccgaacgtcgtaacggtcggtaacgtccggtaacggtcgggtcggtacgtccgttcgttaccgggttcgggaccgggaacgggtaaccggtaaagggtacgtaacggtaacgtaaccggtaaaacggttcgtcgggtcggtaccgttacggtaaccctaaccggttactacggtttacgttccgttacccgttacccg

SEQ ID NO: 40241 - DNA, 869 bp, Homo sapiens
  misc_feature: GYAE6OF01EEZR9.30.27.C05.1.454.CMB.1.raw
  modified_base (203)..(203): a, c, t, g, unknown or other
  misc_feature (203)..(203): n is a, c, g, or t
tcagcacgctacgtcacgaccggtgctcgatttagacgcgatcgaagggtttgggggaggaactgctcagttaggacccagagggaaccatggaagcccccagctcagcttctcttcctcctgctactctggctcccagatgccaccggagaaagtgtgttgacacagtctccagccaccctgtctttgtctccaggggaaanagcccaccttctcctgcagggccagtcagagtgttggccactacatagctggtaccacagaaacgtgccaggcctcccaggctcctacactctactgatgctaagtaccgaaaacgggtccctcgtcggactactaccccgaagccccgtagggtttccgaacggttcggggaccgtaacggggttacggggtccgttacgggggaaaccgaaacgggttaaccctttacccgtaaacccgtttcccgtaacccgtaaacccctaaccgttaacccgttaacggttaaccggtacccgttaaacggtaaccggttaccccgttaaggtaaaaccggttttagtttttacgggtaaccgttttaaacggttttttaaccgtttaaccgtttacggtttaaccgtacgtacggtaacggtaccgggttaaccggacccggttaaacgggttcgggggtcccgggtttaggggttaccccgttaaccggttacccgggttttaccggggacccggggtaaaccgggggtaaaccgggtaaacgggttaacgtaaaccgggtaaacgttaaaccggtaaaacccggtaacggttacgggtcgggtaacccgtacggaaccccgtaaccgttacgttacggtttccggtttacccttccggttaacccccg

SEQ ID NO: 40242 - DNA, 173 bp, Homo sapiens; identical to SEQ ID NO: 40134
  misc_feature: GYAE6OF01EWDCA.30.27.C05.1.454.CMB.1.raw
  modified_base (173)..(173): a, c, t, g, unknown or other
  misc_feature (173)..(173): n is a, c, g, or t

SEQ ID NO: 40243 - DNA, 551 bp, Homo sapiens
  misc_feature: GYAE6OF01B39PJ.30.27.C05.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagcccaccttctcctgcagggccagtcagagtgttggcacctanatagcctggtaccacagaaacctggccaggctcccaggcctcctcatctatgatgcatccaaaagggcctctggcatcccagccaggttccagtggcaggtgggtctgggacagcttcactctccaccatcagtacgcctagacgcctaggtaaagtattttggactaggttttaactttactagtcagcaggtccgtagccgacgtggacgtgggctcgtacgtttcgggcgggacgggaccgaagggttagagtaacgtacgaaacgtaatggtggctagccgtacatctagtcttcgtaccg

SEQ ID NO: 40244 - DNA, 741 bp, Homo sapiens
  misc_feature: GYAE6OF01BV0Y2.30.27.C05.1.454.CMB.1.raw
  modified_base (203)..(203): a, c, t, g, unknown or other
  misc_feature (203)..(203): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtcctccaggggaaangccaccttctcctgcagggccagtcagtagtgtggcaccgtacatacgcctggtaaccaacaagaaacctggccgaacggcctacccgaggcctccgtcactctaatcgtaatgactacgtacccgaaaacgggtcctacgtgggacctacgttccccgacgtaccgtacgggtttaccaggttcgggaccgtaagggttcggggtacgtaggggtaccaaggtaccgtttccaacgttccgtacctaccgtaacgttcgaacggttacgtaccgtaacggtacgtaccgtaaggtaaacggttagttttacggacgttaagtttttaacgttaccgttgtaccgttacgacgtacggtcggtaacgtcgggtaacgtcggggtaccggttcgggtaccgttaccgttaaccggtttccggggaacgggtacgggtaacccgtaaggggtaacggtaccgtaaacgtaccgtaaacggtaacgttcggtaccggcgtacgccgtaaaccttcgttagttcgttacgttcgtaaccccg

SEQ ID NO: 40245 - DNA, 796 bp, Homo sapiens
  misc_feature: GYAE6OF01CDE2E.30.27.C05.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaaancgccaccttctcctgcagggccagtcagagtgttggcacctanatacgcctggtaccaacagaaacctggccaggctcccaggcctcctcatctatgatcgcactaccaaaacggggcctacgtcggcactccccgacgacccgacggttacgaaggtcgggacgtaacgggttcggggtacgttacgggggactaacgggtaacctttaccgaacccgtttccgtacctaaacccctaacgttaccgtaacgggttaacggtaccccttaagggtaaccggtacccgttaagggtaaaaccggttaagttttttacggtacccgtttaagttttttaacgttttaaccgtttacggttaccgtacggtaccgtaacggttaccggttaagggtcccggtaacggttacggggtccggttacggggaccctttaccgttaacgggttttcccgggggtacgggtaaccgggggtaacccgttaaaggggtaacgtaaggtaaacgttaaccgaaaaaccggtaacgttacggggtacggaccgttaacgcccgttaaccacgtttaccgtcggttaccctttcgttaaccccg

SEQ ID NO: 40246 - DNA, 175 bp, Homo sapiens
  misc_feature: GYAE6OF01C2NR7.30.27.C05.1.454.CMB.1.raw
  modified_base (173)..(175): a, c, t, g, unknown or other
  misc_feature (173)..(175): n is a, c, g, or t
tcagcacgctacgtcacgaccggtgctcgatttagacgcgatcgaagggtttggggggaagaggaagactgacggtcctcccaggagttcaggtgctgggcacagcggcctgggctgcctggtcaaggactacttccacgtagcgtgctgagcgggctggcaaggcgcatagnnn

SEQ ID NO: 40247 - DNA, 579 bp, Homo sapiens
  misc_feature: GYAE6OF01CP7NT.30.27.C05.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
tcagcacgctacgtcacgaccggtgctcgatttagacgcgatcgaagggtttgggggaggaactgctcagttaggacccagagggaaccagtcggaacgccccgaagctcaggcttctcttcctcctgctactctggctcccagatgccaccggagaaagtgtgttgacacagtctccagccaccctgtctttgtctccaggggaancgccaccttcncctgccagggccagtcagagtgttgcacctacatagcctggtaccaanagaaacctggccaggctcccaggctcctcatctatgatgcatccaaaaggcctactggcatccagccaggttcagtgcagtgggtctgggacagacttcgaactcgtcaccagtcagtacggcccttaggacgccgttagaagtacgttttgacgttagtttattacgtgtctagcagcgtagcgactggccgtagggcctcgtacgtttcgggacgggtacggaccgaagggtacgagagttacgaaaacggtaacttgggtcggtacgttcgggacctacccgtaacttccgttacgtcctttctaacccg

SEQ ID NO: 40248 - DNA, 645 bp, Homo sapiens
  misc_feature: GYAE6OF01BJH7U.30.27.C05.1.454.CMB.1.raw
  modified_base (199)..(199): a, c, t, g, unknown or other
  misc_feature (199)..(199): n is a, c, g, or t
  modified_base (315)..(315): a, c, t, g, unknown or other
  misc_feature (315)..(315): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctcagccaccctgtctttgctccaggggaangccaccttctctgcagggccagtcagagtgttggcacctacatagcctaggtaccaacagaaacctcggccaggctcccaggcctcctcatctatgatgcataccaaaagggcctntcggcactccagccagtcgagtggcaggtgggtcgtgggacaggtaccttcgacgtcctaccaaccgtatacgacggtacgtaccgtaacggtacgtacccgttaggtaaacgttagtttttacgacgtttaagttttaactttacgttcggttacagttccgaggtacgtacggaccgtacggttaggccgggttacgggtcttaccggtacggttttaccgggcgggaaccggggtacgaaagggtaacgacggtaacgtaccggaaaagtaaccgttaggtcggtcgtacgacctaaccgtataccgttcgtcgtttccgtaacccg

SEQ ID NO: 40249 - DNA, 205 bp, Homo sapiens
  misc_feature: GYAE6OF01CQUJP.30.27.C05.1.454.CMB.1.raw
  modified_base (171)..(205): a, c, t, g, unknown or other
  misc_feature (171)..(205): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggctacttccagtagcgtgctgagcgggctggcaaggcgcatagnnnnnnnnnnnnnnnnnnnnnnnnnnnnnnnnnnn

SEQ ID NO: 40250 - DNA, 178 bp, Homo sapiens
  misc_feature: GYAE6OF01D6659.30.27.C05.1.454.CMB.1.raw
  modified_base (174)..(178): a, c, t, g, unknown or other
  misc_feature (174)..(178): n is a, c, g, or t
tcagcacgctacgtcacgaccggtgctcgatttagacgcgatcgaagggtttggggggaagaggaagactgacggtcctcccaggagttcaggtgctgggcacagcggccctgggctgcctggtcaaggactacttccacgtagcgtgctgagcgggctggcaaggcgcatagnnnnn

SEQ ID NO: 40251 - DNA, 636 bp, Homo sapiens
  misc_feature: GYAE6OF01D1PWY.30.27.C05.1.454.CMB.1.raw
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctcgaggggaancgccaccttctcctgcgaggccagtcagtagtgttgcacctacatagcctggtaccaacagaacctgccagctccagctcctnatctatgatgcactaccgaaagggtccctgtggctactcccgagcctaggttcagtggacgtggtgggtcgtgggactagtacttcgactccgtacacctatcgaagtcgaccgtaagtacaccgtagtaaagttagttttgacgttaagtttacttacgttcggttactaggtctacggtacggtacggtccggtacgtcgggtcggttcgggtcttacggtacgtttaccgggacgggtacgggtaaccgtaaaggtaggtaacgaacgttaaccggtaaaaccggtaggttacggtcggtaccttacggacccgttacctaagttcccgttcgttctttccgtaacccg

SEQ ID NO: 40252 - DNA, 834 bp, Homo sapiens
  misc_feature: GYAE6OF01ACOU5.30.27.C05.1.454.CMB.1.raw
  modified_base (600)..(600): a, c, t, g, unknown or other
  misc_feature (600)..(600): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatcgccacggagaagtgtgttagacacagtctccacgcccaccgttgtacctttcggtcctaccggaaggggaacacgccctacctttctaccgtgaccgacgggcctacggtcgaggtacgttcggttacggcctaaccgttacacgttaacggtcccgttaacgggtaaacccaaaacgtaaccggtaaacccgtcggacccgtacgggtccctacccggacggtcccttaccctactaccttaccgtatacgtacttccggacctaaccgtaaaccggtaaacgggtcccttacggtacggtacctaccgtacccgaacgtaccgtaacggttcgtacggtcggacggtacgggttacggggtcggtacgggtaactacggttccttaccgaccttaccgtacaaccttagtaccgtaacgtaccgtacgtaacgtacgtaccgtaagttaaacgtttntttacgtacgtttaacgttttaacgtccgttagtacgaacgtacgtagggtacccgtaggacccggttacggtcgggtaccgggtcggtaccgttaccggtccgggttaccgggggaaggtaaccggggtaaccgtaaaggtacggaaaccttaccggaaaacgttacggtaccggtaggtccggtacctaacggaccttaaccggtctttacgtccttccgttacctaccccg

SEQ ID NO: 40253 - DNA, 838 bp, Homo sapiens
  misc_feature: GYAE6OF01CXYJS.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaagtgtgttgacacagtctccagccctaccctgttctttgtcctaccgaaggggaaacgacgccctaccttctccgtcgacgacgggccagtcagtagttgttcggaccacctaactagtacgtccgtacggtaacccaaacgaacgtaaacccgtcggacccgtacggccctacccgacggtcctccctactactacttactgtaactcgacctaaccgtaaccgaaaaccgggtccttaccgtacggacctaaccgtaccccgacggtacccgttacgggttaccgtacgggtacggtacggtaggggttccggggtacggtacgggtaacgtaccggttaccttaccgtaacccgttccgtaacccgaacctaacgttaccgtaacggtacggtacccgttaaggtaacccgtccgttaacggttaaacgtttacgttttaccggtaacgttttaaacgttttaacgttcgttacggttacgaacggtcgtaacgggtcgtacggtaccggtaacgtcggggtaccggttacgggtccttaccggttacgggttaccggggtaaccgggtaacgggtaaccggtaagggtaacgaaccggttaacgtaaacggtaaaccgtacggtacggtaacggtcctaacggtacctaccgtacgtttattccgttacttcccgttaccccg

SEQ ID NO: 40254 - DNA, 573 bp, Homo sapiens
  misc_feature: GYAE6OF01AXF71.30.27.C05.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgcccaccggagaaagttgtgttgacacagtctccagcccaccctgtctttgtctccaggggaanagccacctttcncctgcagggccagtcagagtgttgcacctantagcctggtaccaacagaacctggccaggctcccaggctcctcatctatgatgcatccaaaacgggctcgtggcatcccacgccaggttcagtggcagtgggtcgtgggacaggacttcactctacacactcagtacgtacctaggacncgtagagtatttgntagtttatactntcgtagcagtcgtacgcgtacgtcggccggtagggccttaccgtacgtttccgggcgggaacgggaccgtaacgggtagacggtataaccgtaaaccggaactcgggtggacgttccggactaccacttccgtcgttcgttccttaccccg

SEQ ID NO: 40255 - DNA, 740 bp, Homo sapiens
  misc_feature: GYAE6OF01D7WKR.30.27.C05.1.454.CMB.1.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccacggagaagtgtgttgacacagtctccagccaccctgtctttgctccgaagggaanacgcctaccttctacctgacacgggccagtcaaggtagttgttacggacctaacctanatacgcctacggtaaccaanaacgtaacgtcggaccgacggtcctaccgaggtcctacctactatctatgactgacaacgtaaccgaaaacgggtccttacgtcggaccacgtacccgacgtccgtaggttaccgaggtcggacgtagggttcggggtacgtacgggtactaacggtaccttcctaccgttctaaccgtaacctaacgtactaacggtacgtaccgtaaggtaccgtaccgttagtaaacgtttagtttacgacgtttaagttttacttacgtcgtagtacgtacgtaaggtccgtaggtccgtaaggttcggacggttcggtcccgttaccggtaccgggtttaccggggaacgggtaaccgggtaacggtaaaggttacggaacgtaacgtaaaccgtaaacggacgttagggtaccgaccgtacggtaccctaacgtacgttaccgttacgtttccgtccgttaaccccg

SEQ ID NO: 40256 - DNA, 764 bp, Homo sapiens
  misc_feature: GYAE6OF01E1XW1.30.27.C05.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (260)..(260): a, c, t, g, unknown or other
  misc_feature (260)..(260): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccacggagaaagtgtgttgacacagtctccagccacctgtctttgctccgaaggggaaangccaccttntcctgcagggccagtcagagtgttgacactacatagcctaggtaaccaanaagaaacctggaccaggcctacccaggctcctcatctatgatgacacgtaccgaaaaacgggtccctacgtacggacctacgtaccccaaggtaccccgtaagggtttccaacggttcggggacgttacgggttacggggttaccgggttacgggggaacctaacgggttacccttttcccgaaaccgttttcccgttaacccaaaccccttaagttacccgtaacgggttaacccgtacccgttaaacgggaaccggttaccccgttaaggttaaaaggttacgttttttacgacgtttaaacggttttttaagtttaaccgttgttacgaacgtacgtacggtacggttaaggccgtaacggtgggtaccggtgggtaccttacggtacggttttacgggcgggtaacggggaacccgtaagggagtaaacggaagtaaccgtaaacggtaacgtggtaggactacggactaaccgactttacgttcgtctttacgtacccg

SEQ ID NO: 40257 - DNA, 186 bp, Homo sapiens
  misc_feature: GYAE6OF01DK9GD.30.27.C05.1.454.CMB.1.raw
  modified_base (174)..(186): a, c, t, g, unknown or other
  misc_feature (174)..(186): n is a, c, g, or t
tcagcacgctacgtcacgaccggtgctcgatttagacgcgatcgaagggtttggggggaagaggaagactgacggtcctcccaggagttcaggtgctgggcacagcggccctgggctgcctggtcaaggactacttccacgtagcgtgctgagcgggctggcaaggcgcatagnnnnnnnnnnnnn

SEQ ID NO: 40258 - DNA, 671 bp, Homo sapiens
  misc_feature: GYAE6OF01DIKDL.30.27.C05.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagcacgctacgtcacgaccggtgctcgatttagacgcgatcgaagggtttgggggagggaactgctcagttaggacccagagggaaccatggaagccccagctcagcttctcttcctcctgctactctggctcccagatgccaccggagaaagtgtgttgacacagtctccagccaccctgtcttgtctccgaggggaangccacttctcctgcagggccagtcagagtgttggcacctacatagcctggtaccaanagaaacctgcccaaggccttcccaggcctcctacactctagtgatcgacgacgtaccgaaaacggtccctacgtgggaccacgtaccccaggacctacggtttcgaaggtcggacgtaggtacgggttcggtacgggtacacgttaccgttacgtacgttctacccgtactacgtaccgaaggtacgacccgttaaggaccgtaccgtaagaacggtttaagttttcgacgtttaagtttacttacgttcgtacgtagtactacgggtacgtacggtacgtcggtaggtcggtcggtccttaccgtaggttccgggacgggtacgggtaaccgtaagggtacggagtacctaacggtaaacgtacggttggcgtacgtacgacctacgtacgttctgttccgttcttacccg

SEQ ID NO: 40259 - DNA, 633 bp, Homo sapiens
  misc_feature: GYAE6OF01BDO4I.30.27.C05.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (561)..(561): a, c, t, g, unknown or other
  misc_feature (561)..(561): n is a, c, g, or t
  modified_base (608)..(608): a, c, t, g, unknown or other
  misc_feature (608)..(608): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccatcctgtctttgctccaggggaanacgccaccttctcctgcagggccagtcagagtgttggccacctacatacgcctggtaccaacagaaacctggccaggcctcccgaggcctccncgtatctatcgtatcgactacgtaccgaaacgggtccctcgtcggacacgtccccgagtcccgtaggttcacggtggcgtacgggttgggtcgtacgggacacgtacctttaccactcctacgaccacgtacgagttacgccgttaaggacgtacctaggtaacgttagttttacgactttaagtttacgttacgtcggttaccgagtccgtagtaccgtagtccgtaagtcgggtacggtcggtaccgttcgttacggttaccgggnggtaccgggaaccgtaggtacgagtacgtacgaacgtacggtgcgtntcgacactattcgtcgtcgttaccg

SEQ ID NO: 40260 - DNA, 720 bp, Homo sapiens
  misc_feature: GYAE6OF01AMUA7.30.27.C05.1.454.CMB.1.raw
  modified_base (200)..(200): a, c, t, g, unknown or other
  misc_feature (200)..(200): n is a, c, g, or t
  modified_base (249)..(249): a, c, t, g, unknown or other
  misc_feature (249)..(249): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccacctgtctttgctccgaggggaancgcctaccttctcctgcgagggccagtcagtagttgttcggcaccctanagtagccgtaggtaacccaacagaaacctggaccaggcctaccgaggtctccctcagtctatgatgcaactaccgaaacggcctcgtcggacactccccgaagccgtacgggtttcacggttcggactagggtcggggttctagggggactacggtaccttacgaccctacttaccgaccttaacgtacaaggttacgtacccgtaggacgtccgttagaacgttagttttcggatttacgttttattaccgttgtactacggctaacggtcgtacgtaccggtacggttggggtccgggttacgggtcccttaccggttaccggtttaccggggaccggggtaacgggtaacccggtaaaggggtacgaacggttaaccttaaaccggaaacggttaaccgttgggtacccggtgtaacccggtacgttaacccgtacgtttacgttccggtttcgttacccgttacccg

SEQ ID NO: 40261 - DNA, 831 bp, Homo sapiens
  misc_feature: GYAE6OF01EH61Z.30.27.C05.1.454.CMB.1.raw
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
tcagcacgctacgtcacgaccggtgctcgatttagacgcgatcgaagggtttgggggaggaactgctcagttaggacccagagggaaccatggaagccccagctcagtcttctcttcctcctgcctactctggcctcccagatcgccacggaagaagtgtgtagacacagtcctccgagccctaccgttgttcctttgtcctaccggaaggggaaancgtccctaccttccgtcctgccgacggcagtcgaagtgtgttcgacctaccgtanatacgcctacggaaccaagaacgaaccgtcggaccgacggcctacccgacggtcctactacagttcctagttagtactcgaccgtaacgtaaccggtaaacggtcccgtagacggtacctaccgtacccgacgtaccgttacggtaccgtaggtcggtacgtacgggttacgggtaccggtaaggtaaccgtacggtaacctttaccgacgttaccgtaccgtaacctacgtacgtaacggtacgtaccgtagtaccgtacgtaaggttaactttacggtttacgtacgtttaacgttttaacgttaccgttaggtacccgtaagtaccgtaacgtccgggtaacgtaccggttacgggttcgggtaccgggtaccggttaccgtaaccggtttaccgggtttaccggggacgggtaaacccgggtaacggtaaacgggtaaccggtaaagtaaacccggttaaaccggtaaacggtaacgggttacggtaccggtacgttacccggtaaccttaaaccggttgttacccggtttcgttacccgttaaccgttaccccg

SEQ ID NO: 40262 - DNA, 659 bp, Homo sapiens
  misc_feature: GYAE6OF01CQD5E.30.27.C05.1.454.CMB.1.raw
  modified_base (204)..(204): a, c, t, g, unknown or other
  misc_feature (204)..(204): n is a, c, g, or t
  modified_base (317)..(317): a, c, t, g, unknown or other
  misc_feature (317)..(317): n is a, c, g, or t
  modified_base (381)..(381): a, c, t, g, unknown or other
  misc_feature (381)..(381): n is a, c, g, or t
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagcccaccctgtctttgtctccgaaggggaanacgccctaccttctcctgcgagggccagtcagtagttgttcggcctaaccgtacattacgcctaggtaacccaaagtaacgaaaccctgggacccaggcctcccacggctccncatctatgatgacataccgaaaacgggtcctcgtaggcctactcccagcctaggttcgagtcgngaggtcgggtcgtgggacagtactcacgtctacacctatcaagtcgaccgtagcgtacctagtaaagttnttttcggacttaacgttttnttactggtactagcgtacgtacggtagaccgttacggtcgggtacggtcgggtaccttcggttaccggttcgggaacgggaccgggtaaaccgtagggtaacgtaacggacgtaaacgaaacgttacggtagtccggtacgtacgacccgttaaccgtacttccttacggttccttcgttaaccccgg

SEQ ID NO: 40263 - DNA, 790 bp, Homo sapiens
  misc_feature: GYAE6OF01CMEQR.30.27.C05.1.454.CMB.1.raw
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccacggagaagtgtgttgacactagtcctccagcccaccctgttctttgtcctaccgaaggggaacncgccctaccttcncctgcgacgggccagtcaggtagttgtcgactacctatatacggccgtacggtaaccaaagacgtaaccgtcggaccgacggtcctacccgacggtcctacctactactactagtacgagttcgacctacgtaaccgaaacgggtccctacgtcggtacctaccgtacccgacgtaccgtacggttacgacgggttaccggacggtacgggtcgggttacggtagggaacctacgttaccttacgtaccgttaccctacccgtaaccgtaacttaccggtaacgttacgtaccgtacggtaccgtaccgttaacggtaaacgttttacgtttacggttaacgtttaacgttttaacgtttacgttacgtacgttaacgtcggtaacggttccggtaggaaccggtcggtacgggttccgggttacggtaccgtaccgttaccgggtacgggaccgggtacgggtaaccggtaagggtaccggaacgtaaccgaaccggtaaaccgttaggtacggtcggtaccgtaccggaccgtacttacgttacgttccttccgttaccgttacccc

SEQ ID NO: 40264 - DNA, 798 bp, Homo sapiens
  misc_feature: GYAE6OF01BJILV.30.27.C05.1.454.CMB.1.raw
  modified_base (283)..(283): a, c, t, g, unknown or other
  misc_feature (283)..(283): n is a, c, g, or t
tcagcacgctacgtcacgaccggtgctcgatttagacgcgatcgaagggtttggggagaactgctcagttaggacccagagggaaccatggaagccccagctcagcttctcttcctcctgctactctggctcccagatcgccaccggagaagtgtgttgacacgagtcctccgagcccacccgttgttccttttcgtaccgtaccgaaggggaaacgacgccctaccctttctccgtcgccgacggcccaggtcaggtacgttgttacggaccaaccgttacngtaaccgccgtacggaacctaaacgagtaacccgtacggaccgacggtaccctcccgaaggtccctccaccttacttacctattcgtaacgtcgtacctaaccgtaacccggtaaaaccggtcccttaccgtcgggtacctaccgtaccccgtacggtaccccgttaggtaccgtacggtcggtacgtagggttcgggtccgtacgggtactacggttacccgttcgtacccgtccttaccgaccttaacgtacggtaacgttccgtaaccgtacggtaacgtaccggttagttaaaacgtttgtttaacgtactttacgttttaacgttaccgttagtacggtactacggacgttacggtacggaccggtacggtcggtgggttaccgtccgttacggttaccggtttacggggaacggtaacggtaacggtacggtaacgacgtaaacgtacggtaaacgtcggtaggtcgtacgaccgtaccgtactcgttactccgttctaccgttacccg

SEQ ID NO: 40265 - DNA, 760 bp, Homo sapiens
  misc_feature: GYAE6OF01ATEHZ.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagcccaccctgttctttgtctccgaaggggaaacgagccaccttcctcctgcagggccagtcagagtggttggccacctacatacgcccgtaggtaaccaacgaacgaaaacccgtcggacccgacggccttccccgaacggtcctccctctacttcctatgatcggacactaccgaaaacgggcctcgtcgctactcccacgccgtacggtcgaggtcggtacgaggtggggtcgtgggtacgacgtaccttacgaccgttccctacaccgtactacgacgtacgacctagacggtcctaaggtaacgtttagtttacgtacgtttaacgttttactttacgttggttacgacgtacggtaacggtacggtttacggaaccgggttcggtcggggtacccgggttcgggttaccgttacccgttaaccggggtttcggggaacccgggggtaacgggtaaaccgggtaaacggggtaacggtaaacggtaaacgtaaccggtaaaacggtaaccgggtgggtttccggaccggtaccggaccgtaaccgttacggttaccttacggttacccttacccgttaccccg

SEQ ID NO: 40266 - DNA, 187 bp, Homo sapiens
  misc_feature: GYAE6OF01C1PGA.30.27.C05.1.454.CMB.1.raw
  modified_base (157)..(157): a, c, t, g, unknown or other
  misc_feature (157)..(157): n is a, c, g, or t
  modified_base (174)..(187): a, c, t, g, unknown or other
  misc_feature (174)..(187): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggtctacttccacgtagcgtgctgagcgggntggcaaggcgacatagnnnnnnnnnnnnnn

SEQ ID NO: 40267 - DNA, 843 bp, Homo sapiens
  misc_feature: GYAE6OF01CQCXQ.30.27.C05.1.454.CMB.1.raw
  modified_base (237)..(237): a, c, t, g, unknown or other
  misc_feature (237)..(237): n is a, c, g, or t
tcagcacgctacgtcacgaccggtgctcgatttagacgcgatcgaagggtttgggggaggaactgctcagttaggacccagaggaaccatggaagccccagctcagcttctcttcctcctgctactctgcctccagatgcctacggagtaacgtgtgttacgacacagtcctccgacgccctacccttgttacctttgtccctaccggaaagggaaacgcctcccttaccgtttccnccgtacggaccgtacgggaccctaaggtcgtacggtaggttcgttcggacctaaccgtacagttaccgaccgtacggtaacccaaagaaccgtaaccggtacggtaccgacggtacccgtaccgacggtcctaccttaccgacttaccgtatacgtacgacgtacgaacggttaaccgaaacggtcctacgtacgaccctaccgtacccgacggtacccgttagggtaccgtaggtacggtacggtggttacggggtcgtaccgggtaacacgtttacccttacgtaccgtttaccgacctaaccgttagtacggtacgtaccgtaaccggtaacggaccgtttaacgtaggttaaacttttacgttttacgtaacgttttaacgtttattcccggttacgtaacgaccggtacgtacggttaaccgagttaccgggtaggttcggacgggtttacgccgttacggggttacccggtaggggttaacccggagggtaaacgtaagggacgtaaacggtaccgtaaacggtaacggtaggtttaccggcggtacctaacggcgttaaaccgtttggtacttaacccgggtttccttaacgtaccccg

SEQ ID NO: 40268 - DNA, 766 bp, Homo sapiens
  misc_feature: GYAE6OF01CK3KN.30.27.C05.1.454.CMB.1.raw
  modified_base (211)..(211): a, c, t, g, unknown or other
  misc_feature (211)..(211): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctgctccagatgccaccggagaaagtgtgttagacacgagtcctccacgcccaccctgttctttcgtcctaccgaaggggaaancgccctaaccttctcctgcgacggcagtcagagtgttcgacctacctacagtacgccgtaggtaccaacacgaacctcggaccgtacggcctaccgacggcctacctacacttactacgtagatcgactacgtaaccgaaacgtcctacgtcgactactacccgagtccgtacgtcgtacggtcgacggtaggtcgggtacgtagggtactcgtaacttcctacgtacctaccaaccgtacttaccgagtacgaccgtaagaccgttacgtaaggtaagtttcgtttacgacgttttaacgtttacgtacgtaccgttacgtacgacgtacgtaccggtacggtaccggtacggttaacggtcgggttaccgtaccggttaccggttacccggggttaaccgggtaacccggggtaacgggtaaacccgggttaagggaagtaaaccgggtaaacgtaaacccggtaaagggtttaccggacggttaaccgggtaccgtacgaacccgttaacgttaccgttacggttttaaccttcccgtaccctttacccccg

SEQ ID NO: 40269 - DNA, 790 bp, Homo sapiens
  misc_feature: GYAE6OF01CRIKL.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctcggcctccagactcgccgaacggagtaagtgtcgtagacacacgtcaccacgccctaccttgttcttgtaccgacggaaggggacacgccctaccttccgtccgcgccgacggtccacgtcgagttacgttcggtacgacctaaccgtatacgtaccgtaccggtacgtaacccgaaacgtaaccggaaaccgtccggacccgtacggacccctacccgacgtccctacctactaccttactacggacgtaacgtacctaacgtaaccggtaaacccggtaaacggggtcccctacggtaccgaccctaaccgcccgtacggtacggtacggttacggacggtaccggtggtacgggttcgggtacggtaacggtacctcgtaaccctctacccttacaccgtacgttacacggtccgtacgtaacgagtacgtacgtaagttacgttagttacgttaacgttactttacgtcgtacgtagaccgtacgtaccggtacggtcgtacggtcggtacgggtaccggttcggtaccggtacccggtagggttacccgggacgggttaaccggaacggtaaacgggtacaacggtaacgtacggtaaaccggtgtaaccggtcggacgtacgactccgttacttacgttcgtccgttctaccccg

SEQ ID NO: 40270 - DNA, 790 bp, Homo sapiens
  misc_feature: GYAE6OF01B7NRK.30.27.C05.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagcccacctgtctttgcctccgaaggggaancgccctaccttcncctgcgaggccagtcagagttgttggcaccgtacattaggcctaggtaaccaacacgtaaacctcggaccgaggcctacccgaggcctcctcattctatgactcgacacgtaccgaaacggcctacgtcgcaccgtcccaacgtccgtaggttccgaggtcgggtacgtacgggttcggggtacggttcgggaacgacggttaccttcgtacccttacctccgtaaccgtacgtacgaaggttaccgtaccgtaacggacgttaccgtaaggttaacgtttacgttttacgtactttacgtttttaacgttacgttcgtacgtagtaccgtaacgtcggttaccggtacgtaccggttcggggtacggttcgggtaccgtttaccggttaaccgggttttaccggggaccggggttaaccggggaacccggtaacggggtaaaccggttaacggtaaaccggtaacccgggttaaaacgggtaacgttaccggggttacgggacccgttaccgggtaaaccctttaccgaaccggtttaccggtttaccgtttaacccgtttccgttaaccccc

SEQ ID NO: 40271 - DNA, 821 bp, Homo sapiens
  misc_feature: GYAE6OF01ESB0O.30.27.C05.1.454.CMB.1.raw
  modified_base (204)..(204): a, c, t, g, unknown or other
  misc_feature (204)..(204): n is a, c, g, or t
tcagcacgctacgtcacgaccggtgctcgatttagacgcgatcgaagggtttgggggagggaactgctcagttaggacccagagggaaccatggaagccccagctcagcttctcttcctcctgctactctggctcccagatcgccaccgggagaaagtgtgttgacacagtctccagccaccctgttcttgtctcgagggaaangccaccttctcctgcacgggccagtacaggagtgttcggactacctacatacgccgttacggtaaccaacgaacgtaaaccgtcggacccgaacggccctacccgagggtcctaccgtacacgttacctagtcggatacggacctaacgtaaccggaaaacgggtcctacgtcgggacacgtacccgtagacccgtaggttacggaaggtcggacgtacgggttcggggtacgtacggggtacaaggttaccctttacgacccgtttaccgtacctaaacccgtagttaccgtaacggttaaccgtaccgtaacggtaaccgtaaccgtttaacgggttaaacgttttacgttttcggtaacccgttttaagttttaacgtttaacgttagttaccggtaacgttacggtaccggttaggttaaccgtaccggttacggtaccgggttaccgggtacgggttactacccggtttacgggtttaccgggaccggggttaacgggtaacgaagggtttaacgggaacgtaacggtaacgaaaccggtacggtttaggtcggtaacccgtagtaccccgtactaacggtttcccttacggttcccgttcccttaaccccg

SEQ ID NO: 40272 - DNA, 810 bp, Homo sapiens
  misc_feature: GYAE6OF01DEXIK.30.27.C05.1.454.CMB.1.raw
tcagcacgctacgtcacgaccggtgctcgatttagacgcgatcgaagggtttgggggaggaactgctcagttaggacccagagggaaccatggaagccccagctcagtcttctcttcctcctgctactctggcctcccagtactgcccgaacggagtaaagtgtgttagacacgtacgtcctccacgccctacccgttgttccgtttcgtaccgtaccggaaaggggaaacgaccgtccccgttaaccttccgtaccgtcggacggaacggggtaccctaaggtacgaggttaacggttggtttacggaccctaccgtacgtaacgtaccggtaccgtacggtaaaccaaccgaaaccgtaaccgtcggaccgacccgtccgacccgtacggcccttacccgtacaaccggttactagtacgtataccgacgttaaaccgaaccggtaaaaccggtcccgtccggtacggtacctaaccgtacccccgaggtaacccggtggtaacgtacgggtacggtacggtacggggtacgggtttcggaaccggtacgtacgtacccgtactaaccgtccgtaccctagtaccaggacgtacgtacgtacgacgtaccgtagtaacgttagtcgttatacgttattcgtgtacacgtacgtacgtcggagtcggacgttcgggcgtacggtccgttacgtccgggttagggaccgggtaaggtacggtaaaggacggtaactaaccggtaaccgtacgggtagtacggtacgtcgtaccgactacggttacctacgttcgttactcgttacccccg

SEQ ID NO: 40273 - DNA, 180 bp, Homo sapiens
  misc_feature: GYAE6OF01CM6CQ.30.27.C05.1.454.CMB.1.raw
  modified_base (175)..(180): a, c, t, g, unknown or other
  misc_feature (175)..(180): n is a, c, g, or t
tcagcacgctacgtcacgaccggtgctcgatttagacgcgatcgaagggtttggggggaagaggaagactgacggtcctcccaggagttcaggtgctgggcacagcggccctgggctgcctggtcaaggactacttccacgtagagtgctgagcgggctggacaaggcgcatagnnnnnn

SEQ ID NO: 40274 - DNA, 737 bp, Homo sapiens
  misc_feature: GYAE6OF01DF5ZA.30.27.C05.1.454.CMB.1.raw
  modified_base (165)..(165): a, c, t, g, unknown or other
  misc_feature (165)..(165): n is a, c, g, or t
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
  modified_base (344)..(344): a, c, t, g, unknown or other
  misc_feature (344)..(344): n is a, c, g, or t
tcagcacgctacgtcacgaccggtgctcgatttagacgcgatcgaagggtttgggggaggaactgctcagttaggacccaggagggaaccagtggaagccccagctcagcttctcttcctctgctactctggctcccagatgccacggagaaagtgtgttgacanagtctccagccaccctgtctttgtctaccgaaggggaaancgcctaccttctccgtgcgacgggccagtcagacgtgttcgcactanatacgcctaggtaaccaacgacgaaccgtggaccgaggcctccgaggcctaccgtcatctatnatgctactaccgaaaggcctgtcgctacnccagcctagtcgagtcgacgtaggtcgggtcgtggactacgtacttccactcctacacgtctacacgtacgtccgtagacgtacctagtaacgttagttttacgtacgtttaagttttaacttaccggttcgaacgtacgtacggtaacggtacggtacgtccgggtaaccggttcgggtccgggttcggttaccccttaccggtttaccgggtttaccgggggaacgggtaacccggggtaaacccgtaaggggttaaccgggtaacgtaaaccggttaaaacccggtaaaacgggttacccggttacgggttcgggtaaacccggttacgtacccgtaaaccccgttacggtttacccgttaccgtttccccgttacgtttaacccccccg

SEQ ID NO: 40275 - DNA, 184 bp, Homo sapiens
  misc_feature: GYAE6OF01EM336.30.27.C05.1.454.CMB.1.raw
  modified_base (176)..(184): a, c, t, g, unknown or other
  misc_feature (176)..(184): n is a, c, g, or t
tcagcacgctacgtcacgaccggtgctcgatttagacgcgatcgaagggtttgggggggaagaggaagactgacggtcctcccaggagttcaggtgctggggcacagcggccctgggctgcctggtcaaggctacttccacgtagcgtgctggagcgggctggcaaggcgcatagnnnnnnnnn

SEQ ID NO: 40276 - DNA, 198 bp, Homo sapiens
  misc_feature: GYAE6OF01DJ5VY.30.27.C05.1.454.CMB.1.raw
  modified_base (175)..(198): a, c, t, g, unknown or other
  misc_feature (175)..(198): n is a, c, g, or t
tcagcacgctacgtcacgaccggtgctcgatttagacgcgatcgaagggtttggggggaagaggaagactgacggtcctcccaggagttcaggtgctgggccacagcggccctgggctgcctggtcaaggctacttccacgtagcgtgctgagtcgggctggcaaggcgcatagnnnnnnnnnnnnnnnnnnnnnnnn

SEQ ID NO: 40277 - DNA, 216 bp, Homo sapiens
  misc_feature: GYAE6OF01CHKO7.30.27.C05.1.454.CMB.1.raw
  modified_base (194)..(216): a, c, t, g, unknown or other
  misc_feature (194)..(216): n is a, c, g, or t
tcagcacgctacgtcacgaccggtgctcgatttagacgcgatcgaagggtttggggggaagaggaagactgacggtccctcccaggagttcaggtgcgtgggcacaggccggcccgtgggctcgccgttggtacaaaggtctacttccacgtgcgtgcgtggaggccgggctagggaccaaggcctacaagtgnnnnnnnnnnnnnnnnnnnnnnn

SEQ ID NO: 40278 - DNA, 850 bp, Homo sapiens
  misc_feature: GYAE6OF01EMHOC.30.27.C05.1.454.CMB.1.raw
tcagcacgctacgtcacgaccggtgctcgatttagacgcgatcgaaaggggtttgggggaggaactgctcagttaggacccagagggaaccatggaagccccagctcagcttctcttcctcctgctactctggcctccagatcgccaccggaagtaaagtgtgttagacactagtcctaccacgccctacccttgttcctttacgtccgtaaccggaaagggggaaaacgaccgtacccttacccttccgtacccgtggaccgacgggtaccctaaggtaccgagtacgggttgttacggaccctaacctaactacgttacgaccgtacggtaaaacccaaacgtaacgtaaaacccgtcgggaacccgtacggtacccgtacccgtacggtcccttaccctacgtaacttaccgttagtacgtaagtacgtacctaaaggttaaccccggaaaacgggcccttacggacggtacccaactcccgaacgtaccgtaggtaccgtagggtcgtacggtacggggtcgggttacggtacgggtaacgtacgttaaccgtccgtaacctacgtacctaacgtactaccggtaacgttacggtacgtaacgtaccggtactacggtaagttttaacttagttaacttaagtttaacttacggttagtactaggtactacgggtaaccttaccgggtagtacgggtcgggtccggtacggtcgttaccgttaccgggttacgggacccggggaaacggtaacggaaaccgggttcaaacggtaacgtaaccggtaaacgtaccggtagtaccgtacgtacgacctacgtacttacggttccttacgttctacccg

SEQ ID NO: 40279 - DNA, 724 bp, Homo sapiens
  misc_feature: GYAE6OF01AUNT7.30.27.C05.1.454.CMB.1.raw
  modified_base (176)..(176): a, c, t, g, unknown or other
  misc_feature (176)..(176): n is a, c, g, or t
  modified_base (221)..(221): a, c, t, g, unknown or other
  misc_feature (221)..(221): n is a, c, g, or t
tcagcacgctacgtcacgaccggtgctcgatttagacgcgatcgaaggggtttggggggagggaactgctcagttaggacccaggagggaaccatggaagccccagctcagcttctcttcctcctgctactctggctcccagatcgccaccggagaagttgtgttgacacagttcncagccatcctgttcttgctacgaggggaaatcgcctacttctccngcgcggcctagtcagtgtcggtcgaccacgtactgtacgtctacggtaaccacaacgtaaccgtcggccgtaacggtccctaccggacggttcctcctacgtactacttagtagacgtccgtaccgacttaacccgggaaaacggtcccggtttactcgggtaccgtaccttaccccggaccgtacggttacggttaccgtacggtcgggtacgttacggggtacggggtacggtacggtacccgtaagtccttaccggtaccttccgtacgtaccgacgtacgtactacggtaccgtagtaccgtccgtagtacgttaagtcgtacgttacgtttagtcgttacgtacgtcgacgacgtacgtcggtactagggtcggtcggtcggtaccgttacgtcggttaccgggacggacgggtaagtacggtacggacgtacggtaaccggaagttaccgggtgttcgggactacggaccgtactaccggtcttcggttccctccgg

SEQ ID NO: 40280 - DNA, 978 bp, Homo sapiens
  misc_feature: GYAE6OF01CVJZW.30.27.C05.1.454.CMB.1.raw
  modified_base (243)..(243): a, c, t, g, unknown or other
  misc_feature (243)..(243): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgactactctcggcctacccagactcgacccgaccggaagaagtgtgttacgacacagtcctaccgacgcccacccgttgttctttgtccgtaccggaaggggaacgcgccctaccttctcgngacgcgggtacagtacaggtacgttgtcggacctaaccgtactacgttaccggaccgttagggtaaacccaaacgtaaaccggtaaccccggttaccgggacccgaaccgggtacccctaccccggtaaccggtaccccttacccgtaccgtaccttaccgttaacggttacgtacgttacggaacccgtaacccggtaaaacccgggtaaaaccggtccccgtttaccggacgggtacccctaaccgttaccccccgggaacgttaccccggttaaggggtttaaccgacggggttaacggtaccggttaaccgggggtttcgggttaacccggtaggggtaaaccttaccggtttaaccctacggtttaacccgttactacccttaaccggtataaccggtacggtacgtaccgtaacgtaccggtccgttaagtaaacgtttacgtttacgttaagttaacgttttactacgttacgtacgacgtaacgtacggtcgtaacccgggtgtaccgggttacggtaccggggttacggttacccttacggggtttacccgtttacggggggaaccccggtaaggggttaaccccgtaacggggtaaagtaaaccggtaacgtaaaccccggtaacgggttaaacggttacgggtaccggtttaccgaaccccgggtactttaacccgttaacgttcccgggtttaactttccccctttacgggtttaaccccccg

SEQ ID NO: 40281 - DNA, 255 bp, Homo sapiens
  misc_feature: GYAE6OF01BHNQJ.30.27.C05.1.454.CMB.1.raw
  modified_base (149)..(149): a, c, t, g, unknown or other
  misc_feature (149)..(149): n is a, c, g, or t
  modified_base (166)..(166): a, c, t, g, unknown or other
  misc_feature (166)..(166): n is a, c, g, or t
  modified_base (170)..(171): a, c, t, g, unknown or other
  misc_feature (170)..(171): n is a, c, g, or t
  modified_base (173)..(174): a, c, t, g, unknown or other
  misc_feature (173)..(174): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (180)..(255): a, c, t, g, unknown or other
  misc_feature (180)..(255): n is a, c, g, or t
tcagcacgctacgtcacgaccggtgctcgatttagacgcgatcgaagggtttgggggggaagaggaagactgacggtcctcccaggagttcaggtgctgggcacagcgccctgggctgctggtcaaaggctactcacgtgctgctgagngggctggcaaggtccgnatanngnncnancnnnnnnnnnnnnnnnnnnnnnnnnnnnnnnnnnnnnnnnnnnnnnnnnnnnnnnnnnnnnnnnnnnnnnnnnnnnn

SEQ ID NO: 40282 - DNA, 703 bp, Homo sapiens
  misc_feature: GYAE6OF01BUQCD.30.27.C05.1.454.CMB.1.raw
  modified_base (206)..(206): a, c, t, g, unknown or other
  misc_feature (206)..(206): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagcccaccctgtctttgtctccgaaggggaaagngccctaccttctcctgcagggccagtcagagtgttggcacctacatacgcctggtaccaacagaacctggccaggcctcccgacggcctcctcacgtctatgatgacactaccgaaaggtcctacgtcggacacgtcccgacgtaccgtacggttcgaacggtcggacgtagggtcggggtacgtacggggaactacggttacctttctacccgttcctaaccctaacctaacgttaccgaacggttaccggtacctaacggtacggtaccgttaacggtaaagtttagttttacgtacgtttaagttttaacgtttaactcggttaccgagtacgaacggtcgtacggccgtacggtggtccgggtacgggtccgttacggttaccgttcggggaccgggtacgggaaccggtaacggaggtagaaacgtaaccgtaaacgtaggtacggtcggtacgtcgtacctactacttcgtacgttccttacgttaccccg

SEQ ID NO: 40283 - DNA, 652 bp, Homo sapiens
  misc_feature: GYAE6OF01BAY57.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaaagacgcctaccttctcctggcgacgggccagtcagagtgttggcacctacatagccgtcggtaaccaacgaagaaacccgtggccaacggcctcccgaggcctccgtcactctatgatgcataccgaaaacggtcctacgtgcactcccgagtccgtaggttcaggtcggcgtaggtgggtcgtaggacgacgtccgttacactctaccaacgtacgtacgtacgtacgaccgtaagtacgcctaggtaacgttattttacgcgttaagttttaactcgttcgtacgtgtacgagtacgtagtccgtacgtcggtcgtcggtactcgtacgtttaccgggcgggtaacgggaaccgtaagggtacgtaacggtaacgtaaccgaaacgtagttcggtacggtaccgtacgaccgtaaccgtacgttacgttccgttccgttaccttacccg

SEQ ID NO: 40284 - DNA, 971 bp, Homo sapiens
  misc_feature: GYAE6OF01C1DEY.30.27.C05.1.454.CMB.1.raw
  modified_base (95)..(95): a, c, t, g, unknown or other
  misc_feature (95)..(95): n is a, c, g, or t
  modified_base (121)..(121): a, c, t, g, unknown or other
  misc_feature (121)..(121): n is a, c, g, or t
  modified_base (206)..(206): a, c, t, g, unknown or other
  misc_feature (206)..(206): n is a, c, g, or t
tcagcacgctacgtcacgaccggtgctcgatttagacgcgatcgaagggtttgggggaggaatgctcagttaggacccagagggaaccatggaanccccagctcagcttctcttcctcctnctactctgctccagatgcccaccggagaaagtgtgttagacacagtctccagcccacctgtctttgtctaccgaagggaaagacnccctaccttccgtcctgaccgacgggaccagtccgaagtagttcggttacggacctaacccgtaacaagtacgtcccgttacggtaacccaaaacgaaacggtaaacccgttacggaccccgaacggtaccccgttaccccgaacgggtacccttacccgttaccgtaactttaccgttaagtacggtaacgtttacgaaccgtaaccgttaaacccgaaaaaccggggtaccccttacggttaccgggaccttaacccgttaccccgaacggtacccgtaacgggtttaccgaagggttaccggtacggtacgggttacggggttacgtacggggtaacctaacggttaccttaacgtaccctccgttaacaacccgtaacgttaacgtaacgtaccggtacctaaacgggtaccgtaaccgttaagtaaagggtttaacttttttacgggaaacttttaacgggtttttaactttaacgttacggttacccgaacggtaccgtaaacgggtttaccgggtaaccggtaccggtttaacccgggttacggggtcccgggtttaccggggttacccgtttacccggttacccggggtttttaccggggaaccgggtaacggggtaaacccgtaaaaggggttaaccggaacgttaaacgtaacccgggtaaaaacgttaccgggttacgggtaaccgggtacctacggtaacccgtaacccttaacggtttcccgttacgtttacccgttcccggttaaaccccg

SEQ ID NO: 40285 - DNA, 1131 bp, Homo sapiens
  misc_feature: GYAE6OF01ADVC1.30.27.C05.1.454.CMB.1.raw
tcagcacgctacgtcacgaccggtgctcgatttagacgcgatcgaagggtttgggggaggaactgctcagttacggacccagagggaaccatggaacgccccagctcagcttctccttcctcctagctactctcggcctaccagctcgcccgaacggagtaagtggtagtacgacctacgacgtccaccgacgccctacccgttgtttcctttcggtacccgtaaccgggaaaggggtaacgaccgtacccctaccctttccgtcccgtagaccggaccgggacccgtagtaccgtaaggtaggttcggtttaccggacctaaccgtaacgtacgttaaccggtccggtaaccggtaaaccccgaaaaccgtaaaccgggtaaaacccggtccggggaaccccgtaccggggtaccccttacccggacccggtaaccttccctaaccgttacttacgttaaccgttgtaaccgtaccgaaaccgttaaccgtaaaacccggtaaaaccggtccgtttccggtaaccgtcccgtaacccggttaacccgtaccggtacccgttaggggttaccggtacgggtagggttaccggtacgggtcccgggttaggaaccgggtaactttaaaccggttaccgttaccttaccggtacctaaacccgtaacgtaaccgtacggttaaccgtaaccgtaccgttaaccgtacggtaaccggttacggtttaaacggtttaacgttttacgttaaaccggtttttaacgtttaaccgttaacccgggttaacgtttaaccgggtaacgttaccgggtaccggttaaccgggaccggggttaacgggttacgggttcccggttaccggggttaacccgggttttacccgggttaaccgggttttccccggggttaaaccggggggtaaccggggttaaacccgggttaaaccgggttaaaacggggtaagtaaaccccccgggttaaaagggtaaacccggttaaaaccgggtttaccggggtttaaccccggttacggaacccggttaacccgttaaaccccgttaacccgggttttaaccgtttcccggttttaaccccgtttaacccccgtttaaacccgttttaacccccccccgg

SEQ ID NO: 40286 - DNA, 185 bp, Homo sapiens
  misc_feature: GYAE6OF02IMFI9.30.27.C05.1.454.CMB.1.raw
  modified_base (171)..(185): a, c, t, g, unknown or other
  misc_feature (171)..(185): n is a, c, g, or t
tcagcacgctacgtcacgaccggtgctcgatttagacgcgatcgaagggtttgggggaagaggaagactgacggtcctcccaggagttcaggtgctgggcacagcggcctggctgcctggtcaaggactacttccacgtagcgtgctgagcgggctggcaaggcgcatagnnnnnnnnnnnnnnn

SEQ ID NO: 40287 - DNA, 172 bp, Homo sapiens; identical to SEQ ID NO: 40132
  misc_feature: GYAE6OF02JET7C.30.27.C05.1.454.CMB.1.raw
  modified_base (172)..(172): a, c, t, g, unknown or other
  misc_feature (172)..(172): n is a, c, g, or t

SEQ ID NO: 40288 - DNA, 165 bp, Homo sapiens
  misc_feature: GYAE6OF02GJI97.30.27.C05.1.454.CMB.1.raw
  modified_base (163)..(165): a, c, t, g, unknown or other
  misc_feature (163)..(165): n is a, c, g, or t
tcagcacgctacgtcacgaccggtgctcgatttagacgcgatcgaaggttgggaagaggaagactgacggtcctccaggagttcaggtgctggcacagcggcctggctgcctggcaaggactacttccacgtagcgtgctgagcggctggcaaggcgcatagnnn

SEQ ID NO: 40289 - DNA, 173 bp, Homo sapiens
  misc_feature: GYAE6OF02GVE8M.30.27.C05.1.454.CMB.1.raw
  modified_base (171)..(173): a, c, t, g, unknown or other
  misc_feature (171)..(173): n is a, c, g, or t
tcagcacgctacgtcacgaccggtgctcgatttagacgcgatcgaagggtttggggaagaggaagactgacggtcctcccaggagttcaggtgctgggcacagcggccctgggctgcctggcaaggactacttccacgtagcgtgctgagcgggctggcaaggcgcatagnnn

SEQ ID NO: 40290 - DNA, 172 bp, Homo sapiens; identical to SEQ ID NO: 40132
  misc_feature: GYAE6OF02FLQM3.30.27.C05.1.454.CMB.1.raw
  modified_base (172)..(172): a, c, t, g, unknown or other
  misc_feature (172)..(172): n is a, c, g, or t

SEQ ID NO: 40291 - DNA, 196 bp, Homo sapiens
  misc_feature: GYAE6OF02FKWF9.30.27.C05.1.454.CMB.1.raw
  modified_base (173)..(196): a, c, t, g, unknown or other
  misc_feature (173)..(196): n is a, c, g, or t
tcagcacgctacgtcacgaccggtgctcgatttagacgcgatcgaagggtttgggaagaggaagactgacggtcctccaggagttcgaggtgctgggcacagcggcctgggctgcctggtcaaggactacttccacgtagcgtgcctgagcgggctggcgaaggcgcatacgnnnnnnnnnnnnnnnnnnnnnnnn

SEQ ID NO: 40292 - DNA, 176 bp, Homo sapiens; identical to SEQ ID NO: 40149
  misc_feature: GYAE6OF02IUUYG.30.27.C05.1.454.CMB.1.raw
  modified_base (173)..(176): a, c, t, g, unknown or other
  misc_feature (173)..(176): n is a, c, g, or t

SEQ ID NO: 40293 - DNA, 174 bp, Homo sapiens; identical to SEQ ID NO: 40133
  misc_feature: GYAE6OF02GZSG1.30.27.C05.1.454.CMB.1.raw
  modified_base (173)..(174): a, c, t, g, unknown or other
  misc_feature (173)..(174): n is a, c, g, or t

SEQ ID NO: 40294 - DNA, 190 bp, Homo sapiens
  misc_feature: GYAE6OF02GA9HA.30.27.C05.1.454.CMB.1.raw
  modified_base (173)..(190): a, c, t, g, unknown or other
  misc_feature (173)..(190): n is a, c, g, or t
tcagcacgctacgtcacgaccggtgctcgatttagacgcgatcgaagggtttggggaagaggaagactgacggtcctcccaggagttcaggtgctgggcacagcggccctgggctgcctggtcaaggactacttccacgtagcgtgctgagcgggcttggcaaggcgcatagnnnnnnnnnnnnnnnnnn

SEQ ID NO: 40295 - DNA, 174 bp, Homo sapiens
  misc_feature: GYAE6OF02HNO1N.30.27.C05.1.454.CMB.1.raw
  modified_base (172)..(174): a, c, t, g, unknown or other
  misc_feature (172)..(174): n is a, c, g, or t
tcagcacgctacgtcacgaccggtgctcgatttagacgcgatcgaagggtttggggaagaggaagactgacggtcctcccaggagttcaggtgctgggcacagcggccctgggctgcctggtcaaggactacttccacgtagcgtgctgagcgggctggcaaggcgcatagnnn

SEQ ID NO: 40296 - DNA, 177 bp, Homo sapiens; identical to SEQ ID NO: 40147
  misc_feature: GYAE6OF02GFFXO.30.27.C05.1.454.CMB.1.raw
  modified_base (173)..(177): a, c, t, g, unknown or other
  misc_feature (173)..(177): n is a, c, g, or t

SEQ ID NO: 40297 - DNA, 176 bp, Homo sapiens; identical to SEQ ID NO: 40149
  misc_feature: GYAE6OF02ITPWI.30.27.C05.1.454.CMB.1.raw
  modified_base (173)..(176): a, c, t, g, unknown or other
  misc_feature (173)..(176): n is a, c, g, or t

SEQ ID NO: 40298 - DNA, 172 bp, Homo sapiens; identical to SEQ ID NO: 40132
  misc_feature: GYAE6OF02G3L86.30.27.C05.1.454.CMB.1.raw
  modified_base (172)..(172): a, c, t, g, unknown or other
  misc_feature (172)..(172): n is a, c, g, or t

SEQ ID NO: 40299 - DNA, 175 bp, Homo sapiens; identical to SEQ ID NO: 40148
  misc_feature: GYAE6OF02IVWGO.30.27.C05.1.454.CMB.1.raw
  modified_base (173)..(175): a, c, t, g, unknown or other
  misc_feature (173)..(175): n is a, c, g, or t

SEQ ID NO: 40300 - DNA, 174 bp, Homo sapiens
  misc_feature: GYAE6OF02H649R.30.27.C05.1.454.CMB.1.raw
  modified_base (173)..(174): a, c, t, g, unknown or other
  misc_feature (173)..(174): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacatagcgtgctgagcgggctggcaaggcgcatagnn

SEQ ID NO: 40301 - DNA, 173 bp, Homo sapiens; identical to SEQ ID NO: 40134
  misc_feature: GYAE6OF02HKREB.30.27.C05.1.454.CMB.1.raw
  modified_base (173)..(173): a, c, t, g, unknown or other
  misc_feature (173)..(173): n is a, c, g, or t

SEQ ID NO: 40302 - DNA, 180 bp, Homo sapiens
  misc_feature: GYAE6OF02IB2FF.30.27.C05.1.454.CMB.1.raw
  modified_base (173)..(180): a, c, t, g, unknown or other
  misc_feature (173)..(180): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnnnnnnnn

SEQ ID NO: 40303 - DNA, 177 bp, Homo sapiens; identical to SEQ ID NO: 40147
  misc_feature: GYAE6OF02HT30C.30.27.C05.1.454.CMB.1.raw
  modified_base (173)..(177): a, c, t, g, unknown or other
  misc_feature (173)..(177): n is a, c, g, or t

SEQ ID NO: 40304 - DNA, 200 bp, Homo sapiens
  misc_feature: GYAE6OF02FZIGE.30.27.C05.1.454.CMB.1.raw
  modified_base (174)..(200): a, c, t, g, unknown or other
  misc_feature (174)..(200): n is a, c, g, or t
tcagcacgctacgtcacgaccggtgctcgatttagacgcgatcgaagggtttgggggaagaggaagactgaccggtcctcccaggagttcaggtgctgggcacagcggccctgggctgcctggtcaaggactacttccacgtagcgtgctgagcgggctggcaaggcgcatagnnnnnnnnnnnnnnnnnnnnnnnnnnn

SEQ ID NO: 40305 - DNA, 174 bp, Homo sapiens; identical to SEQ ID NO: 40133
  misc_feature: GYAE6OF02IXBIJ.30.27.C05.1.454.CMB.1.raw
  modified_base (173)..(174): a, c, t, g, unknown or other
  misc_feature (173)..(174): n is a, c, g, or t

SEQ ID NO: 40306 - DNA, 187 bp, Homo sapiens
  misc_feature: GYAE6OF02HNZSD.30.27.C05.1.454.CMB.1.raw
  modified_base (172)..(187): a, c, t, g, unknown or other
  misc_feature (172)..(187): n is a, c, g, or t
tcagcacgctacgtcacgaccggtgctcgatttagacgcgatcgaagggtttggggaagaggaagactgacggtcctcccaggagttcaggtgctgggcacagcggccctgggctgcctggtcaaggactacttccacgtagcgtgctgagcgggctggcaaggcgcatagnnnnnnnnnnnnnnnn

SEQ ID NO: 40307 - DNA, 174 bp, Homo sapiens; identical to SEQ ID NO: 40133
  misc_feature: GYAE6OF02HOKGZ.30.27.C05.1.454.CMB.1.raw
  modified_base (173)..(174): a, c, t, g, unknown or other
  misc_feature (173)..(174): n is a, c, g, or t

SEQ ID NO: 40308 - DNA, 177 bp, Homo sapiens
  misc_feature: GYAE6OF02J0OHX.30.27.C05.1.454.CMB.1.raw
  modified_base (170)..(177): a, c, t, g, unknown or other
  misc_feature (170)..(177): n is a, c, g, or t
tcagcacgctacgtcacgaccggtgctcgatttagacgcgatcgaaggtttggggaagaggaagactgacggtcctccaggagttcaggtgctgggcacagcggccctgggctgcctggtcaaggactacttccacgtagcgtgctgagcgggctggcaaggcgcatagnnnnnnnn

SEQ ID NO: 40309 - DNA, 179 bp, Homo sapiens
  misc_feature: GYAE6OF02I9QRW.30.27.C05.1.454.CMB.1.raw
  modified_base (173)..(179): a, c, t, g, unknown or other
  misc_feature (173)..(179): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnnnnnnn

SEQ ID NO: 40310 - DNA, 191 bp, Homo sapiens
  misc_feature: GYAE6OF02FNYI9.30.27.C05.1.454.CMB.1.raw
  modified_base (174)..(191): a, c, t, g, unknown or other
  misc_feature (174)..(191): n is a, c, g, or t
tcagcacgctacgtcacgaccggtgctcgatttagacgcgatcgaagggtttgggggaaggaggaagactgacggtcctcccaggagttcaggtgctgggcacagcggccctgggctgcctggtcaaggactacttccacgtagcgtgctgagcgggctggcaaggcgcatagnnnnnnnnnnnnnnnnnn

SEQ ID NO: 40311 - DNA, 175 bp, Homo sapiens; identical to SEQ ID NO: 40148
  misc_feature: GYAE6OF02GYBQD.30.27.C05.1.454.CMB.1.raw
  modified_base (173)..(175): a, c, t, g, unknown or other
  misc_feature (173)..(175): n is a, c, g, or t

SEQ ID NO: 40312 - DNA, 174 bp, Homo sapiens; identical to SEQ ID NO: 40133
  misc_feature: GYAE6OF02IYRHA.30.27.C05.1.454.CMB.1.raw
  modified_base (173)..(174): a, c, t, g, unknown or other
  misc_feature (173)..(174): n is a, c, g, or t

SEQ ID NO: 40313 - DNA, 174 bp, Homo sapiens; identical to SEQ ID NO: 40133
  misc_feature: GYAE6OF02H6YBX.30.27.C05.1.454.CMB.1.raw
  modified_base (173)..(174): a, c, t, g, unknown or other
  misc_feature (173)..(174): n is a, c, g, or t

SEQ ID NO: 40314 - DNA, 174 bp, Homo sapiens; identical to SEQ ID NO: 40133
  misc_feature: GYAE6OF02GQPTV.30.27.C05.1.454.CMB.1.raw
  modified_base (173)..(174): a, c, t, g, unknown or other
  misc_feature (173)..(174): n is a, c, g, or t

SEQ ID NO: 40315 - DNA, 175 bp, Homo sapiens; identical to SEQ ID NO: 40148
  misc_feature: GYAE6OF02F1XPR.30.27.C05.1.454.CMB.1.raw
  modified_base (173)..(175): a, c, t, g, unknown or other
  misc_feature (173)..(175): n is a, c, g, or t

SEQ ID NO: 40316 - DNA, 176 bp, Homo sapiens; identical to SEQ ID NO: 40149
  misc_feature: GYAE6OF02GZJ1N.30.27.C05.1.454.CMB.1.raw
  modified_base (173)..(176): a, c, t, g, unknown or other
  misc_feature (173)..(176): n is a, c, g, or t

SEQ ID NO: 40317 - DNA, 175 bp, Homo sapiens; identical to SEQ ID NO: 40148
  misc_feature: GYAE6OF02FXN68.30.27.C05.1.454.CMB.1.raw
  modified_base (173)..(175): a, c, t, g, unknown or other
  misc_feature (173)..(175): n is a, c, g, or t

SEQ ID NO: 40318 - DNA, 180 bp, Homo sapiens; identical to SEQ ID NO: 40302
  misc_feature: GYAE6OF02GFRBU.30.27.C05.1.454.CMB.1.raw
  modified_base (173)..(180): a, c, t, g, unknown or other
  misc_feature (173)..(180): n is a, c, g, or t

SEQ ID NO: 40319 - DNA, 175 bp, Homo sapiens; identical to SEQ ID NO: 40148
  misc_feature: GYAE6OF02HI087.30.27.C05.1.454.CMB.1.raw
  modified_base (173)..(175): a, c, t, g, unknown or other
  misc_feature (173)..(175): n is a, c, g, or t

SEQ ID NO: 40320 - DNA, 538 bp, Homo sapiens
  misc_feature: GYAE6OF02HKLGB.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttccttctgctactctggctcccagatgccaccggagaaagtgtgttgacacagtctccagccaccctgtctttgtctccaggggaagagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagatttgactagtttatactgttcagcagcgtagcgactggcgtgggctcgacgttttcgggcggtacgggaccgaagggtaggagaagtccgaaacggtaaccgtggtacggctggaccaccgtagtaccgtcggttccttctaccg

SEQ ID NO: 40321 - DNA, 173 bp, Homo sapiens; identical to SEQ ID NO: 40134
  misc_feature: GYAE6OF02G5BVI.30.27.C05.1.454.CMB.1.raw
  modified_base (173)..(173): a, c, t, g, unknown or other
  misc_feature (173)..(173): n is a, c, g, or t

SEQ ID NO: 40322 - DNA, 182 bp, Homo sapiens
  misc_feature: GYAE6OF02I0JRW.30.27.C05.1.454.CMB.1.raw
  modified_base (173)..(182): a, c, t, g, unknown or other
  misc_feature (173)..(182): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnnnnnnnnnn

SEQ ID NO: 40323 - DNA, 507 bp, Homo sapiens
  misc_feature: GYAE6OF02G0V3N.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagatttgctagtttattactgttcagcagcgtagcgacgtggcgtgggtctcgacgtttcggcggaggaccaaggtagagatacgaaacgaactgtggctgcacatctgtctctac

SEQ ID NO: 40324 - DNA, 218 bp, Homo sapiens
  misc_feature: GYAE6OF02FQJ4C.30.27.C05.1.454.CMB.1.raw
  modified_base (178)..(218): a, c, t, g, unknown or other
  misc_feature (178)..(218): n is a, c, g, or t
tcagcacgctacgtcacgaccggtgctcgatttagacgcgatcgaagggtttggggggaagaggaagactgacggtcctccccaggagttcaggtgctgggcacagcggccctggggcctgccctggtcaaggactacttccacgtagcgtgctgagcgggctggcaaggcgcatagnnnnnnnnnnnnnnnnnnnnnnnnnnnnnnnnnnnnnnnnn

SEQ ID NO: 40325 - DNA, 177 bp, Homo sapiens; identical to SEQ ID NO: 40147
  misc_feature: GYAE6OF02HIW36.30.27.C05.1.454.CMB.1.raw
  modified_base (173)..(177): a, c, t, g, unknown or other
  misc_feature (173)..(177): n is a, c, g, or t

SEQ ID NO: 40326 - DNA, 508 bp, Homo sapiens
  misc_feature: GYAE6OF02IG174.30.27.C05.1.454.CMB.1.raw
  modified_base (505)..(505): a, c, t, g, unknown or other
  misc_feature (505)..(505): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagattttgctagtttattactgttcagcagcgtagcgactggcgtgggctcgactttcggcggagggaccaaggtagagatacgaaacgaactggtgctgcaccatctgtcttntac

SEQ ID NO: 40327 - DNA, 177 bp, Homo sapiens; identical to SEQ ID NO: 40147
  misc_feature: GYAE6OF02GCZ3G.30.27.C05.1.454.CMB.1.raw
  modified_base (173)..(177): a, c, t, g, unknown or other
  misc_feature (173)..(177): n is a, c, g, or t

SEQ ID NO: 40328 - DNA, 173 bp, Homo sapiens; identical to SEQ ID NO: 40134
  misc_feature: GYAE6OF02IBZOQ.30.27.C05.1.454.CMB.1.raw
  modified_base (173)..(173): a, c, t, g, unknown or other
  misc_feature (173)..(173): n is a, c, g, or t

SEQ ID NO: 40329 - DNA, 513 bp, Homo sapiens
  misc_feature: GYAE6OF02IFSM1.30.27.C05.1.454.CMB.1.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgctccaggggaaanagccaccttctcctgcagggccagtcagagtgttggcacctacatagcctggtaccaanagaaacctggccaggctcccaggctcctcatctatgatgcatccaaaagggcctactggcatcccagccaggttcagtggcagtgggtctgggcaggacttcgactctcaccatcagtagcctagacgtccctagaacgattttgctaggtttattacttgtctagcagcgtagcgactggcgtgggctcacgtttcgcgggaggccaaggtagagagtcgaaacgactggtgctgcacntctgtcttntacc

SEQ ID NO: 40330 - DNA, 174 bp, Homo sapiens; identical to SEQ ID NO: 40133
  misc_feature: GYAE6OF02JX4MM.30.27.C05.1.454.CMB.1.raw
  modified_base (173)..(174): a, c, t, g, unknown or other
  misc_feature (173)..(174): n is a, c, g, or t

SEQ ID NO: 40331 - DNA, 226 bp, Homo sapiens
  misc_feature: GYAE6OF02H1MGI.30.27.C05.1.454.CMB.1.raw
  modified_base (179)..(226): a, c, t, g, unknown or other
  misc_feature (179)..(226): n is a, c, g, or t
tcagcacgctacgtcacgaccggtgctcgatttagacgcgatcgaagggtttgggggtaaggaggaagactagaccggtcctcccaggagttcaaggtgcctgggcacagcggccctgggctgcctggtcaaggctacttccacgtagcgttgctgagcgggctggcaaggcgcatagnnnnnnnnnnnnnnnnnnnnnnnnnnnnnnnnnnnnnnnnnnnnnnnn

SEQ ID NO: 40332 - DNA, 185 bp, Homo sapiens; identical to SEQ ID NO: 40160
  misc_feature: GYAE6OF02HN3SI.30.27.C05.1.454.CMB.1.raw
  modified_base (173)..(185): a, c, t, g, unknown or other
  misc_feature (173)..(185): n is a, c, g, or t

SEQ ID NO: 40333 - DNA, 174 bp, Homo sapiens; identical to SEQ ID NO: 40133
  misc_feature: GYAE6OF02HB2E8.30.27.C05.1.454.CMB.1.raw
  modified_base (173)..(174): a, c, t, g, unknown or other
  misc_feature (173)..(174): n is a, c, g, or t

SEQ ID NO: 40334 - DNA, 175 bp, Homo sapiens; identical to SEQ ID NO: 40148
  misc_feature: GYAE6OF02IRUVR.30.27.C05.1.454.CMB.1.raw
  modified_base (173)..(175): a, c, t, g, unknown or other
  misc_feature (173)..(175): n is a, c, g, or t

SEQ ID NO: 40335 - DNA, 174 bp, Homo sapiens; identical to SEQ ID NO: 40133
  misc_feature: GYAE6OF02FY0BR.30.27.C05.1.454.CMB.1.raw
  modified_base (173)..(174): a, c, t, g, unknown or other
  misc_feature (173)..(174): n is a, c, g, or t

SEQ ID NO: 40336 - DNA, 174 bp, Homo sapiens; identical to SEQ ID NO: 40133
  misc_feature: GYAE6OF02F0VK7.30.27.C05.1.454.CMB.1.raw
  modified_base (173)..(174): a, c, t, g, unknown or other
  misc_feature (173)..(174): n is a, c, g, or t

SEQ ID NO: 40337 - DNA, 175 bp, Homo sapiens; identical to SEQ ID NO: 40148
  misc_feature: GYAE6OF02GTLX5.30.27.C05.1.454.CMB.1.raw
  modified_base (173)..(175): a, c, t, g, unknown or other
  misc_feature (173)..(175): n is a, c, g, or t

SEQ ID NO: 40338 - DNA, 173 bp, Homo sapiens; identical to SEQ ID NO: 40134
  misc_feature: GYAE6OF02FILP0.30.27.C05.1.454.CMB.1.raw
  modified_base (173)..(173): a, c, t, g, unknown or other
  misc_feature (173)..(173): n is a, c, g, or t

SEQ ID NO: 40339 - DNA, 533 bp, Homo sapiens
  misc_feature: GYAE6OF02I3SIP.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttgcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagatttgctagtttatactgtcagcagtcgtagcgtactggcgtgggctcgacgtttcggcggacggtaaccgaagggtagacgtagtacgaaacggtaactggtaggcgtaggccaccgtagtcttacgttccgttctaccg

SEQ ID NO: 40340 - DNA, 173 bp, Homo sapiens; identical to SEQ ID NO: 40134
  misc_feature: GYAE6OF02F3LV9.30.27.C05.1.454.CMB.1.raw
  modified_base (173)..(173): a, c, t, g, unknown or other
  misc_feature (173)..(173): n is a, c, g, or t

SEQ ID NO: 40341 - DNA, 525 bp, Homo sapiens
  misc_feature: GYAE6OF02ISJMG.30.27.C05.1.454.CMB.1.raw
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
  modified_base (520)..(520): a, c, t, g, unknown or other
  misc_feature (520)..(520): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcatccaaaagggcctctggcactcccagccaggttcagtggcagtgggtctgggacagacttcactcncaccatcagtacgcctagacgcctagaagtattttgactagtttattactgtcagcagcgtagcgactggcgtggctctacgtttcggcgggacggaccgaaggtagagatacgaaacgtacgtggtaggctgaccacgtatcgtgttcctntaccg

SEQ ID NO: 40342 - DNA, 547 bp, Homo sapiens
  misc_feature: GYAE6OF02JJWLS.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcatccaaaaggcctactggcatcccagccaggtcagtggcagtcggtctggacagactcgactcgtcaccatcgagtacgcctagacgccgtagaagtatttgcttagtttattaacgtgtcgtagcgagtcgtagcgtacgtggacggtggtcttcgtacgtttcggcggacggtaaccgaggttagacgagtacgaaacggtaactggtacgcgtagccgacgtcttacgtcgtccttactaccg

SEQ ID NO: 40343 - DNA, 606 bp, Homo sapiens
  misc_feature: GYAE6OF02JTDRH.30.27.C05.1.454.CMB.1.raw
  modified_base (201)..(201): a, c, t, g, unknown or other
  misc_feature (201)..(201): n is a, c, g, or t
  modified_base (409)..(409): a, c, t, g, unknown or other
  misc_feature (409)..(409): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaanagccaccttctcctgcagggccagtcagagtgttggcacctacatagcctggtaccaacagaaacctggccaggctccaggctcctcatctatgatgcataccgaaagggcctctggcactcccagccaggttcagtggctaggtcgggtctgggactaggacctttcgacttacgccaccatcagtacgcctagacgcctggaagtntttgacttagtttactacgtgttcgagtctacggtcgtagacgtagtcgggacgtcgggtctcgtacgtttccggggaccgggtaacgggaaccgtaagggttacggacgtaacggttaaccggaaacggtaaccgttgggtacggtaccgtacggtacccgacggtactacgtttacgtacccgtttactaacccg

SEQ ID NO: 40344 - DNA, 173 bp, Homo sapiens; identical to SEQ ID NO: 40134
  misc_feature: GYAE6OF02I73V7.30.27.C05.1.454.CMB.1.raw
  modified_base (173)..(173): a, c, t, g, unknown or other
  misc_feature (173)..(173): n is a, c, g, or t

SEQ ID NO: 40345 - DNA, 513 bp, Homo sapiens
  misc_feature: GYAE6OF02HHEYM.30.27.C05.1.454.CMB.1.raw
  modified_base (202)..(202): a, c, t, g, unknown or other
  misc_feature (202)..(202): n is a, c, g, or t
  modified_base (507)..(507): a, c, t, g, unknown or other
  misc_feature (507)..(507): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacaggacttcactctcaccatcagtagcctagagcctgaagattttgctagtttatactgtcagcagcgtagcgactggcgtgggctcgacgttttcggcggagggaccaagggtagagatcgaaacgaactggtggctgcaccatctgtcttnttaccg

SEQ ID NO: 40346 - DNA, 534 bp, Homo sapiens
  misc_feature: GYAE6OF02HRVT9.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagattttgctagtttattactgttcagcagcgtagcgacttggcgtgggctcacgtttcggcggtagggacccaagggttacgagataccgaaaacgaaccttggtacggtctgccaaccgattccgtagttcctttctaacg

SEQ ID NO: 40347 - DNA, 174 bp, Homo sapiens; identical to SEQ ID NO: 40133
  misc_feature: GYAE6OF02HAYQ8.30.27.C05.1.454.CMB.1.raw
  modified_base (173)..(174): a, c, t, g, unknown or other
  misc_feature (173)..(174): n is a, c, g, or t

SEQ ID NO: 40348 - DNA, 176 bp, Homo sapiens; identical to SEQ ID NO: 40149
  misc_feature: GYAE6OF02G4WJX.30.27.C05.1.454.CMB.1.raw
  modified_base (173)..(176): a, c, t, g, unknown or other
  misc_feature (173)..(176): n is a, c, g, or t

SEQ ID NO: 40349 - DNA, 123 bp, Homo sapiens
  misc_feature: GYAE6OF02HJQ2I.30.27.C05.1.454.CMB.1.raw
tcagcacgctacgtcacgaccggtgctcgatttagacgcgatcgaagggtttgggggaagaggaagactgacggtcctcccaggagttcaggtgctgggcacagcggccctgggctgcctgtc

SEQ ID NO: 40350 - DNA, 173 bp, Homo sapiens; identical to SEQ ID NO: 40134
  misc_feature: GYAE6OF02HWPST.30.27.C05.1.454.CMB.1.raw
  modified_base (173)..(173): a, c, t, g, unknown or other
  misc_feature (173)..(173): n is a, c, g, or t

SEQ ID NO: 40351 - DNA, 176 bp, Homo sapiens; identical to SEQ ID NO: 40149
  misc_feature: GYAE6OF02G2204.30.27.C05.1.454.CMB.1.raw
  modified_base (173)..(176): a, c, t, g, unknown or other
  misc_feature (173)..(176): n is a, c, g, or t

SEQ ID NO: 40352 - DNA, 185 bp, Homo sapiens; identical to SEQ ID NO: 40160
  misc_feature: GYAE6OF02GD9N6.30.27.C05.1.454.CMB.1.raw
  modified_base (173)..(185): a, c, t, g, unknown or other
  misc_feature (173)..(185): n is a, c, g, or t

SEQ ID NO: 40353 - DNA, 174 bp, Homo sapiens; identical to SEQ ID NO: 40133
  misc_feature: GYAE6OF02GKO4J.30.27.C05.1.454.CMB.1.raw
  modified_base (173)..(174): a, c, t, g, unknown or other
  misc_feature (173)..(174): n is a, c, g, or t

SEQ ID NO: 40354 - DNA, 194 bp, Homo sapiens
  misc_feature: GYAE6OF02IGLUW.30.27.C05.1.454.CMB.1.raw
  modified_base (152)..(152): a, c, t, g, unknown or other
  misc_feature (152)..(152): n is a, c, g, or t
  modified_base (173)..(194): a, c, t, g, unknown or other
  misc_feature (173)..(194): n is a, c, g, or t
tcagcacgctacgtcacgaccggtgctcgatttagacgcgatcgaaggtttggggggaagaggaagactgacggtcctcccaggagttcaggtgctgggcaccagccggccctggctgcctggtcaaggactacttcacgtagcgtgctgancgggctggcaaggcgcatagnnnnnnnnnnnnnnnnnnnnnn

SEQ ID NO: 40355 - DNA, 944 bp, Homo sapiens
  misc_feature: GYAE6OF02GN4QR.30.27.C05.1.454.CMB.1.raw
  modified_base (318)..(318): a, c, t, g, unknown or other
  misc_feature (318)..(318): n is a, c, g, or t
tcagcacgctacgtcacgaccggtgctcgatttagacgcgatcgaagggtttgggggtaggaacgtgctcagttagggacccacgtagggaacccagtggaacgaccccgacgttcctctaggcttctccttcctcctaggctactctggcgtccccagatggaccaccggggataagtgtgttggttacctacgtagtccttaccttaggaccgtaccttcgtctttggtctaccggaggggaacgacgccgtacgttctcctggcgagggtccaggtccagacgttggtggacaccttagatacgcctggtaccanacgaacctcggcctaggctcccaggtctaccgtctagtctagtgactcggtcactaccgaaacggtccctacggtagggctaacggtcccgtaacggtccggtaacggtttaccaacggttaaccggaccgtaacggtttggggggtaacgttaacgggggaaaactaacggtacgtttacggaacctttcgttaccgaaccggtaacggttccgaacggttaccggacccgttaacgtaccggtaccccgttaagggaacggttaacgttttacggtacccgtaaaggtttttaaccgtttaccgtttaacggttacgttaacggtccgttaacgggtacccgttaaaaggtacccgggttaaaccggttacgggggtacccggtttacgggggtaaccgttaaccccgggtacccgggtttttaaccggggggacccggggtaaaccggggggttaacccggttaaacggggttaaccggttaacgggttaaaccgtttaaccggggtaaaaaccgggtaacccggttaggggttaaccgggttaacccggtttccgggtaacccggttacccgtaaagttttccccggtttaacgggtttttcccgttaacccgtttacccgg

SEQ ID NO: 40356 - DNA, 173 bp, Homo sapiens; identical to SEQ ID NO: 40134
  misc_feature: GYAE6OF02H32Q4.30.27.C05.1.454.CMB.1.raw
  modified_base (173)..(173): a, c, t, g, unknown or other
  misc_feature (173)..(173): n is a, c, g, or t

SEQ ID NO: 40357 - DNA, 176 bp, Homo sapiens; identical to SEQ ID NO: 40149
  misc_feature: GYAE6OF02F9QG9.30.27.C05.1.454.CMB.1.raw
  modified_base (173)..(176): a, c, t, g, unknown or other
  misc_feature (173)..(176): n is a, c, g, or t

SEQ ID NO: 40358 - DNA, 175 bp, Homo sapiens; identical to SEQ ID NO: 40148
  misc_feature: GYAE6OF02HZ5U2.30.27.C05.1.454.CMB.1.raw
  modified_base (173)..(175): a, c, t, g, unknown or other
  misc_feature (173)..(175): n is a, c, g, or t

SEQ ID NO: 40359 - DNA, 182 bp, Homo sapiens; identical to SEQ ID NO: 40322
  misc_feature: GYAE6OF02HRVC4.30.27.C05.1.454.CMB.1.raw
  modified_base (173)..(182): a, c, t, g, unknown or other
  misc_feature (173)..(182): n is a, c, g, or t

SEQ ID NO: 40360 - DNA, 174 bp, Homo sapiens; identical to SEQ ID NO: 40133
  misc_feature: GYAE6OF02GVHB1.30.27.C05.1.454.CMB.1.raw
  modified_base (173)..(174): a, c, t, g, unknown or other
  misc_feature (173)..(174): n is a, c, g, or t

SEQ ID NO: 40361 - DNA, 539 bp, Homo sapiens
  misc_feature: GYAE6OF02HK1KH.30.27.C05.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctanatagccctggtaccaacagaaacctggccaggctcccaggctcctcatctatgatgcatccaaaagggcctctggcatcccagccaggttcagtggcagtgggtctgggacagtacttcactctcaccatcagtagcctagacgtcctgaagtattttgctagttttatactgtcagtcgagcgtagcgacgtggcggtgggccttcgtacgtttccgggcggtacgggacctaagggtagagtatacgaaacgtacgtaggtggctgctaccgattcgtcgttcctcttaccg

SEQ ID NO: 40362 - DNA, 176 bp, Homo sapiens; identical to SEQ ID NO: 40149
  misc_feature: GYAE6OF02HLF1P.30.27.C05.1.454.CMB.1.raw
  modified_base (173)..(176): a, c, t, g, unknown or other
  misc_feature (173)..(176): n is a, c, g, or t

SEQ ID NO: 40363 - DNA, 619 bp, Homo sapiens
  misc_feature: GYAE6OF02JFWIK.30.27.C05.1.454.CMB.1.raw
  modified_base (202)..(202): a, c, t, g, unknown or other
  misc_feature (202)..(202): n is a, c, g, or t
  modified_base (359)..(359): a, c, t, g, unknown or other
  misc_feature (359)..(359): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagcccacctgtctttgtctccgaggggaangccaccttctcctgcagggccagtcagagtgttggcacctacatagcctggtacccaacagaacctggccaggctcccaggcctcctcactctatgatgcataccaaaacgggcctcgtcggcactcccagaccaggttcagtcggcaggtgggtcngggacagacgttcactcgtacaccatcagtacgtacctacgacgtcctagtaagtacttttgacttaagtttacttacttagtctaggtctagtcgtagacggtactggggcgtacgggtccttacgtaccgtttcgggccgggtaacgggacccgtaaggggtaacgtaggtacgtaacgtaaaaccggtacgttacgggtccggtacgtacggtacccgtaaccgtacgttccgttacggttccctttacctaacccg

SEQ ID NO: 40364 - DNA, 535 bp, Homo sapiens
  misc_feature: GYAE6OF02FR2HD.30.27.C05.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (379)..(379): a, c, t, g, unknown or other
  misc_feature (379)..(379): n is a, c, g, or t
tcagcacgctacgtcacgaccggtgctcgatttagacgcgatcgaagggtttgggggaggaactgctcagttaggaccctagagggaaccatggaagccccagctcagcttctcttcctcctgctactctggctcccagatgccaccggngaaagtgtgttgacacagtctccagccaccctgtctttgtctccaggggaaanagccaccttctcctgcagggccagtcagagtgttggcacctacatagcctggtaccaanagaaacctggccaggctcccaggctcctcatctatgatgcatccaaaaggcctctggcatcccagccaggttcagtgcagtgggtctgggacagacttcactctcaccatcagtacncctagacgcctgaagtatttgctaggttttatacttgttcagtcagtcgtagcgatcggcggtgggcctcgtacgtttcgggcgggtaggacccgaagggtacgagacgtacgaaacgaacctggtggacctgaccaccatctcgttcctctaccg

SEQ ID NO: 40365 - DNA, 173 bp, Homo sapiens; identical to SEQ ID NO: 40134
  misc_feature: GYAE6OF02GQAIJ.30.27.C05.1.454.CMB.1.raw
  modified_base (173)..(173): a, c, t, g, unknown or other
  misc_feature (173)..(173): n is a, c, g, or t

SEQ ID NO: 40366 - DNA, 565 bp, Homo sapiens
  misc_feature: GYAE6OF02JUVV9.30.27.C05.1.454.CMB.1.raw
  modified_base (203)..(203): a, c, t, g, unknown or other
  misc_feature (203)..(203): n is a, c, g, or t
  modified_base (492)..(492): a, c, t, g, unknown or other
  misc_feature (492)..(492): n is a, c, g, or t
tcagcacgctacgtcacgaccggtgctcgatttagacgcgatcgaagggtttgggggagggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggcctcccaggctcctcatctatgatgcataccgaaaacgggtcctcgtggcactcccgagcctaggttccagtcggcaggtcgggtcgtagggacaggtacttcgactctaccaccatcgagtacgtacctagacgctagaagtagtttgacttagtttatagtcgtacagtctagtcgtagcggtacgtggcggtggccttcgtaccgttcgggnggtaacggacgtaaggtagagacgtaacgaacgtagtggtacggctcgacacgtacgtctcggtcttcgtacc

SEQ ID NO: 40367 - DNA, 193 bp, Homo sapiens
  misc_feature: GYAE6OF02H89BX.30.27.C05.1.454.CMB.1.raw
  modified_base (174)..(174): a, c, t, g, unknown or other
  misc_feature (174)..(174): n is a, c, g, or t
  modified_base (176)..(193): a, c, t, g, unknown or other
  misc_feature (176)..(193): n is a, c, g, or t
tcagcacgctacgtcacgaccggtgctcgatttagacgcgatcgaagggtttggggggaagaggaagactgacggtcctcccaggagttcaggtgctgggcacagcggccctgggctgcctggtcaaggactacttccacgtagcgtgctgagcgggctggcaaggcgcatagnannnnnnnnnnnnnnnnnn

SEQ ID NO: 40368 - DNA, 605 bp, Homo sapiens
  misc_feature: GYAE6OF02HEKTR.30.27.C05.1.454.CMB.1.raw
  modified_base (246)..(246): a, c, t, g, unknown or other
  misc_feature (246)..(246): n is a, c, g, or t
tcagcacgctacgtcacgaccggtgctcgatttagacgcgatcgaagggtttgggggaggaactgacgtcagttacggacccagagggaacccactggaagccccaagactcagacttctcttccgtcctcgcctactctggctcccagatcgccaccggaggaaacgtgtcgttgacacagtctcagccacctggtccttgtctccgagggaaagcgccaccttctcctgccagggccagtcagngtgttggcacctacactagcctagtaaccaacgagaaacctgccaggctccaggacctcctcactctacgtgacgtgcataccgaaaaggtcctacgtcgctactcccgagccacgtcagtcgacacgtggtctggacagtacttacactctaccactatcaacgtacgtacctaagtacgtacccgttaggaagttacgtttcgacttagtttacttacgtcgttacgacgctaacggcgtacgcgtacgtgggtcgtcgggcctcgtacgtttccggacgggtacggaacgtaaggtacggagacgtacgaaacgtactagacgactgaccgtactatacgtcgttccgtcgtaccg

SEQ ID NO: 40369 - DNA, 183 bp, Homo sapiens
  misc_feature: GYAE6OF02GKIPM.30.27.C05.1.454.CMB.1.raw
  modified_base (173)..(183): a, c, t, g, unknown or other
  misc_feature (173)..(183): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcgggctggcaaggcgcatagnnnnnnnnnnn

SEQ ID NO: 40370 - DNA, 514 bp, Homo sapiens
  misc_feature: GYAE6OF02ICEE3.30.27.C05.1.454.CMB.1.raw
  modified_base (318)..(318): a, c, t, g, unknown or other
  misc_feature (318)..(318): n is a, c, g, or t
  modified_base (343)..(343): a, c, t, g, unknown or other
  misc_feature (343)..(343): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaagagccacctttctcctgcagggccagtcagagtgttggcacctacatagcctggtaccaacagaaaacctggccaggctcccaggctcctcatctatgatgcatccaaaagggcctcnggcatcccagccaggttcagtggcngtgggtctggacagactcactctcaccatcaagtagcctagacgcctgaagtattttgctagttttattactgtcagcagtcgtagcgagtggcggtggctctcgttcggcggaggaccgaggtagagatacgaaaggactggtggctagcacgtatcgtntcttntaccg

SEQ ID NO: 40371 - DNA, 174 bp, Homo sapiens; identical to SEQ ID NO: 40133
  misc_feature: GYAE6OF02FOR0Z.30.27.C05.1.454.CMB.1.raw
  modified_base (173)..(174): a, c, t, g, unknown or other
  misc_feature (173)..(174): n is a, c, g, or t

SEQ ID NO: 40372 - DNA, 530 bp, Homo sapiens
  misc_feature: GYAE6OF02IK9V5.30.27.C05.1.454.CMB.1.raw
  modified_base (526)..(526): a, c, t, g, unknown or other
  misc_feature (526)..(526): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaagagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagacgcctagaagtattttagctagttttaattactgttcagcagcgtagcgtactggcgttgggctcgtacgtttcgggcggacgggaccaggtagagacgtaccgaaacggtaactgtaggctagccactatctcgttacttntacc

SEQ ID NO: 40373 - DNA, 526 bp, Homo sapiens
  misc_feature: GYAE6OF02I5MPX.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcatccaaaagggcctctggcatcccagccaggttcagtgcagtggtctggacagacttcactctcaccatcagtagcctaagacgtcctagaagtatttgactagtttatactgtcagcagtcgtagcgtacgtggcgtgggctcgtacgtttcgggcggagggaccaagggtagagatacgaaacgactagtacggactcgacacctacttctcgttctctaccg

SEQ ID NO: 40374 - DNA, 544 bp, Homo sapiens
  misc_feature: GYAE6OF02GOF3T.30.27.C05.1.454.CMB.1.raw
  modified_base (149)..(149): a, c, t, g, unknown or other
  misc_feature (149)..(149): n is a, c, g, or t
  modified_base (201)..(201): a, c, t, g, unknown or other
  misc_feature (201)..(201): n is a, c, g, or t
tcagcacgctacgtcacgaccggtgctcgatttagacgcgatcgaagggtttgggggagaactgctcagttaggacccagagggaaccatggaagccccagctcagcttctcttcctcctgctactctggctcccagatgccaccgganaaagtgtgttgacacagtctccagccaccctgtctttgtctccaggggaaangccaccttctccgtgcgagggccagtcagagtgttggcacctacatacgcctggtaccaacagaaacctggccaggctcccaggctccgtcatctatgatgcatccaaaaggcctcgtggcatcccagccaggttcagtcgcagtggtctgggacaggacttcactcgtcaccatcagtagcctagacgcctagaagtatttgctagtttactactgtcgagcagcgtagcgtacgtggcgtggctcgacgtttcggcggacggaccgaaggtagagtactacgaaacgtaacgttaggtcggtacgtacgacacctacgttccgtggttcctacttaacccg

SEQ ID NO: 40375 - DNA, 528 bp, Homo sapiens
  misc_feature: GYAE6OF02HPX77.30.27.C05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttcncctgcagggccagtcagagtgttggcacctacatagcctggtaccaacagaaaacctggccaggctcccaggctcctcatctatgatgcatccaaaagggcctntggcatcccagccaggttcagtggcagtgggtntgggacagacttcactctcaccatcagtagcctagagcctgaagtattttgctagtttattactgttcagcagcgtagcatggcgtggctctacgtttcggcggtaggaccaagggtagagagtaccgaaaggtaacctggtacggtctggaccacgtatcctaggttccttctaaccg

SEQ ID NO: 40376 - DNA, 545 bp, Homo sapiens
  misc_feature: GYAE6OF02IPSPD.30.27.C05.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcaggccagtcagagtgttggcacctacatagcctggtaccaanagaaacctggccaaggctccccaggactcctcgatctatgatgcatccaaaacgggcctactggcatcccagccaggttcagtggcagtggtctgggacaggacttcgactctcacctatcagtagcctagacgcctgaagtagttttgactagtttattacgttgttcagcagtcgtagtcgtacgtggacgtgggtacctcacgtttcggccgggtaggacgtaaggtagagacgtacgaaacgacgtggtagtacgtgacgtaccgatctcggttctcgtacc

SEQ ID NO: 40377 - DNA, 644 bp, Homo sapiens
  misc_feature: GYAE6OF02G78YR.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaagagccaccttctcctgcagggccagtcagagtgttggcacctacatagcctggtaccaacagaaacctggccaggctcccaggcctcctcatctatgatgcactaccaaagggcctcgtggcactcccagcctaggttcaggtcggacgtaggtcggggtcgtgggacgtacggtaccttaccgaacctccgtaccaaccctactccgtaacggttacgtacccgtaaggtacgtaccgttaggtaaacgttattttacgacttaaggttttaacttacttgtacgtacgcgtacggtcgtagaccgtacgtcgggtcggtcgggtccttacgtaccgtttcgggacgggtacgggaaccgtaagggtagacgtaagtaccgtaaacggtaacggtagggtcgtaccgtagacctaccgtattccggtcgttaccgttctaccg

SEQ ID NO: 40378 - DNA, 567 bp, Homo sapiens
  misc_feature: GYAE6OF02IK49A.30.27.C05.1.454.CMB.1.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (399)..(399): a, c, t, g, unknown or other
  misc_feature (399)..(399): n is a, c, g, or t
  modified_base (412)..(412): a, c, t, g, unknown or other
  misc_feature (412)..(412): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaanagccaccttctcctgcagggccagtcagagtgttggcacctacatagcctggtaccaanagaaacctggccagctcccaggctcctcatctatcgatgcataccgaaaagggcctacgtcggcacgtcccacgacctaggttccaggttggcctaggtcgggtctaggggacaggtacttcgactcgtcacctatacngtacgcctagacnccgtgaagtatttgcttagtttattactgttcagcagcgtagacgagtggcgtcggctcgtacgttcgggcggtaggaccgtaaggtagagtataacgaacggaacgttggtacggcgtacggcctaaccggcttacggcgttaccttacgtacc

SEQ ID NO: 40379 - DNA, 599 bp, Homo sapiens
  misc_feature: GYAE6OF02HTFLR.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatagcctggtaccaacagaaacctggccacggccccacggctcctcatctatgatgcataccaaaacgggacctctcggcactcccacgcacggttacgagtggcgaggtgggtcgtggacgacgtacttcactctacaccactcgacgtacgcctagacgactagtaagtatttgacttagttactttacgtagtcagtacgacgtacggtacgtacgacgttggcggtcggtcgtacgtccggtttacgggcgggtaggggaccgtaaagggtaaggagaacgtacgaaaacggtacgtcggttacggcgtacgacgtacctacgtccgttcgttacttaccgtacttccccg

SEQ ID NO: 40380 - DNA, 613 bp, Homo sapiens
  misc_feature: GYAE6OF02I8AIT.30.27.C05.1.454.CMB.1.raw
  modified_base (203)..(203): a, c, t, g, unknown or other
  misc_feature (203)..(203): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagngccaccttctcctgcagggccagtcagagtgttggcacctacatagcctggtacccaacagaaacctggccaggctcccaggcctccctcactctatgatgctataccaaaacgggcctcgtcggcactccccgacgccgtaggttcgaggtcggcgtacggtcggggtacgtcgggactagacttcaccgtctaccaccactctaacgtacgtacctaacgacgcctagtaagtactttgacttagtttacttacgttgttactacgtactagacgtacgtcggtacgtaggtcggtgggcgttcgtacgttccgggacgggtacggtaacgtaacggtaggagacgtacgtaaacgtaactaggtacggtcgtcgaccgtaccgtagtccgtcgttccgttacgtacc

SEQ ID NO: 40381 - DNA, 556 bp, Homo sapiens
  misc_feature: GYAE6OF02FQZBH.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagccctggtaccaacagaaaccctggccaggctccccaggctccctcatctatgatgcatccaaaagggcctctggcatcccagccaggttcagtgcagtgggtctgggacaggacttcaactctcgaccatcagtacgcctagacgctgaagtattttgctagtttattacttgttcagcagcgtagcgactggcggtgggcttcgacgttttcgggcggtacgggaaccgtaagggtagtagtacgtacgtaaacgaacgttggtacgtacgtgtacgaccagttcgttcgttaccgtcttaacccg

SEQ ID NO: 40382 - DNA, 588 bp, Homo sapiens
  misc_feature: GYAE6OF02GEOQ9.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcataccgaaaagggtcctctggcatcccagccaggttcagtggcgaggtgggtcgtgggacagacttcactctcaccatcagtacgcctagacgcctaggaagtattttacgacttagtttaacttacgttgttcagcgtaggacgtagccgagtgggacgtgggcttcgtacgtttcgggacggtacgggacgtaagggtagacgtaagtaccgaaacggtaacgttcggtacggtcgtaccggtaccgaaccgtacgttccggttacgtttccttacgttaacccg

SEQ ID NO: 40383 - DNA, 570 bp, Homo sapiens
  misc_feature: GYAE6OF02H5DCF.30.27.C05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (327)..(327): a, c, t, g, unknown or other
  misc_feature (327)..(327): n is a, c, g, or t
  modified_base (401)..(401): a, c, t, g, unknown or other
  misc_feature (401)..(401): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttcncctgcagggccagtcagagtgttggcacctacatacgcctggtaaccaaacagaaacctggacccaggcctccccaaggcctcctcattctatgatgcatccaaaacgggcctcnggcactcccagccaggttcagtggcaggtcggtcgtgggactagacgttcactctcaccatcagtacgctaagngcctagaagtattttgcttagtttattactgtcagcagtcgtagcgtacgtggcggtcggtctacgtacggtttcgggcgggtaaggaaccgtaagggtagagaactaacgaaacggaacgttggtacggacgtcgaccgtaacctagttccgtgttaccttgttaccc

SEQ ID NO: 40384 - DNA, 174 bp, Homo sapiens; identical to SEQ ID NO: 40133
  misc_feature: GYAE6OF02HJSTW.30.27.C05.1.454.CMB.1.raw
  modified_base (173)..(174): a, c, t, g, unknown or other
  misc_feature (173)..(174): n is a, c, g, or t

SEQ ID NO: 40385 - DNA, 760 bp, Homo sapiens
  misc_feature: GYAE6OF02I4086.30.27.C05.1.454.CMB.1.raw
tcagcacgctacgtcacgaccggtgctcgatttagacgcgatcgaagggtttgggggaggaacgtgcctcagttaggacccaagaggggaaccgattcggaagtccccgagctcagcttctcttacctcctgcgtactctcgctccgagtagtcgccacggagtaaaggtttcgtgtttgactacttaagtcgtccacgcctaccgttgtactttggtcctaccgaagggggtaaagacgtccgtaccggggttcctccgtcgcgacgggtcgaaggtccaggagttcgttcggcctacctacgactacggcctcggtaaccaaactacgtaaaaccttcggactaacggtccgtcccgaaggtcctaccgtcgtacgtacctaagtcgtaacgtcggaccgtaaagtacccggtaaaaagggggtccttacggtcggtacgtaacttacccgtacgtaccgtaggtttccaagggtacggacgttacgggtacggtacgtaggtaactacgtacgttacgtaaccgtcgtaaccgaccgtaattaccgaacggtactaccgtacgaacggaccgttaacgtaaacttactttaacggacttaacgtttattaccgttgtacagtactaagtcgtacgacgtacgtaggtacggtggactcgtacgtttcggacggtacggtaacgtaaggtaacgagtaggtaacaaacgtaggtgacggactacgactaacgtacgttacgtcgttacgtcgtaccgg

SEQ ID NO: 40386 - DNA, 539 bp, Homo sapiens
  misc_feature: GYAE6OF02G657U.30.27.C05.1.454.CMB.1.raw
  modified_base (408)..(408): a, c, t, g, unknown or other
  misc_feature (408)..(408): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcataccgaaaacgggcctctcggcatccccagccaggttcgaggtggcgaggtcgggtcgtggggacagacttcactctcaccatcagtagcctagacgctagaagtntttgctagtttattactgtcagcagcgtagcgactgggcgtggtctcgtcgttcggcggacgggtaccgagggtagagacgtacgaaacgtactggtcggtacgtgccgactacgtctcgttcttctaccg

SEQ ID NO: 40387 - DNA, 821 bp, Homo sapiens
  misc_feature: GYAE6OF02IPOPG.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggtaaagacgccaccttctcctgcagggccagtcagagtgttggcacgtacatagcctggtaccaacagaacctggccaggcctcccaggcctccgtcatctatgtatgcataccgaaaacggcctactcggactactacccgagtacctaggtttacgacggtcggaccgtaggttcggggtacgtcggggaactaacggtacttaccgtaactccgtacccgtaacccaacgttccgtaacggtaacgttacccggttaacggtaacggtaccccgttaagggttaaacggttaaacgttttttcggtaacgtttaaacgggtttttttaaactttaaccgtttaggtttaaccggtaacggttaccggtaacggttaaccggggttaaccgtacccgggttaaaccggttcggggttacccgggttcggggttacccttaccggttacccgggttttaccgggtaccggggtaaacggggtaaacccgtaaagggggtttacgaacgggtaacgttaacccggtaaaaccggttaaccggttagggtaacccggttccgtaccggaaccgttaacccgtacgtttacccggttacgtttacccgtttaccttaacccccgg

SEQ ID NO: 40388 - DNA, 512 bp, Homo sapiens
  misc_feature: GYAE6OF02FV2SM.30.27.C05.1.454.CMB.1.raw
  modified_base (199)..(199): a, c, t, g, unknown or other
  misc_feature (199)..(199): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccacctgtctttgtctccagggaangccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacaggacttcactctcaccatcagtagcctagacgtcctgaagtattttgctagtttatacttgtcagcagcgtagcgacgtggcgtgggctcgtacgtttcggcggtagggaccaaggtgagatacgaaacgactggtgtcgtgcaccatctgtctctaccg

SEQ ID NO: 40389 - DNA, 558 bp, Homo sapiens
  misc_feature: GYAE6OF02IWBNS.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatctatgatgcatccaaaagggcctctggcatcccagccaggttcagtggcaggtgggtctgggacagacttcactctcaccatcagtagcctagacgcctgaagtattttgctagtttactatgttcagcagtcgtagcgacgtcgggcgtcgggcttacgtacgtttcgggacgggtacgggaccgaagggttaggacgtagtaccgaaacgtaaccgttggtacggtacgtgaccgtaccacgttccgtcggttccttctaaccg

SEQ ID NO: 40390 - DNA, 522 bp, Homo sapiens
  misc_feature: GYAE6OF02FMXDJ.30.27.C05.1.454.CMB.1.raw
  modified_base (231)..(231): a, c, t, g, unknown or other
  misc_feature (231)..(231): n is a, c, g, or t
  modified_base (518)..(518): a, c, t, g, unknown or other
  misc_feature (518)..(518): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagngtgttggcactacatagcctggtaccaacagaaacctggccaggctcccaggctcctcatctatgatgcatccaaaaggcctctggcactcccagccaggttcagtgcagtggtcgtggacagacttcactctcaccatcagtacgcctagacgctagaagtatttcgacttagtttattacttgttcagtcagtcgtagcgtacgtggcgtgggctcgtcgtttcggcggacggacgaggtagagactacgaaacgtacgtaggtgacgtgacactactctgtctntacc

SEQ ID NO: 40391 - DNA, 578 bp, Homo sapiens
  misc_feature: GYAE6OF02F25CS.30.27.C05.1.454.CMB.1.raw
  modified_base (203)..(203): a, c, t, g, unknown or other
  misc_feature (203)..(203): n is a, c, g, or t
  modified_base (404)..(404): a, c, t, g, unknown or other
  misc_feature (404)..(404): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatggcaccggagaaagtgtgttgacacagtctccagccaccctgtctttgtctccaaggggaaanagccaccttctcctgcagggccagtcagagtgttggcacctacatagcctggtaccaacagaaacctggaccaggctcccaggcctcctcatctatgatgcataccaaaagggcctcgtggcactcccagccaggttcagtcgcagtggtcgtggacagacttcactctcaccatcagtcgccgtaagacgaccgtgaatntttcgacttagtttactacttgtacagtcagtacgtacgtcgtacgtggacggtggtcctcgtacgtttcggggacggaacgggaccgtaaggtacgaggtaactaccggtaaacggaacgttcgggtacggtaccgtcgaccgtactacgttcgtacgttacctacttacccg

SEQ ID NO: 40392 - DNA, 185 bp, Homo sapiens
  misc_feature: GYAE6OF02I36N6.30.27.C05.1.454.CMB.1.raw
  modified_base (174)..(185): a, c, t, g, unknown or other
  misc_feature (174)..(185): n is a, c, g, or t
tcagcacgctacgtcacgaccggtgctcgatttagacgcgatcgaagggtttggggggaagaggaagactgacggtcctcccaggagttcaggtgctgggcacagcggccctgggctgcctggtcaaggactacttccacgtagcgtgctgagcgggctggcaaggcgcatagnnnnnnnnnnnn

SEQ ID NO: 40393 - DNA, 725 bp, Homo sapiens
  misc_feature: GYAE6OF02G073N.30.27.C05.1.454.CMB.1.raw
  modified_base (373)..(373): a, c, t, g, unknown or other
  misc_feature (373)..(373): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttagacacagtctccagccacctgtcttgtctccgaggggaaagacgccaccttctcctgccagggccagtcagagtgttggcacctacatacgcctggtaaccaacgagaaacctggaccaggcctacccgaggcctcctcatctatgatcgactactaaccgaaacggcctcgtggcctactacccgacgtccgtaggttccaggtcggacgnggtacgggtcgtgggaaccgacgtaccttacgtacttccgtaccaacctactacgtacgtacgaccgtaacgacgtaccgtaggtaacgttacgttttacgacgtttaacgttttaacgttaccgttaggtttaccaacgggttaccgaacgggttacggttaacgggtaccgtttaccgggtcggggttaccgggttacgggtacccggtttaccgttaaccgggttttccgggggaaccgggtacggggtaacccgggtaagggtaacggtacggtaacgtaaccgaaaccggtacggttacggtacggtaccgtacgtccacgtacgttcttacgttaccttctacccg

SEQ ID NO: 40394 - DNA, 183 bp, Homo sapiens
  misc_feature: GYAE6OF02F64FG.30.27.C05.1.454.CMB.1.raw
  modified_base (174)..(183): a, c, t, g, unknown or other
  misc_feature (174)..(183): n is a, c, g, or t
tcagcacgctacgtcacgaccggtgctcgatttagacgcgatcgaagggtttggggggaagaggaagactgacggtcctcccaggagttcaggtgctgggcacagcggccctgggctgcctggtcaaggactacttccacgtagcgtgctgagcgggctggcaaggcgcatagnnnnnnnnnn

SEQ ID NO: 40395 - DNA, 901 bp, Homo sapiens
  misc_feature: GYAE6OF02I51WB.30.27.C05.1.454.CMB.1.raw
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagcncctaccttctcctgcgaggccagtcaggagttgtcgacctacctanagtacgcctacggtaaccaaacgaacgtaaacccgtcggacccgacggtaccctacccgacggtcccttccctactacttaccttatgtacttacggactaacgtaaccggaaaaacgggtcccttacggtacggtacctaaccgtaccccgtaacggacccggttaagggttaccgtaagggtaccggtaccgttaagggggttccggggtttacggtccggggtaaacgtacggtaacccgttttacgaaccgtttccctaacccgtaaccctacgtaccgtaacggttaccgtaacccggtaaaggtaccgtaccgttaagggtaaacgtttagttttaccggaacgtttaaggtttttaaccgttacgtttacggtaccgtaacggtaccgtaaacgggttacgttaacgggtaccgttaaccgggttcggggaaccgggttccgggttaccgtttaccggtttaacccggggtttccgggggaaccggggtaaaccggggttaaaccgggtaaaggggtaaccgggtaacgttaaccggtaaaccgaaaaaccggggttaggtttacgggtaaccgggtaccgttaaccggtaccctaacggttaccgtttaccgttacgtttacccgtttaacgtttaacccccg

SEQ ID NO: 40396 - DNA, 175 bp, Homo sapiens
  misc_feature: GYAE6OF02G8HEE.30.27.C05.1.454.CMB.1.raw
  modified_base (174)..(175): a, c, t, g, unknown or other
  misc_feature (174)..(175): n is a, c, g, or t
tcagcacgctacgtcacgaccggtgctcgatttagacgcgatcgaagggtttggggggaagaggaagactgacggtcctcccaggagttcaggtgctgggcacagcggccctgggctgcctggtcaaggactacttccacgtagcgtgctgagcgggctggcaaggcgcatagnn

SEQ ID NO: 40397 - DNA, 529 bp, Homo sapiens
  misc_feature: GYAE6OF02GQ6Y4.30.27.C05.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgctccaggggaaangccaccttntcctgcagggccagtcagagtgttggcacctacatagcctggtaccaanagaaacctggccaggctccccaggctcctcatctatgatgcatccaaaagggcctctggcatcccagccaggttcagtggcagtgggtctgggacagacttcactctcaccatcagtancctagacncctgaagtntttgctagtttattactgtcagtcagctagcgtactggcgtgggctctacgtttcggcggtagggaccgtaagggtagagtagtacgaaacggaacttggtcggctagccaccgatcctcgttacttctaaccg

SEQ ID NO: 40398 - DNA, 605 bp, Homo sapiens
  misc_feature: GYAE6OF02IJMFU.30.27.C05.1.454.CMB.1.raw
  modified_base (218)..(218): a, c, t, g, unknown or other
  misc_feature (218)..(218): n is a, c, g, or t
tcagcacgctacgtcacgaccggtgctcgatttagacgcgatcgaaggtttgggggaggaactgactcagttacggacccagagggaacccatggaagccccaagcctcagacttcctcgttccgtcctcgccttactctgggctcccagatcgaccaccggaggaacgtgtcgttggacacagtctccagcaccctggtccttgtctcgagggaaancgccaccttctcctgccagggccagtcagtagtgttggcaccgtacatagcctggtaccaacgagaaacctggccaggcctccaggcctccgcatctataggagtcgacagtaccgaaaggcctctggctatcccgagccgtagttacagtcgacagtcggtatcggacacgactacgactctacgactacgtcgtacgtacgacctagacgtcctagacgttacgtttgacttagtttagtacgtgtacacgcgacgtcgtacgtacgtacgttcggtcggtagtccgtacgtacgtttaccgggacggtacggaaccgtagggtagacggtacttaacgaacgtacgtgtcgactgtactacgtagttcgagttccgtactaccg

SEQ ID NO: 40399 - DNA, 361 bp, Homo sapiens
  misc_feature: GYAE6OF02F2C87.30.27.C05.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (345)..(361): a, c, t, g, unknown or other
  misc_feature (345)..(361): n is a, c, g, or t
tcagcacgctacgtcacgaccggtgctcgatttagacgcgatcgaagggtttgggggaggaactgctcagttaggacccagagggaaccatggaagccccagctcagcttctcttcctctgctactctggctcccagatgccaccggagaaagtgtgttgacacagtctccagccacctgtctttgctccgaggggaaancgcctaccttctccgtgcagggccagtcagngtgttggccacctanatacgccgtagtacccaacgagaaaccctggaccaagggcctacccgaggccttccgtcacttcctaagtgactggaccacgtaacccgaaaaccgggnnnnnnnnnnnnnnnnn

SEQ ID NO: 40400 - DNA, 618 bp, Homo sapiens
  misc_feature: GYAE6OF02H2LUS.30.27.C05.1.454.CMB.1.raw
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
  modified_base (433)..(433): a, c, t, g, unknown or other
  misc_feature (433)..(433): n is a, c, g, or t
tcagcacgctacgtcacgaccggtgctcgatttagacgcgatcgaagggtttgggggagggaacgtgctcagttaggaccagagggaaccatggaagcccagctcagcttctcttcctcctgctactctggctcccagatgccaccggagtaaagtgtgtgacacagtctccagccaccctgtctttgctcaggggaaagntcccacttctcctgcagggcctagccagtagtgttggacacctcgatacnctggaaccaanacgaaactgacagactccacgactccnactntactagntgcactacaaaacggtccactggctacaccccagtaccgtggttacacggtcgacgtacggnggttacggtcgggacagacgttacgctacgtccaccatcaggtacacgtacagtacctagacgtagtttancgttaagttatttacgtattcgtacgatacggtagtacgtcgacggttcggtacggtgggtacctaggttaccgtttacggggccggggtaacgggaaccgggttaagaacggacggttaacgaacgtaaaacggacggttacgacgttacggctaccgactaccgtagttcttcttaccggtac

SEQ ID NO: 40401 - DNA, 919 bp, Homo sapiens
  misc_feature: GYAE6OF02JQZA7.30.27.C05.1.454.CMB.1.raw
tcagcacgctacgtcacgaccggtgctcgatttagacgcgatcgaagggtttgggggagggaactgctcagttaggacccagagggaaccatggaagccccagctcagcttctcttcctcctgctactctggctcccagatgccaccggagaaagtgtgttgacacagtctccagccaccctgtctttgtctccgaggggaaagacgccctaccttctccgtgaccaggggtcccagttccaggtagttcggttgggacctaccgtactagttaccggccgttacgggaacccaaacgaacggtaaaaccccgttcgggaccccgtaacggggccctttcccccggaaaggggtcccctttcccgtaccctaacgtttaccctaagttcggtaaaccgttacggacccttaaaccggttaaaccccgaaaaacggggggtcccctccggttaccggggacctaaccgggttacccccacggtaacccgttacggtttacaacggggttcggtaccggtaacggggttcggggtttacgtccgggggtaaacctaccggtaacctttactaacccgttccgttaaccgaaacccctagttttacggaaccggttaccggtaacccgtaagggtacctaaccggttacgtaacggttacgtttttaccggactttaaccgggttttaaacttaccgttaccggtcgtaaccgtctaacgggttctaaagggtcccgtaacggttccgggagggtttccggtaccgttcccggtttaacggttccggggtaccgggaaacggttaacccgaaggggtttcggaaccgtttagtaccggtaaaacccggtgttacgggtaaccggttcgttacccggaaccttaccgtaccggttagtttccggttacccgttagtaaccccc

SEQ ID NO: 40402 - DNA, 715 bp, Homo sapiens
  misc_feature: GYAE6OF02ILIN9.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagtttaggacccagagggaaccatggaagccccagctcagcttctcttcctcctgctactctggctcccagatgccaccggagaaagtgtgttgacacagtctccagccaccctgtctttgtctccgagggaangccaccttctcctgcgagggccagtcagagttgttcgcacctacatacgcctaggtaccaacgagtaaacctggaccacggtcctacccgaggtcctccgtcatactagtgatcgactacgtaccgaaaacggtcctacgtcggacctactcccgacgtaccgtaggttacgtacggtcggacgtaggtcgggtcgtacgggacgtacgtaccgttacgtacgttacctaccgtaactacgttacgtacgtactaccgttagacgtccgtaacggtagttagtttttaggttaacgtttattacgtacgttacgacggttacgacgttacggtacgtcgtaacggttcgggtacgggttacggttccttaccgttacggtttccgggacgggtaaccgggtaccgtaagggttacgaaggtaccgtaaaccggtaacggtaacggttacggtacggtacgtaccggaccttacgtacgtttccgtacgttaccgtttactaccgtttaccccg

SEQ ID NO: 40403 - DNA, 729 bp, Homo sapiens
  misc_feature: GYAE6OF02GDCL7.30.27.C05.1.454.CMB.1.raw
  modified_base (204)..(204): a, c, t, g, unknown or other
  misc_feature (204)..(204): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaaggggaaagngccaccttctcctgcagggccagtcagagtgtggcactacatagcctggtaccaacacgaaacctggccaggcctacccgaggcctcctcactctatgactgacacgtaccgaaaagggcctcgtcggccactccccgagaccgtaggttcgaggttcggacgtagggtggggtcgttagggacgtacggtacgttctacgttcctaccgtaacctacgtaccgaacgtaccgtaccgtacggtaccggtacccgtagtaaacggttaagtttttggaacgtttaacggttttaactttaccgttaggttacgtacggtacgtacggttaccgtaacggtacccggtacgtacggggacggttcggggtccttaccggttacccgggtttccgggaccggggtacgggtaaacccggagggttaacggacggttaaccgtaaccggtaaaaccggtaaccggttagggtacggtaccgtcgaaccgtaccgtacgtaccgtttacggttcccttacgttaccccg

SEQ ID NO: 40404 - DNA, 595 bp, Homo sapiens
  misc_feature: GYAE6OF02FWRY1.30.27.C05.1.454.CMB.1.raw
  modified_base (203)..(203): a, c, t, g, unknown or other
  misc_feature (203)..(203): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagngccaccttctcctgcagggccagtcagagtgttggcacctacatagcctggtaaccaacagaaacctggccaggcctcccaggctcctcatctatgatcgcactaccaaaacgggcctcgtcggcactcccacgccgtaggttcagtcggcgaggtcgggtcgtgggacacgtacttcactctcacctatcagtacgcctaagacgtccgtagtaagttatttagtcgttaagtttacttacttcgtacgtagcgtagtcgtacgccgtacgtcgggtcggtcgggtcttcgtaccggtttcggacgggtacggaaccgtaagggtacgagtactaacgaacgtaacgtcggtacgtacgtcgaccactacgtcgttcgttaccttctaccg

SEQ ID NO: 40405 - DNA, 837 bp, Homo sapiens
  misc_feature: GYAE6OF02J0GVJ.30.27.C05.1.454.CMB.1.raw
tcagcacgctacgtcacgaccggtgctcgatttagacgcgatcgaagggtttgggggagggaactgctcagttaggacccagagggaaccatggaagccccagctcagcttctcttcctcctgctactctggctcccagatgccaccggagaaagtgtgttgacacagtctccagccacctgtctttgtctccgaggggtaaagagccctaccttctccgtagccgtacgggccaggttccaggtacgttggttcgggaccacctactaacgttaggcccgttaggttaacccaaacgtaacgaaacccgttacggccaacgggcctaccccgaagggtcccttccccgtactaacgttccttaacgtcgtacgtcggtactaaccgtaaccgaaaacggggtccctacgtacgggacctaccgtaacccgtacggtacccgtacggggtttacccacgggttggggtaccgtacggggttacggggttacccgggtcgggggtaaaaccgtacgggttaaaccgttttaccctacccgtttaacccggacccttaaccccgtacgttacggtaccggtaacggttacccgtaagtaccggttaccgttaacggtaagttacgtttcgtaaccgtttagtttaccgtttaactcgtttaccgaacgtacgtacgtaggtacgtaccgtaggtgggtaccggtcgggttaccttcggtacccggtttcggggaacggtacggtaacggaaggtaagtgtaacgttaaccgagttaacggcggttaaccggtactacgacccgttacgtacgttacgtcgttacccgttcgttaacccg

SEQ ID NO: 40406 - DNA, 179 bp, Homo sapiens
  misc_feature: GYAE6OF02FOYFZ.30.27.C05.1.454.CMB.1.raw
  modified_base (172)..(179): a, c, t, g, unknown or other
  misc_feature (172)..(179): n is a, c, g, or t
tcagcacgctacgtcacgaccggtgctcgatttagacgcgatcgaagggtttgggggaagaggaagactgacggtcctcccaggagttcaggtgctgggcacagcggccctgggctgcctggtcaaggactacttccacgtagcgtgctgagcggctggcaaggcgcatagnnnnnnnn

SEQ ID NO: 40407 - DNA, 179 bp, Homo sapiens; identical to SEQ ID NO: 40309
  misc_feature: GYAE6OF02HWDQ1.30.27.C05.1.454.CMB.1.raw
  modified_base (173)..(179): a, c, t, g, unknown or other
  misc_feature (173)..(179): n is a, c, g, or t

SEQ ID NO: 40408 - DNA, 644 bp, Homo sapiens
  misc_feature: GYAE6OF02F1TID.30.27.C05.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
tcagcacgctacgtcacgaccggtgctcgatttagacgcgatcgaagggtttgggggaggaactgctcagttaggacccagagggaaccatggaagcccccagctcagcttctcttcctcctgctactctggctcccagatgccaccggagaaagtgtgttgacacagtctccagccaccctgtctttgtctccaggggaaanagccaccttcncctgcagggccagtcagagtgttggcacctacatagcctggtaccaacagaaacctggcaggctcccaggctcctcatcctatgatgcataccaaaagggcctcgtggacatcccagccgaggtttcaggtggcaggtcgggtcgtgggaccaggactttccgacttcgtaccaacctatcgagtaccgtaccgtagacgtcctaggaaagttgttttcgactaggttttaacttacttcgttctacgcctagtcgtacgccggtaacgtcggggcgttcgggccttaccgtacgttttaccgggggacggaacggggtaacccgaaggggttacggagtaaccgtaacgaaaaccggaacgttcgggtacggtaccgttaggacccgtacccgtaagttcccgtaggtttacccgttaccgttaacccg

SEQ ID NO: 40409 - DNA, 796 bp, Homo sapiens
  misc_feature: GYAE6OF02GFUUY.30.27.C05.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtagttgacacagtctccagccacctgtctttgtctccaggggaanagccaaccttcncctgcagggccagtcagagtgttggcacctagataggacctggtaaccaaacagaaacctggaccaaggctaccccaggcctaccctcctaatctactgatagctaactaccgaaaaacgggtcctactacgggacacgtaccccacggcctaggtttaccaagtggaccgtaggtggggtccttacggggacctaaggactttacacttacctaccgtaacccacttacaacgttacgaccttaacgacgtacccgtagtaaacgttattttacgaacgtttaaacggttttaaacgtttaacttacgggttaccctaaaggtactaacgggtaccggtttaacggacccggttaaaaccggttccgggtaacccgggtttcggggtaccctttaaacccggttaaccgggtttttacccggggaaccggggtaaaccgggggttaaccggtaaaaacggggttacggtaacggtaacgttaaaaccggaaaaaccgggtaaacgttacggggttacggtaaccgttacggaaccgttacccgtaaagttcccgtttaccgttacccgttaccgttaacccc

SEQ ID NO: 40410 - DNA, 1096 bp, Homo sapiens
  misc_feature: GYAE6OF02H14A4.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaanagcccaccttctcctgcagggccagtcagagttgttggaccaccttacatacgcccgttaggtaacccaaacgtttaacggaaaacccgtcgggacccgaacggggcccttacccccgaacggggacccttccccgttacctaaccttaccgttaacgttcggaacttcggtaccgtaacttaaaccccgggtaaaaaaaccgggggtcccctttaccggttaccggggtaccctaaaacccgttccccccgtaaacgggtaccccgttaacgggggtttttacccggtaaacgggttaccgggggtacccggttaacgggggtttcggggggttttaacccgggttagggggggttaaacccttaaacgggttaacccgtttttaccccgtaaccccggttttacccgtttaacccctaaacccccgttaaacgttaacccgttaaaccggggtttaaacccgttaacccggttaacggtaacccgggtaacccggtttaacggtaaaacgggttttaacgtttttttacgggaaccgttttaaaggtttttttaaaccggttttaaccgtttacggttaaccgtaaccgggttaaccgtaacggggtttaccggttaacgggtacccggttaacgggttaccgggggttaccgggttacggggttacccgtttacccgggtttaacccgggtttttacccgggggaaccggggggttaaaaccggggtaacccgggtaaaacgggggtttaacgggaaaccgggtttaaccggtaaacccgggtaaaacggttaaacccgggttcgggttaaacccgggttaccgtaccggtaccgttaacccggttaaccgtttaccggtttaccgtttacccgtttacgttaaccccccg

SEQ ID NO: 40411 - DNA, 899 bp, Homo sapiens
  misc_feature: GYAE6OF02JCUNG.30.27.C05.1.454.CMB.1.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
tcagcacgctacgtcacgaccggtgctcgatttagacgcgatcgaagggtttgggggaggaactgctcagttaggacccagagggaaccatggaagcccccagctcagcttctcttcctcctgctactctgctcccagatgccaccggagaaagtgtgttgacacagtctccagccaccctgtcttgtctccgaggggaangcctaccttctcctgcncggccagtcagtagtgttcggccaccgtacatagccctacggttaacccaacgtaacgaaacccgtggacccaagggtcccctccccgaacggtcctacccctcaactcctaattacgacttcggacctaagtaacccgaaaaacggggtccctcggcggctaccgtccccgtaacgcccggttaagggttccaaggtcgggtacgtacgggttgggttaccggtcgggaacgacgttaccgtttacctaccgttacccgtacctaaccctaacgttccgggtaaacgttaccggtacccgttaacggaaccggtacccgttaacggttaaacggtttaacgttttagtaacccgttttaaaggttttaacgtttaccgttagttacccgttaaagggtcccttaacgggtacccggtaacgggtaccggttaacccgggttggggacccgggttaccggggttaccgttacccggttaacccgggttttccgggggaaccggggtaaacccggggttaaacccggtaaggggtaaccgggtaaaccgtttaacggaaacccggttaaaaccggtaacccggggttacgggttaccggtaacccggtaccggttaacccccgtaaacccggttcccggttttacgtttacccggtttaccctttaccccgttaaccccccg

SEQ ID NO: 40412 - DNA, 706 bp, Homo sapiens
  misc_feature: GYAE6OF02GT1BZ.30.27.C05.1.454.CMB.1.raw
  modified_base (203)..(203): a, c, t, g, unknown or other
  misc_feature (203)..(203): n is a, c, g, or t
  modified_base (347)..(347): a, c, t, g, unknown or other
  misc_feature (347)..(347): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaaanagccaccttctcctgcagggccagtcagagtgttggcacctacatagcctggtaaccaacagaaacctggccaggctcccaggctcctcatctatgatgcagtaccgaaaaggcctctggcactcccgagcccgaggtttaccngtacggcgtaggtcggggtacgtggggaactacgtacgttcaccttccgtccaaccctaataccgtaaggtaccgtacccgtaacggacgtaccccgttaagtaaacggttaattttcggactttaaggttttaacttaaccgttgttacctacggtacgtacgtcgtaacgtacggtacgtgggtaccggttcgggtccttacgttaccggtttaccgggacggggtaaccgggtaacccgaaagggttaacggaacggtacgttaaccggaaaaccggttaacgttacggggttaccggacgttaccggtaccgtaaccggtacgtttaccggttcggttacccttacgttaccccg

SEQ ID NO: 40413 - DNA, 628 bp, Homo sapiens
  misc_feature: GYAE6OF02IVDXK.30.27.C05.1.454.CMB.1.raw
  modified_base (411)..(411): a, c, t, g, unknown or other
  misc_feature (411)..(411): n is a, c, g, or t
  modified_base (442)..(442): a, c, t, g, unknown or other
  misc_feature (442)..(442): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctgctcccagatgccaccggagaaagtgtgttgacacagtctccagcccaccctgtctttgtctccgaggggaaagacgccaccttctccctgcagggccagtcagagtgttggccacctacagtacgccgtaggtaacccaacgtaagaaacctgggaccctagggcctccccgaggcctcccgtcactctatgactgactataccgaaaacgggcctcgtacggcactcccgacgtccgtaggttcgagtggctagggtggtcgtggactagacttcactcncaccatacagtacgctagacgctagtaagtnttgacttagtttactatgtacgatcagcgtagccgtagtcggtacggtggtccttacgttaccgggtttacggacgggaccggtaaaccgtaggggtaccgaagtactaaacccggtaaaacgtaacgtgggttaacgaccgttagaaccctaccgttagttccgttcgtttcctccgttaacccg

SEQ ID NO: 40414 - DNA, 607 bp, Homo sapiens
  misc_feature: GYAE6OF02HVR81.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgagggaaagagccaccttctcctgcgaggccagtcagagtgttggcacctacatacgcctggtaccaacagaaaccgtggccaggcctcccgacggcctcctccatctatgatgcactaccgaaaacgggcctcgtcgcactcccgagccgacggttcaggtgcgtgtcgggtcgtgggacgtagtacttcactcgtcaccagtactagttacgacctagacgtcctagaaaggttattttcgacttacgttttattacttgtactagtcgacgtcgtaggccgtacgtgggtcgtgggtacctacgtaccggtttccgggcggggtaacggaccgaaagggtgtaacgtatacggaaaccgtacgtaggtacggtaccgtagaccgacgtactttcgtcgttcttacttcccg

SEQ ID NO: 40415 - DNA, 557 bp, Homo sapiens
  misc_feature: GYAE6OF02GBTTK.30.27.C05.1.454.CMB.1.raw
  modified_base (200)..(200): a, c, t, g, unknown or other
  misc_feature (200)..(200): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccacctgtctttgctccaggggaaangccaccttctcctgcagggccagtcagagtgttggcacctacatacgcctggtaccaacacgaaacctggccaaggcgtccccaggcctcctcatctatgatgcatccaaaagggcctctggcatcccagccaggttcagtgcgagtgggtctggacagacttcactctcaccatacagtagcctagacgcctgaagtatttgtactagtttattactgtcagacgagtcgtagtacgacgttggacggtggactcgtacgtttacgggcggacgggaccgtaaggtagaggtacgtacgaaacggtacgtacggtggactaggacctacgtacttcgttcgttacttcgttacccg

SEQ ID NO: 40416 - DNA, 183 bp, Homo sapiens
  misc_feature: GYAE6OF02FSRN1.30.27.C05.1.454.CMB.1.raw
  modified_base (172)..(183): a, c, t, g, unknown or other
  misc_feature (172)..(183): n is a, c, g, or t
tcagcacgctacgtcacgaccggtgctcgatttagacgcgatcgaagggtttgggggaagaggaagactgacggtcctcccaggagttcaggtgctgggcacagcggcctgggctgcctggtcaaggactacttccacgtagcgtgctgagcgggctggcaaggcgcatagnnnnnnnnnnnn

SEQ ID NO: 40417 - DNA, 856 bp, Homo sapiens
  misc_feature: GYAE6OF02JV4TT.30.27.C05.1.454.CMB.1.raw
  modified_base (171)..(171): a, c, t, g, unknown or other
  misc_feature (171)..(171): n is a, c, g, or t
tcagcacgctacgtcacgaccggtgctcgatttagacgcgatcgaagggtttgggggagggaactgctcagttaggacccagagggaaccatggaacgccccagctcagcttctcttcctcctgctactctggctcccagatgccaccgagaaagtgtgttgacacagtcncagccaccgtgtcttcgtcctaccggaaggggaaacgtacgaccctacccgttttccgtaccttcggaccggtacggggacctagtaccgaaggttgggttcggttacgggacctacccttaaccacgttaccgcccgttacgggttaaacccaaaacctaacggtaaaccccggtcggtacccggaacggtccccgtaaccccggacggtacccttacctccgtaacttacgtacgtacgtactccgaccgtacgtaaaccggtaacgggtcccttcggtacgaccgtccgtaccccgagtacccggtaacgggttcgtaaggtcggtacgttacggggttacggggtactacgggggtaacctacggttacccttacgtaccgtcgtaaccaaccgttaccgttggaaacggttaccaccggttacgtaaccggtccgttaaggtaacgtttacgtttcggtaaacgtttaacgttttaacgtttcggtaaccggttacgtacgtacggtacggtacggtacgaccggtttccggtcgggtcgttccgggacttcgggttaaccgggtacggggtaaccggtacgggtaagaaccggttaagtacggttaaacgtaaccggtaagtccggttagtccggacttacccggacgtccttaacgtgttttacgtccttacgttccc

SEQ ID NO: 40418 - DNA, 764 bp, Homo sapiens
  misc_feature: GYAE6OF02HTEQK.30.27.C05.1.454.CMB.1.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaaanagccaccttctcctgacagggccagtcagagttgttggcacctacatagcctaggtaaccaanacgaaacctggaccaggctcccgaggtcctacctcactactatgatcgacacgtaccgaaaaacgggtcccttcgtcgggactaccgtacccacggtacccgtaacgggttacgtaacggtcgggtaccgtaggggttacggggtaccggtacggggaaccgtaacggtaaccgtttaccgtaccgttaccttaaccctaaccgtaactaccgtaacggttacgaaccgttaacggaaccgtacccggttaaggtaaacgttacgttttacgtacgttaacgttttaacgttacgttacgttacgtaggtcgtacggtacggtaacgccgtacgggttcggtacgggttcgggtacgttccggtaaccggtttccgggtacggggtaacgggtaacccggtaagggtacggtaaggtaacgtaaccggtaaaacggtaccggttagggtacgcgttacgaccgtaccgtagttccgttcgttccgttaccgttacccg

SEQ ID NO: 40419 - DNA, 777 bp, Homo sapiens
  misc_feature: GYAE6OF02H2J9S.30.27.C05.1.454.CMB.1.raw
  modified_base (150)..(150): a, c, t, g, unknown or other
  misc_feature (150)..(150): n is a, c, g, or t
  modified_base (206)..(206): a, c, t, g, unknown or other
  misc_feature (206)..(206): n is a, c, g, or t
tcagcacgctacgtcacgaccggtgctcgatttagacgcgatcgaagggtttgggggaggaactgctcagttaggacccagagggaaccatggaagccccagctcagcttctcttcctctgctactctggctcccagatgccaccggaanaaagtgtgttgacacagtctccagcctaccctgttctttgtcctcgaaggggaaancgccctacctttctcctgcacgggccagtcagtagttgttggcctacctacatacgcctaggtaaccaacgaacgtaaaccgtcggaccaacggtccttaccccgacggcctccctctacttctatagactcgacctaacgtaaccgaaaacgggtccctttacgacggtaccaaccgttaccccgacggtaccgttacggttaccgacgggtcggtacgtagggttcggggtacgtacgggaactaacggtactcgtaccttcgtacctaaccgattaccgaacggttacgtacgttacggacggttaccgtaacggtaaagtttacgttttacggtaacgtttaacgttttaactttaccgttacgttacgtacgtacgtacgtacggtacggtaccgtacgggttcgggacgggtaccgggtaccttaccgggttacgtttacccggggaacgggtaaacgggaaccggtaaggggtaagtacggaacgttaaccggaaacgttaaccggttagggtacggcgttacgaaccgttaccgtacttcgttacgttccttaccgttacccg

SEQ ID NO: 40420 - DNA, 791 bp, Homo sapiens
  misc_feature: GYAE6OF02HRUM1.30.27.C05.1.454.CMB.1.raw
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaaggggaaangcccacttctcctgcagggccaggtccaggtagtgttcggctacctanatacgcctggtaaccaacagaaacctggaccacggcctcccgaggtcctccgtcatctatgatcgctaacgtaccgaaaacggggtcctacgtcggaccgtacgttaccccgacggtacccgtaagggttccgaacggttcggggtacgtacggggttcggggttcggtacggggtaaccgtaacggttaaccgttccgtaaccgttcctaccgaaccctacgttaccgtaacggttaccgtacccgtaaaggtaccggtacccgttaaggtaaacggttacgttttcgtaacgttacgtttttaaacgtttacgttacgttacgtaacggtacgtacggtacggttacggaccggtacggttacgggtccggttcgggtaccttccggttaccggtttcccgggggaacggggttaacggaaacccggttaaggggtaccgtagggtaacgtaaaccggtaaacggttaccgttaagggtcggtaccgttacggacccgtaccgtaaccttcggtttacgttccgttacttaacccgg

SEQ ID NO: 40421 - DNA, 751 bp, Homo sapiens
  misc_feature: GYAE6OF02JXJ9B.30.27.C05.1.454.CMB.1.raw
  modified_base (213)..(213): a, c, t, g, unknown or other
  misc_feature (213)..(213): n is a, c, g, or t
tcagcacgctacgtcacgaccggtgctcgatttagacgcgatcgaagggtttggggggaggaactgctcagttaggacccagagggaaccatggaagccccagctcagcttctcttcctcctgctactctggctcccagatgaccaccggaagtaaagtgtggttcacacagtcctaccacgccaccctgttctttgtcctccgaggggaaancgacccaccgttctcctagcaggtcctagtcgagtaggtgttgaccgtacctaactatacgtccttacgggtaaccctaaacgaacgtaaacccgtggtaccacggcctacccggacggtacctacccgtacagttactaactcggtactacggactaacgtaaccgaaacgggtcctacgtcgacctaccgtaccgaactcggtagttaccgacggttaggacgagggttcgggtacgtacgggtacacggtttactacgtacgttccacctaccgtattacgtacgtaacgaccgtacgtacgtacgtacgttaacgttagtttcgttacgttacgtttacgttacgttacggtacgtacgaccggtagtacgtacggtacggttacgttaccggggtcgtcgtaccgttaccgtacgggtttaccgggaccgggttacggaacggttaggtaagacgtacggtaaccggtaacggtacggttacgacggtcgtacgaccttaccggtacgttacgtaccgttacgtacgttaccc

SEQ ID NO: 40422 - DNA, 786 bp, Homo sapiens
  misc_feature: GYAE6OF02IBMC3.30.27.C05.1.454.CMB.1.raw
  modified_base (218)..(218): a, c, t, g, unknown or other
  misc_feature (218)..(218): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatcgccaccggagaaagtgtgttgacacagtctccagccaccctgtctttgtctaccgaagggaagacgtcctaccttcncctgcgaggccagtcagagtgtgcacctatatacgctacggtaccaacgtacgaaacctcggaccgacggtaccctacccgaggtcctccgtactacgttacgtagtacggtacgtcgtaacgtaaccgttaaccggaaaaccgggttcctaccggttaccggacctaccgtacccgacggtaccgtcggttaacggacgtacggtacggtacggggtgggtacggtacgggtacgtacgtactaccgtacctaccgtacctactactacgtaacgtacgtacgtacgtacgtccgtagtaacggttacgtttatacgttaacgttttacgtacgtcgtacgtaaccgagttaacgggtaccttacggccggttggtaccgggtcccgggttagggtccttttacccgggtacgggtttacccgggaaggggtaacccgggttaacgtaaacgggggttaacgaacggttaaccgtaaccgggttaaacgtaaccggttaggggaaccgttacgaccggtaaccgacgttccgtttaccggtccgttacccgttaccgttaaccccgg

SEQ ID NO: 40423 - DNA, 202 bp, Homo sapiens
  misc_feature: GYAE6OF02FSC66.30.27.C05.1.454.CMB.1.raw
  modified_base (173)..(202): a, c, t, g, unknown or other
  misc_feature (173)..(202): n is a, c, g, or t
tcagcacgctacgtcacgaccggtgctcgatttagacgcgatcgaagggtttgggggggaagaggaagactgacggtcctcccaggagttcaggtgctgggcacagcggccctgggctgcctggtcaaggctactccacgtagcgtgctgagcgggctggcaaggcgcatagnnnnnnnnnnnnnnnnnnnnnnnnnnnnnn

SEQ ID NO: 40424 - DNA, 746 bp, Homo sapiens
  misc_feature: GYAE6OF02IKMAZ.30.27.C05.1.454.CMB.1.raw
  modified_base (202)..(202): a, c, t, g, unknown or other
  misc_feature (202)..(202): n is a, c, g, or t
  modified_base (326)..(326): a, c, t, g, unknown or other
  misc_feature (326)..(326): n is a, c, g, or t
tcagcacgctacgtcacgaccggtgctcgatttagacgcgatcgaagggtttgggggaggaactgctcagttaggacccagagggaaccatggaagcccccagctcagcttctcttcctcctgctactctgctccagatgccacggagaagtgtgttgacacagtctccagcccaccctgttctttgtctccgagggaaagngcccaccgtttctccgtgcgacgggccagtcgagtaggttgttcggacacctacagtacgtcgtacggtaaccaaacacgaaaccgtggacccgaggccgtccgagcctcgtccattctagtcngtacgaccaacgtaccgaaacgggtccctagtcgacctaccgtaccgtaacgtacccgtaccggttagacgggttagccggtaacgggtttcgggtacgggtaaccggtacgtaccggttaaccgttcctaacccgtaccgttacccgaacccgttagtaaccgtacggtaacgtaccgtaacgtaccgtaccgttaaggtaaacgtttagttacgttacgttaagttttacgtacgtacgtacgtaccgttacgtaccggtagtaaccggtcgttaacggtcggtcggtacgtccgttacgttaccgggttcggaaccgggtacggaacggtaagggtacgtaggaacgttacggaaaccggtacgtcggtaaggtacctaccggccgtaactccgttcgtcgttaccgttcttacccg

SEQ ID NO: 40425 - DNA, 744 bp, Homo sapiens
  misc_feature: GYAE6OF02IOCMD.30.27.C05.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
tcagcacgctacgtcacgaccggtgctcgatttagacgcgatcgaagggtttgggggaggaactgctcagttaggacccagagggaaccatggaagcccccagctcagcttctcttcctcctgctactctggctcccagatgccaccggagaaagtgtgttgacacagtctccagccaccctgtctttgtctccgaggggaanagccaccttcncctgcagggccagtcagagtgtgcacctanatagcctggtaccaanagaacctggccaggcctcccaggctcctcactctatgatgactacgtaccgaaaagggtccctacgtcggcctactccccgacgaccgtaggttccgtaggtcggcgtacgggtgggttcgtacggggactacggacctttacaccgttctacctaacccgtagtaccgaggttaacgacccgttaacggaaccggtccgttaaggtaacggtttaacgttttcggacgtttagttttaacgtttaccgttcggttaccgtaggtaccgtacgtacgtacgggtcgaacgggttcgggtacgggttcgggtaccgttacggttaccgggtttaccggggtaccgggtaacggggtaaacccgggtaaagggttacgggtaacggtaacggtaaacggtaaaccggtaaccggttacggtacgggtaccgtacggtacccgtaaccgttacgtttaccgttaccggttacctttacgtaccccgg

SEQ ID NO: 40426 - DNA, 877 bp, Homo sapiens
  misc_feature: GYAE6OF02I9NH8.30.27.C05.1.454.CMB.1.raw
  modified_base (202)..(202): a, c, t, g, unknown or other
  misc_feature (202)..(202): n is a, c, g, or t
tcagcacgctacgtcacgaccggtgctcgatttagacgcgatcgaagggtttgggggaggaactgctcagttaggacccagagggaaccatggaacgccccagctcagcttctcttcctctgctactctggcctccagatcgccacggagaagtgtgttgacacacgttctccagccacctgtcttgtcctccgaggggaancgcctaccttcgtacctgcgagggccagtcgagtacgtgtcggaccacgtacgtactacgaccgtggaacctaacgaacgaaccgttcggccggtacggtcctcccgtagggtccttccctacgtaacgtccgttaaagtcgtacgtacggaccgttaacgaaccggaaacgggtcccttagtaccgggtacctccgtaacccgtaccggtaaccggttcggttaccggacggttcggtacggtacggggtacccggggtacggtcggggaaaccgtaccgtttaaccggttccctaacgtttcccccgaacgtaaacccgttccgtaaacccggtacggttaacgtaccccggttaacgggttaacgtacccgggttaaagttaaccgggttttacggtttaccgggttaacggtttaacgttttaaccggtttaccggttaaacggttccgttaaccgggtacgttaaaccgggtacccgggtagtttaaccgggaacgggttcgggtaaccgggtttcgggtacccttaacggggtaccgttttacggggacgggtaaccggttaacgggaacggtacggtaccgttaacggaaacggttccggtaaaggtccggtttcggacgttaccggtacgttaaccttcggtaccgttaccgttcctaccgttccgg

SEQ ID NO: 40427 - DNA, 847 bp, Homo sapiens
  misc_feature: GYAE6OF02GJKW5.30.27.C05.1.454.CMB.1.raw
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (335)..(335): a, c, t, g, unknown or other
  misc_feature (335)..(335): n is a, c, g, or t
  modified_base (407)..(407): a, c, t, g, unknown or other
  misc_feature (407)..(407): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggcctcccagatgccaccggaagaaaggtgtgttgacacagtcctccagcccctaccgttgttcttttgtcctaccggaagggggaaagtacgccctacctttctccgtgacgacggccagtcgaagtggtggttcgccacctanacgtcnccgtacggaaccaacaacgaacctgcagcctccgagtctacctctactactacgngtacgtcgactaacgtaaccggaaacggtcctacggacggacctaacctccgacggtaccgtacggttacgngggttcggacgtacgggtggggtttacggtacggggactaacggttccttaccgtaacgttcctaccgacctaacgtaccgaaggttccggtaacgtaaccgtaccgttacgtaacggtaagtttaacgttttacgttaacctttaaggttttaaccttacggttaacgttccggtaacgttaccggaagttacggggtaccggtacgggtaacgggttggggtacccggggttgggtacccgtttcgggtttaacccggtttccggggggtaaaccggggtaacccggggttaaaccggggtaaaccgggttaacgggtaagggttaaaccgtaacccgggtaaaaccgggttaacggttagggtttaccggtcggttaaccggtacccttacttaaccccgtttcgtttaaccgtttaccgttaccccgtttaacccc

SEQ ID NO: 40428 - DNA, 763 bp, Homo sapiens
  misc_feature: GYAE6OF02FOFLH.30.27.C05.1.454.CMB.1.raw
  modified_base (205)..(205): a, c, t, g, unknown or other
  misc_feature (205)..(205): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (345)..(345): a, c, t, g, unknown or other
  misc_feature (345)..(345): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgaccaccggagaaagtgtgttgacacagtctccagccaccctgtctttgtctccgaaggggaagngcctaccttctcctgcagggccagtcagagtgttggcacctanctagtcctggtaccaanacgaaacctggccctaggccaccgacggcctccgtctactctatgatcgtacactacccgaaacggtcctgcggactacncccgtagaccgtaggttccgaggtcggacgtaggtcgggtacggtcgggtactacgtaccgttaccgaccttacccgtactaaacccgtagtaccggtaacgtaccggtaccgtaacggtaccggtacccttaagggtaacgttagttttacgacgtttaacgggtttttactaaccggtttacgtacgttacgaccgtaacggtacgttaccgggtaacggtaccgttcgggggttaccggttcgggtaccttaccgggttacccgggttttaacggggaccgggtaaacggggtaacgtaagggggttaaccgacggttaacgtaaccggtaaaaccggtaccggtttagggtcggtaccgttaccggtaactcccgtaaacgtttcccggttactttaccgtaccgttaaccccg

SEQ ID NO: 40429 - DNA, 1021 bp, Homo sapiens
  misc_feature: GYAE6OF02JWJF2.30.27.C05.1.454.CMB.1.raw
tcagcacgctacgtcacgaccggtgctcgatttagacgcgatcgaagggtttgggggaggaactgctcagttaggacccagagggaaccatggaagccccagctcagcttctcttcctcctgctactctggcctcccagatcgccaccggagaaagtgtgttgactacagtctccacgtcccacccttgttcgtttcgtaccttccgaagggggaaacgacgccctaccttcctccctcgacgacgggaccgacgtacgaggtacggttcgttcggacctacctaactagttaacgtcccgttaaccggttaaacccaaaccgtaaaccggtaaacccgtcgggacccgtaacggggtccccttaccccggacggtaccccttccctacgttaccgttacgtaacgtagtaacgtcggtaaccctaaccggttaacccggtaaaaccgggtcccgttaccggtaaccgggttacccgtaacccgtacccccggtaaccggtaccccgtaacggttttaaccggacggggttcggaaccgggtttacgggttccggggtaccggtaccggggtaaaccgttaccggttaaccctttacccgtacccgtttacccgaccccttaacccgtaacgtttaacccggaacgttaaccccggtacccgttaaacgggtaaccggttaaccccggttaaagggtaaacgtttttaaccggtttacgtaaccggttttaaacgtttttaccgttaacggtttaaccttacggtaccgtacggttaaaccgtaccgttaccgggtaccggtacggttaaccgggtcgggttacccgttaccgttccgggtttaaaccggggttccggggaaaccgggggttaacccggaaacggtttaaccggggtaacggtaaccggttaaaccgttaaccggggtaaaccggtttaaccgtacgggttacccggtaaccgtttaccgaacccgttacgttccgttaaccggtttcgttacccgttacgtttacccccg

SEQ ID NO: 40430 - DNA, 712 bp, Homo sapiens
  misc_feature: GYAE6OF02FRYCS.30.27.C05.1.454.CMB.1.raw
  modified_base (198)..(198): a, c, t, g, unknown or other
  misc_feature (198)..(198): n is a, c, g, or t
  modified_base (560)..(560): a, c, t, g, unknown or other
  misc_feature (560)..(560): n is a, c, g, or t
  modified_base (675)..(675): a, c, t, g, unknown or other
  misc_feature (675)..(675): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctccagatgccaccggagaaagtgtgttgacacagtctccagccacctgtctttgctacgagggaanagcctaccgttctctgcacgggccagtcagacgtgtcggaccacgtacatacggcctcggtaaccaacacgaaaccgtcggccgacggtcctaccccgaggtaccccttcccactacgttaccttagttggtaacttcgaccgtaacttaacccgggaaaacgggtcccttacggttcggacccttaacgtaccccaggtacccggttacggttacgtaggtcggtaccggtaggggtcgggttcgtaggggtaaccgagttaccgttcgtaccgttacctcccgtaactacgtaccgagttacctcgtagactcgtaagtagttacgtttgacgtttagtttactcgtagtacgtatacgngtaccgttggaccgtcggtacgggtcgtccggtacgttaccgtcgtttaccggggacgtacgggataacggtagtacgaccgtaacgtaaaccggtacgttcgggtacaccggtntaccggttacgactttcgtaccgttagttccctaccg

SEQ ID NO: 40431 - DNA, 203 bp, Homo sapiens
  misc_feature: GYAE6OF02IWUK4.30.27.C05.1.454.CMB.1.raw
  modified_base (95)..(95): a, c, t, g, unknown or other
  misc_feature (95)..(95): n is a, c, g, or t
  modified_base (169)..(169): a, c, t, g, unknown or other
  misc_feature (169)..(169): n is a, c, g, or t
  modified_base (174)..(203): a, c, t, g, unknown or other
  misc_feature (174)..(203): n is a, c, g, or t
tcagcacgctacgtcacgaccggtgctcgatttagacgcgatcgaagggtttggggggaagaggaagactgacggtcctcccaggagttcaggtnctgggcacagcggccctgggctgcctggtcaaggactacttccacgtagcgtgctgagcgggctggcaaggcgnatagnnnnnnnnnnnnnnnnnnnnnnnnnnnnnn

SEQ ID NO: 40432 - DNA, 772 bp, Homo sapiens
  misc_feature: GYAE6OF02GNY0Q.30.27.C05.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgcctactctggctcccagatgccaccggagaaagtgtgttgacacagtctccgagcccacctgtcttgtctaccgaggggaancgccaccttctccngcgagggccagtcagagtgtcggacaccgtanagtacgccgttaggaccaagaacgaaaccgtcggaccaggcctaccccgaggcctaccctacgacttctactacgtagtcggactacgtaacccgaaaacggtccctacgttcgacctactaccccgaaggtaccgtacgggtttacgaacggttcgacggtaacggttcgggtacggttacggaactaacggttaccgttacgtaaccgttccgtaaccgacctacgtacgtaacgttacggacctaacgggtactaccggtaagtaacgttacgtttacgaacgtttaacgttttaacgttacgtaggttacctaaacgcgttaagggtacgttaacgacggttacgttacgggtccggttacgggtccttaaccggttacgggttaccggggaaccggtaacggtaaaccgggaacgttaaggacggtaaccgtaacggttaaaccggaggttagttacccggacgtttaccgggactaccggttaacttccgttaaccgttaccgttacctacccggg

SEQ ID NO: 40433 - DNA, 701 bp, Homo sapiens
  misc_feature: GYAE6OF02FPIOY.30.27.C05.1.454.CMB.1.raw
  modified_base (177)..(177): a, c, t, g, unknown or other
  misc_feature (177)..(177): n is a, c, g, or t
  modified_base (319)..(319): a, c, t, g, unknown or other
  misc_feature (319)..(319): n is a, c, g, or t
tcagcacgctacgtcacgaccggtgctcgatttagacgcgatcgaagggtttgggggaggaactgctcagttaggacccagagggaaccatggaagccccagctcagcttctcttccctcctgctactctggcctcccagatgccaccggagaagtgtcgttgacacagtctccgancccacccttgtcctttgtcctcccgaagggggaaagtcgcccacccgtttctcccgtgacgacggccagtaccagtagttggttcggcacctacatacgcccgtaggtaacccaacacgtaaaccgtcggaccgacggtccnccgacggtcctaccctcatcctagtagtacgtggctaacgtaaccggtaaaaccgggcccttcggtacgtacgccctacccgaccggtaccgttacggttacgaggtcggacgtagggtcggggtaccgttacggggactaacggttaccttaccgtacttcccgtacacctagtaccgagtacgaccgtacgacgtctaagtatttcgttacgtacgttagttttactcgttgtactacgtcaccgacgtcgcgtacgggtgtacggtacgcgttccgtacgttacgggacggaggtaaccgtagggtacgtacgtacgaacgtaacggtacgtaggtccggactacgtaccgacgttactcgtcgttactaccgtacccg

SEQ ID NO: 40434 - DNA, 850 bp, Homo sapiens
  misc_feature: GYAE6OF02F2P89.30.27.C05.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (246)..(246): a, c, t, g, unknown or other
  misc_feature (246)..(246): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccaccggagaagtgtgttgacacagtcctccagcccacctgtctttgtcctccgaagggaaancgccaaccttcncctgcgaggccagtcagagtgttgcactanatagctggtaaccaacagaaccgtggaccacggtcctcccgacggccttcccgtactactacttacgtgtacgtagactaaacgtaacccgaaaaacggggccctacgtacgggacctaacttcccgaacgtaaccgtacgggttacgtaggtacggtacggtaaggttcggggtcggtacgggtaacgtaacgtacgttaacccgtaccgtaccgtaccaaacccgtaccgttaacgtaaccggtaccggtaaacccgttaagggtacccggttaccgggtaaacggttaaacggttttaacgttttaaccggtcggtttaaacggttttaacggttaaaccggtttcgggttaaaccctagggtaccgttaaacgggacccgggtttaaagtacccgggttaccgggtacgggttaaccggggttccgggttacgtttacccgggttaaccggggttttaccggggaccggggtaaaacgggtaccccgggtaaaagttaacgggtaaccgtaaacggttaaaccggaaacggttaaccggtagtaaccggtccgtacgacccttaaccgtcgtacgtttcttacccgttaacgtttacccg

SEQ ID NO: 40435 - DNA, 793 bp, Homo sapiens
  misc_feature: GYAE6OF02GHM3Q.30.27.C05.1.454.CMB.1.raw
  modified_base (207)..(207): a, c, t, g, unknown or other
  misc_feature (207)..(207): n is a, c, g, or t
  modified_base (253)..(253): a, c, t, g, unknown or other
  misc_feature (253)..(253): n is a, c, g, or t
tcagcacgctacgtcacgaccggtgctcgatttagacgcgatcgaagggtttgggggaggaactgctcagttaggacccagagggaaccatggaagccccagctcagcttctcttcctcctgctactctggctcccagatgccacggagaaagtgtgttgacacagtctccagccctacctgttctttgtcctccgaaggggaaacncgccctacttctcctgctagggccagtcagagttgttacgcactanatacgccgtagtaaccaacaacgaaaccgtcggaccgacggacctcccgaacggccttacctactacttacctaagttagatggtactaacgttaccgaaaaacggccttacgtacggactaacgtacccaacgtaccgtacggttaccaggttaccggtacgtacggttcggggtacgttacgggggaaccgtacgtaaccttacgtaaccgtccgtaacctaaccctaacgttaccggtaacttaccggaacgtaacgggacgttacccggtaggtaaggttaacttttacggacgtttaagttttaccgttaaaccttaggttactaccggtcgaacgttacggtaaccggtacggtaacggtccggtaacggtcgggtaccgttaccgttaccgggtttacgggtacgggtaaacggaaacccggtaaggggttaacgaacggttaaacgtaaccgtaaacggtaaccgttacgggtacgtacgtaccggtacctaacggtaccgttcgttaccggttaccttaccggtttaaccc

SEQ ID NO: 40436 - DNA, 788 bp, Homo sapiens
  misc_feature: GYAE6OF02GZ63J.30.27.C05.1.454.CMB.1.raw
tcagcacgctacgtcacgaccggtgctcgatttagacgcgatcgaagggtttggggaggaactgctcagttagacccagagggaaccatggaagccccagctcgagcttctcttcctacctcgctactctggctcccagatgccaccggagaaagttgtgttagacctacagtctccagcccacccttgtctttgtcctcgagggaacgcgcctaccttctctgcgaggccagtcgagaggtggttcggctaccgtacgtatacggccgtaggtaccaacgaacggaaaccgtcggaccgaggacctccccgacggtccttacctacgaacgttctagtcgtactgcacgtaaccgaaacggctacgtgactacgtacccgagtacgtacgtttaccgacggtcggaacgtcgggtcggtacggtacgggactacggtaacctttactaccgttacctacgtacccgtacgttaccggtaacggtacgtccgtaaacggacggttaccgtaacggttaaacggtttacggttttaccgtacgggtttaagttttaaccgtttacgttaccggtttacgtaccggtacggtaccggtacggtacggtaccgtacggtttcgggtaccgggttacgggttccgttaccggttacggttaccggggaacgggttacgggaacggtaacggggtacgttaacgtacggttaaccggtaaggtaccggttaggtacggtaccgtacggaccgttaaccgtcgttaaccgttcggtttaccgtacccgttaccg

SEQ ID NO: 40437 - DNA, 166 bp, Homo sapiens
  misc_feature: GYAE6OF01AOHNS.29.14.B03.1.454.CMB.1.raw
  modified_base (166)..(166): a, c, t, g, unknown or other
  misc_feature (166)..(166): n is a, c, g, or t
tcagatagagtactcacgaccggtgctcgatttagtgtgagtagtttggatttggggtctccactcccgccttgacgggctgccatcagcccaaggccaaccccactgtcactctgttcccgccctcctcagtactctatctgagcgggctggcaaggcgcatagn

SEQ ID NO: 40438 - DNA, 525 bp, Homo sapiens
  misc_feature: GYAE6OF01DOCLE.29.14.B03.1.454.CMB.1.raw
  modified_base (523)..(525): a, c, t, g, unknown or other
  misc_feature (523)..(525): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccagggggacgctggtcaccgtctcctcagcctccaccaagggcccatcgtcttcccctgcaccctcctccaacgacgcacctctcggggcacagcacgccctgggctgcctggtcaaggactactccagtactctatctgagcggctggcaggcgcatcnnn

SEQ ID NO: 40439 - DNA, 564 bp, Homo sapiens
  misc_feature: GYAE6OF01C9SWG.29.14.B03.1.454.CMB.1.raw
  modified_base (60)..(60): a, c, t, g, unknown or other
  misc_feature (60)..(60): n is a, c, g, or t
  modified_base (146)..(146): a, c, t, g, unknown or other
  misc_feature (146)..(146): n is a, c, g, or t
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
tcagatagagtactcacgaccggtgctcgatttagtgtgagtagtttgggctgagcgtgngtttctaggtggctattttaaaaggtgtccagtgtgacgtgcagttggtggagtctgggggcgcctgggtacggccgggggggtcnctgagactctcctgtgcggcctctggattaagttttaggatcatgccatgaactgggtccgccaggctccaggggaaggggctggagtgggtctcggctattgtggcagtggtggcgctatatattatgcagacgccctgaaggccggttcaccatttccagagacaattcgaagaacacgctgtatctgcaaatgganagcctgagactcgacgacacggcctntatattgngttaaaggcagctggaatacgggaccggggcccgacttgaccactggggccgaggggacgcgtggtcaccggtctcctcacgcctccaccgaacgggcccactcggtccttcccccgtcggccacccctccctccaacgacgcacccgtcgtcgggggccacgacgacagcccgtgggcgtccgg

SEQ ID NO: 40440 - DNA, 550 bp, Homo sapiens
  misc_feature: GYAE6OF01BAUS5.29.14.B03.1.454.CMB.1.raw
tcagatagagtactcacgaccggtgctcgatttagtgtgagtagtttgggctgagcgtggcgttttcttagtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggatacgggacgggccgacttgaccactgggccaggggacgcgtggtcaccgtctcctcagcctccaccaaggcccatcggtccttccccctcggccaccctcctcccaacgacgcacctctcgggggcacgacgcagccctgggcgtcgg

SEQ ID NO: 40441 - DNA, 537 bp, Homo sapiens
  misc_feature: GYAE6OF01D2T6M.29.14.B03.1.454.CMB.1.raw
  modified_base (536)..(537): a, c, t, g, unknown or other
  misc_feature (536)..(537): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccgggcccgacttgaccacgtgggccaggggacgctggtcaccgtctcctcagcctccaccaagggcccatcggtccttccccgtgccacccctcctccaacgacgcacctcgtcggggcacgacgcacgccctgggctcgcctggtcaaggactacttccagtactctatctgagcgggctggcaaggcgcatagnn

SEQ ID NO: 40442 - DNA, 520 bp, Homo sapiens
  misc_feature: GYAE6OF01B9RWM.29.14.B03.1.454.CMB.1.raw
  modified_base (518)..(518): a, c, t, g, unknown or other
  misc_feature (518)..(518): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcagctggaatacgggacgggccgacttgaccactggggccaggggacgctggtcaccgtctcctcagcctccaccaaggcccatcggtcttcccctggcaccctcctccaagcgcacctctggggcacagcagccctggctgcctgcaagactactccagtactctatctgagcggctggcagcgnag

SEQ ID NO: 40443 - DNA, 567 bp, Homo sapiens
  misc_feature: GYAE6OF01ED3LP.29.14.B03.1.454.CMB.1.raw
  modified_base (562)..(562): a, c, t, g, unknown or other
  misc_feature (562)..(562): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgctggtcaccgtctcctcagcctccaccaacgggcccatcggtcttccccgtggccaccctcctcccaacgacgcacctcgtcggggcacgacgccacgcccgtgggcctcgccgtggtccaacggtacctacgttcctacgtacctctacgtctggacgcgggtcgtggacgaacggcgngtacg

SEQ ID NO: 40444 - DNA, 544 bp, Homo sapiens
  misc_feature: GYAE6OF01BU5L5.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccactggggccaggggacgctggtcaccgtctcctcagcctccaccaacggcccatcggtcttccccctcggccaccctccctccaacgacgccaccctctcgggggcacagcacgcccgtcggctcgcctggtcaaggactactccagtactctatctgacgcggctggcacggcgcacg

SEQ ID NO: 40445 - DNA, 192 bp, Homo sapiens
  misc_feature: GYAE6OF01ANXGY.29.14.B03.1.454.CMB.1.raw
  modified_base (191)..(192): a, c, t, g, unknown or other
  misc_feature (191)..(192): n is a, c, g, or t
tcagatagagtactcacgaccggtgctcgatttagtgtgagtagttccgcgggtcagcctccaccaagggcccatcggtcttcccctggcaccctcctccaagagcacctctgggggcacagcggccctgggctgcctggtcaaggactacttccgtactagacgctgagcgggctggcaaggcgcatagnn

SEQ ID NO: 40446 - DNA, 569 bp, Homo sapiens
  misc_feature: GYAE6OF01AKBTG.29.14.B03.1.454.CMB.1.raw
tcagatagagtactcacgaccggtgctcgatttagtgtgagtagtttgggctgagcgtggcttttcttgtggctattttaaaaggtgtccagtgtgacgtgcagttggtggagtctgggggcgcctggggtacggccgggggggtcgctgagactctcctgtgcggcctctggattaagttttaggagtcatgccatgaactgggtccgccaggctccagggaaggggctggagtgggtctcggctattagtggcaggtggtggcgctatatattatgcagacgccctgaagggccgttcaccatttccagagacaattcgaagaacacgctgtatctgcaaatggagagcctgagactcgacgacacggccgtctattattgtagttaaaggcgagctggaagtacgggaccggggcccgacgttcgaccgacgtcgggccgaggggacgcgtcggtcaccgtctcctcacgcctccaccgacgggcccacgtccggtccttcccctcggccaccctccctccaacgcgcaccgtcgtcggggcacgacgcacgcccgtgggcgtcgg

SEQ ID NO: 40447 - DNA, 569 bp, Homo sapiens
  misc_feature: GYAE6OF01CSAOD.29.14.B03.1.454.CMB.1.raw
  modified_base (469)..(469): a, c, t, g, unknown or other
  misc_feature (469)..(469): n is a, c, g, or t
tcagatagagtactcacgaccggtgctcgatttagtgtgagtagtttgggctgagctggcttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccaggggaaggggctggagtggggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtagttaaaggcgaagctggaatacgggaccgggcccgacgttcgaccacgtggggccgaggggacgcgtggtcaccgtctcctcncgccctccaccgaagggcccatccggtccttcccctggccacgtcctcctccgaacgtagccacctccgtggggccacgacgccgacgcccgtgggtccg

SEQ ID NO: 40448 - DNA, 538 bp, Homo sapiens
  misc_feature: GYAE6OF01C2ISH.29.14.B03.1.454.CMB.1.raw
  modified_base (382)..(382): a, c, t, g, unknown or other
  misc_feature (382)..(382): n is a, c, g, or t
  modified_base (529)..(529): a, c, t, g, unknown or other
  misc_feature (529)..(529): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctatattgtgttaaaggcgagctggaatacggggaccgggccgacttgaccactgggggccaggggacncgtggcaccgtctcctcagcctccaccaagggcccatcggtcttcccctcggccaccctcctccaacgacgcacctctggggcacgagcacgccctgggctcgcctggtcaaggactaccttccagtactctatctgagcggctggnaaggcgcag

SEQ ID NO: 40449 - DNA, 578 bp, Homo sapiens
  misc_feature: GYAE6OF01CGOFW.29.14.B03.1.454.CMB.1.raw
tcagatagagtactcacgaccggtgctcgatttagtgtgagtagtttgggctgagcgtgcgttttcttaggtggctaattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctagcaaatggagagcctgagactcgacgacacggccgtctattattgtgttaaagcgagctggaagtacgggaccggggcccgacgttcgaccgacgtcgggccgaggggacgcgtggtcacccgtctcctcacgcctaccgaccaacgggcccacgtccggttccttccccctcggcccaccctccctacccgaacgacgccaccgtcgtcggggccacgacgcagccctggcgtcgg

SEQ ID NO: 40450 - DNA, 584 bp, Homo sapiens
  misc_feature: GYAE6OF01CS09A.29.14.B03.1.454.CMB.1.raw
  modified_base (150)..(150): a, c, t, g, unknown or other
  misc_feature (150)..(150): n is a, c, g, or t
tcagatagagtactcacgaccggtgctcgatttagtgtgagtagtttgggctgagcgtgcttttcttggtggctattttaaaaggtgtccagtgtgacgtgcagttggtggagtcgtgggggcgcctggggtacgggccggggggggtcnctgagactctcctgtgcggcctctggatttaagttttaggagtcatgccatgaactggggtccgccaggctccgaggggaaggggctgggagtggggtctcgggcttattagtggcaggtggtggcgctatatattatgcagacgccctgaagggccggttcaccatttccagagacaattcgaagaacacgctgtatctgacaaatggagagcctgagactcgaacgacacggccgtctattattgtagttaaaggcgagctaggagtacgggaccggggcccgacttgaccacgtcggggccgaggggacgcgtggtccgaccgtctcctcacgccctccaccgaacgggcccagttccggtccttcccctcggccacccctccctaccaacgcgcaccgtcgtcgggggcacgacgcagccctgggctcgg

SEQ ID NO: 40451 - DNA, 575 bp, Homo sapiens
  misc_feature: GYAE6OF01AFDON.29.14.B03.1.454.CMB.1.raw
  modified_base (253)..(253): a, c, t, g, unknown or other
  misc_feature (253)..(253): n is a, c, g, or t
  modified_base (372)..(372): a, c, t, g, unknown or other
  misc_feature (372)..(372): n is a, c, g, or t
tcagatagagtactcacgaccggtgctcgatttagtgtgagtagtttgggctgagcgtggcgttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctgggagtgggtctcggctattagnggcagtggtggcgctatatattatgcagacgcctgaagggccgttcaccatttccagagacaatcgaagacacgctgtatctgacaaatggagagcctgagactcgacgcacggccgtntattattgtagttaaaggcgagctgaagtacgggaccggggcccgacttcgaccgacgtcgggccgaggggcgacgtggtcaccgtctcctccacgcctaccacgaacgggcccacgtccggtccttcccccgcgtcccacccgtccctccgaacgacggccacccgtcgtcggggcaccgacgcacgccctgggccgtccgg

SEQ ID NO: 40452 - DNA, 585 bp, Homo sapiens
  misc_feature: GYAE6OF01A6FE8.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacgggaccgggccgacttgaccacgtgggccaggggacgcgtggtcaccgtctcctcacgcctccaccgaacgggcccacgtccggtcccttcccccgtcggcccaccctccctaccaacgacgccaccctcgtcggggccacgacgccacgccccgtcgggcctcggcccgtggtacgaacggtacctaccttaccgacgttacctctatctcgacggcggcgtggaccgaacggcgcacg

SEQ ID NO: 40453 - DNA, 567 bp, Homo sapiens
  misc_feature: GYAE6OF01EA9TS.29.14.B03.1.454.CMB.1.raw
  modified_base (348)..(348): a, c, t, g, unknown or other
  misc_feature (348)..(348): n is a, c, g, or t
tcagatagagtactcacgaccggtgctcgatttagtgtgagtagtttgggctgagcgtggcttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggccgtctattattgtgttaaaggcgagctaggaatacgggaccggggccgacgttgaccacgtggggccaggggacgcgtggtcaccgtctcctcacgcctccaccaacgggcccagtccggtccttcccccgtcggccacccctcctacccaacgacgccaccctcgtcgggggcacgacgccagccctgggctcgg

SEQ ID NO: 40454 - DNA, 576 bp, Homo sapiens
  misc_feature: GYAE6OF01A3NDF.29.14.B03.1.454.CMB.1.raw
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagacgccctgaagggccgttcaccatttccagagacaattcgaagaacacgctgtatctgacaaatgganagcctgagactcgacgacacggcctntattatgtgttaaaggcgagtcgtaggaagtacgggaccggggcccgacgttcgaccgacgtcggggccgaggggacgcgtcggtcgaccgtctcctcgacgcctcccaccgaacgggcccactccgtcttcccctcggccaccctccctccaacgcgacaccctcgtcggggccacgacgacgacgcccgtggccgtcgg

SEQ ID NO: 40455 - DNA, 553 bp, Homo sapiens
  misc_feature: GYAE6OF01BE5RI.29.14.B03.1.454.CMB.1.raw
  modified_base (541)..(541): a, c, t, g, unknown or other
  misc_feature (541)..(541): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggccgacttgaccactggggccaggggacgcgtggtcaccgtctcctcagcctccaccaacgggcccactcggtccttccccctcggccacccctcctccaacgacgccaccgtcgtcgggggccacgacgcacgcccgtcgggctgccctggtcaaggacctactccagtcctctatctgagcggtcnggacaggcgcag

SEQ ID NO: 40456 - DNA, 565 bp, Homo sapiens
  misc_feature: GYAE6OF01E2K3G.29.14.B03.1.454.CMB.1.raw
  modified_base (563)..(565): a, c, t, g, unknown or other
  misc_feature (563)..(565): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccagggggacgcgtggtcaccgtctcctcacgccctccaccaacgggcccatccggtccttccccctggccacccctcctcccaacgacgccaccctccgtcgggggccacgacgccacgccccgtggggcctcggcccgtgggtccaacgggacctacttccagtactctatcgtgaggcgggctggcaggcgcatagnnn

SEQ ID NO: 40457 - DNA, 560 bp, Homo sapiens
  misc_feature: GYAE6OF01CJGK1.29.14.B03.1.454.CMB.1.raw
  modified_base (555)..(555): a, c, t, g, unknown or other
  misc_feature (555)..(555): n is a, c, g, or t
  modified_base (558)..(560): a, c, t, g, unknown or other
  misc_feature (558)..(560): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtgggccagggggacgctggtcaccggtctccctcacgcctccaccaacgggcccacgtccggtccttccccctcggcccacccctccctccaacgacgccaccctcgtcggggccacacgcacgcccgtgggctcgccgttcggacgaacggactacttccagtaccttctatcgtgagcgggctggcaacggcgcancgnnn

SEQ ID NO: 40458 - DNA, 579 bp, Homo sapiens
  misc_feature: GYAE6OF01B1DDS.29.14.B03.1.454.CMB.1.raw
tcagatagagtactcacgaccggtgctcgatttagtgtgagtagtttgggctgagcgtgcgttttctaggtggctaattttaaaaggtgtccagtgtgacgtgcagttggtggagtctgggggcgcctggggtacgggccgggggggtcgctgagactctcctgtgcggcctctggatttaagttttaggagtcatgccatgaactgggtccgcaggctcagggaaggggctggagtgggtctcggctattagtggcagtggtggcgctatatattatgcagacgccctgaagggccggttcaccatttccagagacaattcgaaagaacacgctgtatctgcaaatggagagcctgagactcgacgacacggccgtctattattgtagttaaaggcgagctaggagtacgggaccggggcccgacgttcgaccgacgtcggggccgaggggacgcgtcggtcaccgtctcctcacgcctccaccgaacggcccacgtccggtccttcccctcggtccacccgtccctaccaacgacgccacctcgtcggggcaccgacgcgacgcccgtggcgtccgg

SEQ ID NO: 40459 - DNA, 551 bp, Homo sapiens
  misc_feature: GYAE6OF01BKLQO.29.14.B03.1.454.CMB.1.raw
  modified_base (136)..(136): a, c, t, g, unknown or other
  misc_feature (136)..(136): n is a, c, g, or t
  modified_base (547)..(547): a, c, t, g, unknown or other
  misc_feature (547)..(547): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcaggggtnccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgctgggtcaccgtctcctcagcctccaccaacgggcccatcggtccttcccctcggccaccctcctccaacgacgcacctcgtcgggggccacacgcacgcccgtgggctgccgtgtcaaggactacttccagtactctatctgagcgggctggcaaggcgngacg

SEQ ID NO: 40460 - DNA, 691 bp, Homo sapiens
  misc_feature: GYAE6OF01CEV4X.29.14.B03.1.454.CMB.1.raw
tcagatagagtactcacgaccggtgctcgatttagtgtgagtagtttggtgggagtcctaggggggcgtcctcgggtacggcccggggggtcggccttcgaggactctacctagtgcgggaccctctggatttaaggtttttacggtacgttcactggccgatgaactcggtcgccagggcctcgacgggaagggctggagtgggtctcggctagttagtgggccaggtggtgggcgactacttagtagttacttgccagaccgccctgaaagggtccggttcaccagtttcccagtacgactaattccgaaggtaaccaacgcgtggtacttcgtcgtccgaaattgggaccgaggaccgtgaggactcggaacgtacgacggtccgtctaattactggtggttaaaggcgagctaggaacgtacccgggaccgggcccgatttggaacctacgtcggggccacggggtactctggtcaccgtctccacgacgtcctccaccgaaggccagtcggtccttcccgtcgcctccctccgtccgaacgcgccaccttcgtcggggcacgcgcgtacgtccgtcggttcgtcgtccgttcggtaccgtacggtacctaccgttaccgacggtaccttacggtaccttcggtacgaccggtccggtcctacggaccgaccggtccgacgtaacgg

SEQ ID NO: 40461 - DNA, 765 bp, Homo sapiens
  misc_feature: GYAE6OF01ALUW4.29.14.B03.1.454.CMB.1.raw
  modified_base (148)..(148): a, c, t, g, unknown or other
  misc_feature (148)..(148): n is a, c, g, or t
  modified_base (210)..(210): a, c, t, g, unknown or other
  misc_feature (210)..(210): n is a, c, g, or t
  modified_base (337)..(337): a, c, t, g, unknown or other
  misc_feature (337)..(337): n is a, c, g, or t
tcagatagagtactcacgaccggtgctcgatttagtgtgagtagtttgggctgagcgtgtcgtttctaggtggctaattttaaaaggtgtccagtgtgacgtgcagttggtggagtctgggggcgcctgggtacggccgggggggtcnctgagactctcctgtgcggcctctggattaagttttaggagtcatgccatgaactgggtccnccaggctccgagggaaggggctggagtgggtctcggctattagtggcagtgggtgcgctatatattatgcagaccgccctggaacggggtccggttcacctatttccagagacaattcgaaagaacncgctgtatctgacaaagtgggagagcctagacgacgtcgaaccgacgaccgggtcctacttatttacgttggttaaggttaaaacgggccgtaaggtccgtagggtaaaccggtacccggggggtaaccccgggggtaccccgtaccgtttacggaacccgtaacgggttcgggggacccggtacggggggaccgtcggttaccgggtccgtacccgttccgttcccgtaccgtaaccggtcccccttaaccgaacccggtaaacccggggtcccccttaaccggttcccgggtttacccccgtttccccccgtccgggtacccctaacccccgttccccgtaaccggaaccgtaccgacccgtaacccggttcgggtcggggacctaccgaacggtcccgaccgggtcccggtgggccgttcccggg

SEQ ID NO: 40462 - DNA, 601 bp, Homo sapiens
  misc_feature: GYAE6OF01BZJDR.29.14.B03.1.454.CMB.1.raw
  modified_base (598)..(599): a, c, t, g, unknown or other
  misc_feature (598)..(599): n is a, c, g, or t
  modified_base (601)..(601): a, c, t, g, unknown or other
  misc_feature (601)..(601): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtgggccaggggacgctggtcaccgtctcctcagcctccaccgaacgggcccagtccggtccttcccccgtcggcccacccctcctacccaacgacgcacccgtcgtcggggccacgacgcacgcccgtgggcctcggccgtcggtccaaacgggtacctaccttcctacggttaccttccttaacgttccgtggtacggccggggtccgtcggggaccgaaacgggccgacgaagttacgnngn

SEQ ID NO: 40463 - DNA, 554 bp, Homo sapiens
  misc_feature: GYAE6OF01CGZJY.29.14.B03.1.454.CMB.1.raw
  modified_base (383)..(383): a, c, t, g, unknown or other
  misc_feature (383)..(383): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacnctggtcaccgtctcctcacgcctccaccaagggcccaatccggtcttcccccgtggccaccctccctccaagacgcacctcgtcggggcacgagcacgcccgtgggcctgcccgtggtcaaggactacttaccacgtactctatctgacgcggctcggacgaggcgctacg

SEQ ID NO: 40464 - DNA, 549 bp, Homo sapiens
  misc_feature: GYAE6OF01BWAQI.29.14.B03.1.454.CMB.1.raw
  modified_base (531)..(531): a, c, t, g, unknown or other
  misc_feature (531)..(531): n is a, c, g, or t
  modified_base (547)..(549): a, c, t, g, unknown or other
  misc_feature (547)..(549): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgacccacgtggggccaggggacgcgtggtcaccgtctccctcacgcctccaccaagggcccatccggtccttccccctcggccacccctcctcccaacgacgccacctcgtcgggggccacgacgcacgcccgtgggcctgcctggtcaaggactacctccatactctatctgagcgggcnggcgaaggcgcatagnnn

SEQ ID NO: 40465 - DNA, 579 bp, Homo sapiens
  misc_feature: GYAE6OF01AJKSL.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttcgaccacgtggggccaggggacgcgtggtccaccgtctcctcacgccctccaccaacgggcccacgtccggtcttccccctggccacccctccctacccaacgacgccacccgtcgtcgggggccacgagccgacggccccgtgggcctcgcccgtggtaccgaaggaccttaccgtcccagttacctctatcctggagcgggctggacaacggcgcag

SEQ ID NO: 40466 - DNA, 612 bp, Homo sapiens
  misc_feature: GYAE6OF01BJMR9.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacggggaccgggccgacttgaccacgtcggggccgaggggacgcgtggtcaccgtctcctcacgccctccaccgaacgggcccacgtccggttcccttccccgtcggccctacccctccctccaacgacgccaccgtcgtcgggggccacgacgccgacgcccgtcgggctcgcccgtcggtacgaacggaccttaccgttaccctaacgttaccttacttacgtccgtaggacggccgggtcgtcgggacgaacggcgacgtaacg

SEQ ID NO: 40467 - DNA, 588 bp, Homo sapiens
  misc_feature: GYAE6OF01DL734.29.14.B03.1.454.CMB.1.raw
  modified_base (147)..(147): a, c, t, g, unknown or other
  misc_feature (147)..(147): n is a, c, g, or t
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
tcagatagagtactcacgaccggtgctcgatttagtgtgagtagtttgggctgagcgtgcgttttctaggtggctattttaaaaggtgtccagtgtgacgtgcagttggtggagtctgggggcgcctgggtacggccgggggggtcnctgagactctcctgtgcggcctctggattaagttttaggagtcatgccatgaactgggtccgccaggctccgaggggaaggggctgggagtgggtctcggctattagtggcagtggtggcgntatatattatgcagacgccctgaagggccggttnaccatttccagagacaattcgaagaacacgctgtatctgcaaaatggagagcctgagactcgacgacacggccgtntattatgtagttaaaagcgaagcgtaggaagtacgggaccggggcccgacgttcgaccacgtcggggccgaggggacgctggtcaccgtctcctcagcctccaccgaacgggcccacgtccggttccttcccccgtcggcccacccctccctcctaacggacgccaccctccgtcgggggaccacgacgacacgcccgtcgggctccgg

SEQ ID NO: 40468 - DNA, 534 bp, Homo sapiens
  misc_feature: GYAE6OF01AVRBV.29.14.B03.1.454.CMB.1.raw
  modified_base (532)..(534): a, c, t, g, unknown or other
  misc_feature (532)..(534): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccagggggacgctggtcaccggtctccctcagcctccaccaagggcccatcggtcttccccctggccacccctcctccaagacgcacctctgggggcacagcagccctgggcctgcctggtcaaggactacttccagtactctatctgagcgggctggcaaggcgcatgnnn

SEQ ID NO: 40469 - DNA, 569 bp, Homo sapiens
  misc_feature: GYAE6OF01C2LC2.29.14.B03.1.454.CMB.1.raw
  modified_base (567)..(569): a, c, t, g, unknown or other
  misc_feature (567)..(569): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccgggcccgacttgaccactggggccaggggacgctggtcaccgtctcctcagcctccaccaagggcccatcggtcttccccctcgccaccctcctccaacgacgccaccctcgtcggggcacgtacgcacgcccgtcgggccgtcggccgtcggtaccgaacggtaccttaccttcctaacgttacctcttactcgtcgaggcgggcgtcggacgacggccgacatagnnn

SEQ ID NO: 40470 - DNA, 599 bp, Homo sapiens
  misc_feature: GYAE6OF01AZE4E.29.14.B03.1.454.CMB.1.raw
  modified_base (266)..(266): a, c, t, g, unknown or other
  misc_feature (266)..(266): n is a, c, g, or t
  modified_base (333)..(333): a, c, t, g, unknown or other
  misc_feature (333)..(333): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcaggtggtggcgntatatattatgcagacgccctggaacggggccggttcacctatttccaggagacaattcgaagaacncgctgtatctgcaaagtggagagcctgacgactcgacgacacggccgtctattagttgtagttaaaggcgaagcgtaggaacgtaccggggaccggggacccggacgttcgaccgacggtcgggccgacggggacggcgtcggtccgaccgtctcctccacgcctaccaccgaacggcccgacgtccggtccttccccgtcggcccaccctccctaccaacgacgaccacccgtcgtcgggccacgacgcacgcccgtggcgtcgg

SEQ ID NO: 40471 - DNA, 582 bp, Homo sapiens
  misc_feature: GYAE6OF01AUBSG.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaggcgagctggaagtacgggaccgggccgacttgaccacgtggggccaggggacgcgtggtcaccgtctcctcacgcctccaccacgggcccagtccgtccttccccgtcggcctaccctccctccaacgacgccacctcgtcggggcacgacgccacggcccgtgggcctcgcccgtggtccgaacggaccttaccgtacccacgttacctctacgtctacgacggccgggcttcggacgaacggcgctacg

SEQ ID NO: 40472 - DNA, 564 bp, Homo sapiens
  misc_feature: GYAE6OF01DVTZX.29.14.B03.1.454.CMB.1.raw
  modified_base (383)..(383): a, c, t, g, unknown or other
  misc_feature (383)..(383): n is a, c, g, or t
  modified_base (542)..(542): a, c, t, g, unknown or other
  misc_feature (542)..(542): n is a, c, g, or t
  modified_base (555)..(555): a, c, t, g, unknown or other
  misc_feature (555)..(555): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacnctggtcaccgtctcctcagcctccaccaacggcccatccggtccttcccccgtcggccacccctccctccaacgacgccacctcgtcgggggccacacgcgacgcccgtcggcctgccctggtcgaacggtactaccttaccagtacctcgtactctgngcgggtctcgganaggcgctag

SEQ ID NO: 40473 - DNA, 759 bp, Homo sapiens
  misc_feature: GYAE6OF01B171C.29.14.B03.1.454.CMB.1.raw
  modified_base (60)..(60): a, c, t, g, unknown or other
  misc_feature (60)..(60): n is a, c, g, or t
  modified_base (84)..(84): a, c, t, g, unknown or other
  misc_feature (84)..(84): n is a, c, g, or t
  modified_base (121)..(121): a, c, t, g, unknown or other
  misc_feature (121)..(121): n is a, c, g, or t
  modified_base (145)..(145): a, c, t, g, unknown or other
  misc_feature (145)..(145): n is a, c, g, or t
tcagatagagtactcacgaccggtgctcgatttagtgtgagtagtttgggctgagcgtgngtttctaggtggctatttaaaggngtccagtgtgacgtgcagttggtggagtctgggggcncctgggtacggccggggggggtcnctgagactctctgtgcgcctcgtaggtattaagtttaggagtcatcgcctagtgaacgtgggtccgccgaggctccggaaggggaggggtctagggaggtcgggtctcggtacttagttaggtcggcgtagggttgggtaggccgtacttaattaattaacgttagtcgaccgaacggaccgtcccgttaagggtaacggggtcccggttaccaaccttacgtttaccgaagtaacgtaaccgtaaacgttaccggaaaacgtaaccgtaccggtcgttagttaacgtcgtacgtaacgtaaagtagggaacgtacgtaccgtaggaacgtaccgtaccggaaccggtaccgaccggtaccgttacttaagtttacgttaggttaaggttaaacggcgtacgtacgtaacggtaacggtaccggggaccgggacccgtacgtacgaccgtacggtacgggacggacgggcgtcgtcgtaccgtaccgtctctccgtacgccctaccgaccgaccggtaccgtacgtccgtcccgtcccgcgtaccctaccctaccctacgacgcgaccgtaccggtcggtacgggaccacgacgaccgacgccgtcggtcgtcg

SEQ ID NO: 40474 - DNA, 607 bp, Homo sapiens
  misc_feature: GYAE6OF01ELKEB.29.14.B03.1.454.CMB.1.raw
  modified_base (484)..(484): a, c, t, g, unknown or other
  misc_feature (484)..(484): n is a, c, g, or t
  modified_base (502)..(502): a, c, t, g, unknown or other
  misc_feature (502)..(502): n is a, c, g, or t
tcagatagagtactcacgaccggtgctcgatttagtgtgagtagtttggtggagtctgggggcgcctgggtacggccggggggtggctgagactctcctgtgcggcctctggagttaagttttaggtagtcatgccatgaactgggtccggcccaggctccagggaagggggcgtggaggtgggtcgtcggctattagtggcagtggtggcgctatatattatgcagacgccctgaagggccggttcaccatttccagagacaattacgaagaacacgctgtatctgcaaatggagagcctgagactcgacgacacggccgtctattatttgtggttaaaggcgagctgggaagtaccggggacccgggggcccgaccgttgaccacgtgggggcccgaggggacggctcgggtcgacccgtcctccctcacgcctcccaccaagggccccatcggtcctcccctcggcaccctccctcaagancaccctcgtgggggcacngccagccccgtgggcgtcgccgtcgggtcgaaaggaccttaccttaccctaggtacctccgttatcctgggacgggccgggtcgggacggcgaacgggccgcacg

SEQ ID NO: 40475 - DNA, 608 bp, Homo sapiens
  misc_feature: GYAE6OF01ECAD5.29.14.B03.1.454.CMB.1.raw
  modified_base (602)..(602): a, c, t, g, unknown or other
  misc_feature (602)..(602): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaatacggggaccgggccgactcggaccacgtcggggccgaggggacgcgtggtccacccgttctcctcgacgccctaccacccgaacgggccccacgtccggtccttcccccgtcggccacccctcctcccaagacgcaccctcgtcggggccacgacgccacgcccgtaggccgtacgacggtcggtacgaaacgggaccttaaccttccgaacgtaccttcctagttccgtgacggcgggtcgtcggactaacgggcngtaacg

SEQ ID NO: 40476 - DNA, 546 bp, Homo sapiens
  misc_feature: GYAE6OF01EGAGN.29.14.B03.1.454.CMB.1.raw
  modified_base (384)..(384): a, c, t, g, unknown or other
  misc_feature (384)..(384): n is a, c, g, or t
  modified_base (542)..(542): a, c, t, g, unknown or other
  misc_feature (542)..(542): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtggggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgtttaaaggcgagctggaatacgggaccggggccgacttgaccactggggccaggggacncgtggtcaccgtctcctcagcctccaccaagggcccatcggtcttcccctggccaccctcctccaacgacgcacctcgtcgggggccacgacgcacgccctgggctgcctggtcaaggactacttccagtactctactctgagcggctggcaaggcgngacg

SEQ ID NO: 40477 - DNA, 628 bp, Homo sapiens
  misc_feature: GYAE6OF01BEQEE.29.14.B03.1.454.CMB.1.raw
tcagatagagtactcacgaccggtgctcgatttagtgtgagtagtttgggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagcgtggaatacgggacccggggccgacgttgacccacgtcgggggaccagggggacgcgtggtcaccgtctcccgtcgacgccctccaccgaacgggcccacgtccgggtcccttcccccgtggcccacccctccctaccaagacgccaccctcgtcggggccacgacgcacggcccgtgggcctcggcccgtacggtccgaacgggtaccttaccgttcccgtaacggttaccttacttacgttccgtaggacgggccggggtacgtcgggacgaagggccgtacgtaacg

SEQ ID NO: 40478 - DNA, 633 bp, Homo sapiens
  misc_feature: GYAE6OF01DNS8N.29.14.B03.1.454.CMB.1.raw
  modified_base (275)..(275): a, c, t, g, unknown or other
  misc_feature (275)..(275): n is a, c, g, or t
  modified_base (571)..(571): a, c, t, g, unknown or other
  misc_feature (571)..(571): n is a, c, g, or t
tcagatagagtactcacgaccggtgctcgatttagtgtgagtagtttgggctgagcgtgcgttttctaggtggctaattttaaaaggtgtccagtgtgacgtgcagttggtggagtcgtgggggcgcctggggtacgggccgggggggtcgctgagactctcctgtgcggcctctggatttaagttttaggagtcatgccatgaacgtgggtccgccaggctccgaggggaagggctggagtgggtctcggctagttagtggcaggtggtggcgntatatattatgcagaccgccctaggaacgggtccggttcacctactttccagagacaattcgaaagaacacgctagtatctgacaaagtggagagcctaggacgacgtacggaacgacgaacggtcctattatttagttgtaggttaaaggcgtagacgtaggaacggtaccggggacccggggacccgtacgttacggaaccgtacggtcggggaccgacggggacgtccgtggtactacccggtctacctcacgccctaccgaccgacggcccacgtccgtccctcccgcgccnccctccaccgtaacgcgccaccgtcggtcggggccacgacgcgaccgcccgtgggcctccgg

SEQ ID NO: 40479 - DNA, 575 bp, Homo sapiens
  misc_feature: GYAE6OF01AUSAT.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccggggccgacttgaccacgtggggccaggggacgcgtggtcaccggtctcctcacgccctccaccaacgggcccacgtcgtcctcccctcggccaccctccctccaacgacgccacctcgtcggggccacgacgaccacgccccgtgggccgtcgccgtcggtacgaacggacctaccgttccacgtacctctactctgacgcgggtctacggacaaggcgcgtacg

SEQ ID NO: 40480 - DNA, 598 bp, Homo sapiens
  misc_feature: GYAE6OF01A9BIG.29.14.B03.1.454.CMB.1.raw
  modified_base (245)..(245): a, c, t, g, unknown or other
  misc_feature (245)..(245): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
  modified_base (577)..(577): a, c, t, g, unknown or other
  misc_feature (577)..(577): n is a, c, g, or t
tcagatagagtactcacgaccggtgctcgatttagtgtgagtagtttgggtcgtgagcgtggcgttttcttgtggctattttaaaggtgtccagtgtgacgtgcagttggtggagtcgtgggggcgccgtgggtacggccggggggtcgcgtgagctctcctgtgcggcctctggattaagttttaggagtcatgccatgaactgggccgcaggctccgagggagggctggagtcgggtctcggnttataggtggccaggtggtggccgatatatattatcgcagacgcccgtaggaaggggccggttacaccatttccgagacgacaattcgaaagaacacgctagtancctagacaaatgggagagcctgagactcgacganaccggtcctatattaatgtagttaaaggcagcgtagagtacgggaccgggccggacgttcgaccgacgtcgggacgagggacgcgtcggtcgaccgtctcctcacgccctccaccgaacggccccgtaatccggtccctcccccgtggcccaccctcccgtaccgaacgcacgaccgttcgcgggccacgacnccgtacgccctggggcctcgg

SEQ ID NO: 40481 - DNA, 604 bp, Homo sapiens
  misc_feature: GYAE6OF01AOVRP.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgacaaatggagagcctgagactcgacgacgacggccgtctattattgtagttaaaggcgagctaggaagtacgggaccgggccgacttcgaccacgtgggccaggggacgcgtcggtccaccgtctcctcacgcctccgaccgaacggcccagtccggtcccttccccgtcggccaccctcctaccaacgcgccaccgtcggtggggccacgacgccgacgcccgtacgggcctcgtcccgtacggtacgaacggtaccttaccttccgtacgttaccttactacttccgtcggacggcgggtccgtacggacgaacggcgacgtag

SEQ ID NO: 40482 - DNA, 517 bp, Homo sapiens
  misc_feature: GYAE6OF01CXOG4.29.14.B03.1.454.CMB.1.raw
  modified_base (124)..(124): a, c, t, g, unknown or other
  misc_feature (124)..(124): n is a, c, g, or t
  modified_base (147)..(147): a, c, t, g, unknown or other
  misc_feature (147)..(147): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (507)..(507): a, c, t, g, unknown or other
  misc_feature (507)..(507): n is a, c, g, or t
tcagatagagtactcacgaccggtgctcgatttagtgtgagtagtttgggctgagcgtgcgttttctaggtggctattttaaaaggtgtccagtgtgacgtgcagttggtggagtctgggggcncctgggtacggccgggggggtcnctgagactctcctgtgcggcctctggattaagttttaggagtcatgccatgaactggggtccgccaggctccaggggaagggctggagtgggtctcggctattagtggcagtggtggcgntatatattangcagacgcctgaaggcgtcacatttccagagacaattcgaagaacacgctgtanctgcaaatgganagcctgaagactgacgactaacgcgtactattatgtgttaaaagcaagctgaatacgggaccgggccgaacgttcgacaactgggcgagggacgctgtcacgtcgtctcagctccacaaggccancgtctcccngcacctcncagngtcactctgggcagcacngcctggctcg

SEQ ID NO: 40483 - DNA, 576 bp, Homo sapiens
  misc_feature: GYAE6OF01BCZZG.29.14.B03.1.454.CMB.1.raw
  modified_base (150)..(150): a, c, t, g, unknown or other
  misc_feature (150)..(150): n is a, c, g, or t
  modified_base (213)..(213): a, c, t, g, unknown or other
  misc_feature (213)..(213): n is a, c, g, or t
  modified_base (259)..(259): a, c, t, g, unknown or other
  misc_feature (259)..(259): n is a, c, g, or t
  modified_base (338)..(338): a, c, t, g, unknown or other
  misc_feature (338)..(338): n is a, c, g, or t
tcagatagagtactcacgaccggtgctcgatttagtgtgagtagtttgggctgagcgtggcgttttcttaggtggctaattttaaaaggtgtccagtgtgacgtgcagttggtggagtctgggggcgcctgggtacggccgggggggtcnctgagactctcctgtgcggcctctggatttaagttttaggagtcatgccatgaactgggtccnccaggctccaggggaaggggctgggagtggggtctcggctattagnggcagtggtggcgctatatattatgcagacgccctgaagggccggttcaccattttcccagagaccaattcgaagaacncgctgtatctgcaaaatggagagcctgagactcgacgacacggcgtctattattgtgttaaaggcgagctggatacgggaccggggcccgacttgaccacgtggggccgaggggacgcgtggtcaccgtctcctcacgcctaccaccaacgggcccacgtccggtccttcccccgtggccaccctccctccaacgcgccaccgtcgtcggggccacgacgcacgcccgtgggcctcgg

SEQ ID NO: 40484 - DNA, 633 bp, Homo sapiens
  misc_feature: GYAE6OF01EUERY.29.14.B03.1.454.CMB.1.raw
  modified_base (214)..(214): a, c, t, g, unknown or other
  misc_feature (214)..(214): n is a, c, g, or t
tcagatagagtactcacgaccggtgctcgatttagtgtgagtagtttgggctgagcgtggcttttcttggtggctatttttaaaaggtgtccagtgtgacgtgcagttggtggagtctggggggcgcctggggtacgggccggggggggtcgctgagactctcctgtgcggcctctggattaagttttaggagtcatgccatgaactgggtccnccaggctccgaggggaggggctggagtgggtctcggctattagtggcaggtggtggcgctatatattatgcagacgccctgaacgggccggttcaccatttccagagacaattcgaagaacacgctgtatctgacaaagtggagagcctagacgactcgacgacacggccgtactatttattgttagttaaggcgagcgtaggaacgtaccggggaccgggcccgtacgttcgaccgacgtcggggaccgaggggacgtcgtcggtccaccgtcctccgtcacgccctaccgacccgaacgggccctaacgttcccggttcccttcccccgtcggtccctaccccttccccgtacccaacggaccgacccacccgtcggtcggggaccacgaccgccgaccgcccggtgggcctccggg

SEQ ID NO: 40485 - DNA, 625 bp, Homo sapiens
  misc_feature: GYAE6OF01A4SZG.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgctgggtcaccgtctcctcagccctccaccaacggcccactccggtccttcccccgtcggccacccctccctcccaacgacgccacctccgtcgggggccacgacgccacggccccgtcgggcctcggcccgtcgggtaccgaaacgggtaccttaaccttacccgtaacgttaccgttaccttacgttccgttcggaacggccggggtaccgttacggggaccaaacggggccggtcgtaacg

SEQ ID NO: 40486 - DNA, 586 bp, Homo sapiens
  misc_feature: GYAE6OF01ED00A.29.14.B03.1.454.CMB.1.raw
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgacccacgtgggccagggggacgcgtggtcaccgtctcctcacgccctaccaccgaacgggcccacgtccggtccttccccccgtcgggtcccacccccttccctacccaacgacgccacccgtcgtcgggggcacgagccacgcccgtcgggctcgccgtggtccgaacggaccttaccttcctacgtacctctactctggagcgggtcgcggcaacgggcgacatagnngn

SEQ ID NO: 40487 - DNA, 715 bp, Homo sapiens
  misc_feature: GYAE6OF01D9QX6.29.14.B03.1.454.CMB.1.raw
  modified_base (150)..(150): a, c, t, g, unknown or other
  misc_feature (150)..(150): n is a, c, g, or t
  modified_base (257)..(257): a, c, t, g, unknown or other
  misc_feature (257)..(257): n is a, c, g, or t
tcagatagagtactcacgaccggtgctcgatttagtgtgagtagtttgggctgagcgtgtcgttttctagtggctaattttaaaaggtgtccagtgtgacgtgcagttggtggagtcgtgggggcgccgtgggtacggccgggggggtcnctgagactctcctgtgcggcctctggattaagttttaggagtcatgccatgaactgggtccgccaggctccgaggggagggctggagtgggtctcggcttagttagnggcaggtgggtggcgctaatatattatgcagaccgcccgtggaacggggtccggttacacctatttccaaggacgaactaattacggaaagaaccacgctgtaacttctagacaaagtggagacgccgtagacgacctcggaaccgacgtaccggtcccgttattaagtttacgtttaggtacggttaaagggcgtagtacgtagggtaacgtaccggggaccgggtcccgtacgttacgaccgtacggtcggggaccgacggggtaccgcgtcggtcctacccgtctccgtcgacgtccctaccgaaccgaccggtcccacgttcccggtaccccttccccggtcgtacccctacccgttacccgtaccgaacggaccgtcccgaacccggttcccgggacggggaccctaaccggaccggacccgaccgggtccccgtcgggtcccgttacccggg

SEQ ID NO: 40488 - DNA, 565 bp, Homo sapiens
  misc_feature: GYAE6OF01CKN1C.29.14.B03.1.454.CMB.1.raw
  modified_base (562)..(563): a, c, t, g, unknown or other
  misc_feature (562)..(563): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccattttccagagacaattcgaagaacacgctgtatctgcaaaatggagagcctgagactcgacgacacggccgtctattattgtgttaaaggcgagctggaatacgggaccgggccgacttgacacgtgggccaggggacgctggtcaccgtctcctcagcctccaccaagggcccagtccgtcttccccctcggccacccctcctccaacgacgccacctcgtggggccacacgcacgcccgtcggctcgccgtcggtcgaacggtacctacgttaccacgtactcttactcgtcgaggcgggtcgtcggacgaacggcgacagtacgnncg

SEQ ID NO: 40489 - DNA, 629 bp, Homo sapiens
  misc_feature: GYAE6OF01AWC9W.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgacccacgtggggccaggggacgcgtgggtcaccgtctcctcacgccctccaccaacgggcccacgtccggtccttcccccgtcggccacccctccctacccaacgacgaccacccgtcgtcgggggcctacgacgccgacggccccgtcgggccgtcgtcccgtcggtaccaaacgggaccttaccgttacccgaacggttacctcttaacgttccgtacggtacggccggggtacgttcgggaccgaacgggccgtacgtaacg

SEQ ID NO: 40490 - DNA, 562 bp, Homo sapiens
  misc_feature: GYAE6OF01BA7QT.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaagcgagctggaatacgggaccgggccgacttgaccacgtcggggccaggggacgcgtggtcaccgtctcctcacgcctccaccaacgggcccacgtcggtcccttccccctcggccacccctccctcccaacgacgccaccctcgtcggggccacgacgcacgcccgtgggctcgccgtggtcaacggactacttaccacgtactctatctcgagcgggctggcacggcgcag

SEQ ID NO: 40491 - DNA, 609 bp, Homo sapiens
  misc_feature: GYAE6OF01CWT8F.29.14.B03.1.454.CMB.1.raw
  modified_base (150)..(150): a, c, t, g, unknown or other
  misc_feature (150)..(150): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
tcagatagagtactcacgaccggtgctcgatttagtgtgagtagtttgggctgagctggctttttcttgtggctattttaaaaggtgtccagtgtgacgtgcagttggtggagtcgtgggggcgccgtggggtacgggccgggggggtcnctgagactctcctgtgcggcctctggatttaagttttaggagtcatgccatgaactgggtccgccaggctccgaggggaaggggctgggagtgggtctcggctattaggtggcaggtgggtggcgntatatattangcagacgcctgaacgggccgttacacctattccagagacaattcgaaagaacacgntgtatctagacaaaagtgggagagcctagaacgacgtcgacgacacggcctatattatgtagttaaaggcgaagcgtaggaagtacgggaccgggccgacttgaccgacgcggggccgaggggacgcgtcggtccaccgtctcctcacgccctaccgaccgaacgggcccacgtccggttcccttcccccgtcggcccaccccgtccctaccgaacgacgaccacccgtcggcggggaccaccgacgaccacggcccgtgggctcgg

SEQ ID NO: 40492 - DNA, 593 bp, Homo sapiens
  misc_feature: GYAE6OF01B10UM.29.14.B03.1.454.CMB.1.raw
  modified_base (147)..(147): a, c, t, g, unknown or other
  misc_feature (147)..(147): n is a, c, g, or t
  modified_base (272)..(272): a, c, t, g, unknown or other
  misc_feature (272)..(272): n is a, c, g, or t
tcagatagagtactcacgaccggtgctcgatttagtgtgagtagtttgggctgagctggctttttcttgtggctattttaaaaggtgtccagtgtgacgtgcagttggtggagtcgtggggcgccgtgggtacggccgggggggtcnctgagactctcctgtgcggcctcgtggattaagttttagagtcatgccatgaactgggtccgccaggctccgaggggaaggggctgggagtgggtctcggctagttaggtggcagtggtggccgntatatattatgcagacgccctggaacgggccgttcacctattccagagacaattcgaaagaacacgctgtactctagacaaagtggagagcctagacgactcgacgacgcggctatattatgtagttaaagcgtagcgtaggaagtacgggaccgggccgacgttcgaccgacgtcgggacgacgggacgcgtcggtccaccgtctcctacgacgtccctaccaccgacggaccgacgtccggtcctccccgtcgccctacccgtcctaccgaacgcgccaccgtcgtcgggaccacgacgcacgcccgtcgggtcgtccg

SEQ ID NO: 40493 - DNA, 579 bp, Homo sapiens
  misc_feature: GYAE6OF01CX8NX.29.14.B03.1.454.CMB.1.raw
  modified_base (348)..(348): a, c, t, g, unknown or other
  misc_feature (348)..(348): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccgaggggaaggggctgggagtgggtctcggctattagtggcagtggtggcgctatatattatgcagacgccctgaagggccgttcaccatttccagagacaattcgaagacacgctgtatctgcaaatgganagcctgagactcgacgacacggccgtctattattgtgttaaaggcgagctggaagtacgggaccggggcccgacgttgaccacgtgggccgaggggacgcgtcggtcaccgtctcctcacgcctccaccaacgggcccacgtccggtccttcccccgtcggccctacccctccctcccaacgacgccacccgtccgtcgggggccacgacgccgacgcccgtgggctccgg

SEQ ID NO: 40494 - DNA, 544 bp, Homo sapiens
  misc_feature: GYAE6OF01BBG74.29.14.B03.1.454.CMB.1.raw
  modified_base (541)..(541): a, c, t, g, unknown or other
  misc_feature (541)..(541): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacgcgtggtcaccgtctcctcagcctccaccaagggcccatcgtcttcccctcggcacccctcctccaacgacgcacctcgtcgggggcacgagcacgccctgggctcgcctggtcaacggactacttccagtactctatctgagcgggtctggcacggcgnacg

SEQ ID NO: 40495 - DNA, 773 bp, Homo sapiens
  misc_feature: GYAE6OF01BZK2E.29.14.B03.1.454.CMB.1.raw
tcagatagagtactcacgaccggtgctcgatttagtgtgagtagtttcggtgggagtctgggggacgccgtgggtacggccggggggtcggctgagactctccgtgtgcggcctcctgggatttaagttttaggtagtctattgccatggaactgggttccgccaggcctccgagggaagggtctggagtgggtctcggctattagtgcagtggtggcgctatagtattagtggcagacgccctagaagggccggttacaccatttcccaagagtacttaattcgaacgaacacgactagtatctgactaagtggagagacctagagactcgacgacgacggcctctattattcgtagtttaaacggcggtacgtcgtacgggaacgtccggggaccgggacccgtacgttcgaccgacggtcggggacctagggggaccgtcgtggggtacctaccggttcttacccgtcgacgtccctaccgaccgtaaccggccccgtacgtccggtccctttccccgcggaccctacccttacccgtaccgaaggtaccgaccgtacccgttacggttacgggggtaccctacgaaccgtaccgtaaccggtacccgttacgggtacctttccggtcccgttacggtacccgtaaacgggttaccgtttacccgttacccggtaacggttacccttacgttaacgtacccggttacggaaccgggtacccggggttaccggttacgggaccggtaaccgggtccggtaccgttaaacgg

SEQ ID NO: 40496 - DNA, 614 bp, Homo sapiens
  misc_feature: GYAE6OF01C2N2G.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctggggtacggccggggggggtcgctgagactctcctgtgcggcctctggattaagttttaggagtcatgccatgaactgggtccgccaggctccgaggggaaggggctgggagtgggtctcggctattagtggcagtggtggcgctatatattatgcagaccgccctggaacgggccggttcaccatttccagagacaattcgaagaacacgctgtatctgacaaatggagacgcctgagactcgacgacacggccgtactattattgtagttaaaggcgagtcgtaggaacgtaccggggaccggggcccgtacgtcgaccgacgtcggggaccgaggggcgcgtcggtcaccgtctcctcacgccctaccgacccgaacgggcccacgtccggttcccttccccgtcggccctacccctccctacccgaacgaccgaccacccgtccggtcggggacccacgacgaccgacgcccgtgggcctccgg

SEQ ID NO: 40497 - DNA, 634 bp, Homo sapiens
  misc_feature: GYAE6OF01AUKZS.29.14.B03.1.454.CMB.1.raw
  modified_base (386)..(386): a, c, t, g, unknown or other
  misc_feature (386)..(386): n is a, c, g, or t
  modified_base (629)..(629): a, c, t, g, unknown or other
  misc_feature (629)..(629): n is a, c, g, or t
  modified_base (632)..(632): a, c, t, g, unknown or other
  misc_feature (632)..(632): n is a, c, g, or t
tcagatagagtactcacgaccggtgctcgatttagtgtgagtagtttgggggcggcctgggtacgggccggggggtcggcgtgagactctcctgtgcggcctctggattaagttttaggagtcatgccatgaactgggtccgccaggctccgagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacgggaccgggcccgacttgacccacgtggggcccaagggggaccncgtgggtccaccgttctccgtcacgcccttcccgaaccgacgggaccccacgtccggtcccttcccccgtcggtccctacccctcctacccgaacgacgccacctccgtcggggccacgacgcacgcccgtgggcctcgccgtggtaccaacggacctaccgtcctaacgttcctaccgttaactccgttcggacggtccggggtcctcggggacccgtaaagggcccggtacgaagttacgngtncg

SEQ ID NO: 40498 - DNA, 901 bp, Homo sapiens
  misc_feature: GYAE6OF01BRDIG.29.14.B03.1.454.CMB.1.raw
tcagatagagtactcacgaccggtgctcgatttagtgtgagtagtttagggtttaggggggcgcctgggtaccggccggggggtcgcgtgagactctcctggtgcggcctcgtcggattaagttttaggagtccagtgcccatgaactgggtccgccgaggcctccgagggaaggggactggagtgggtcctcggctattacgtggcagtcggtcggcgctatatattatgcagacgcctgaacgggccgttcaccatttccgagagacaattcgaagaacacgctgtatcgtgcaaatggaagagaccctaggaacgacctacggacgtaacaccgggtcccgttacgtaacgtttacgtttcggttaaggtttaaaaggggacggtacgggtaccttagggtaaacgttaaccgggggaccccggggaccccggtaaccggtttcggaaccgtacggtcgggggtacccgaaggggggaaccgcgttacgggtcctaacccggttcccttaccccgtaccgtaacgtccccgttaccccgaacccgtaaccgggggtacccccgtaacgttccccgggtttaccccgtttacccccccgttacgggtaccccgtaccccccgtttacccgtaccccgaaaaccggtaccgtacccgttaacccgttcccggtaccggggggtacccaacccgtaacggtacccgtaacggtccccggttacggggttcccgttaccgggtccccgggttacgggttaacccggtaaaccgggtaacccggttaaccgtttacccgtaacgttaacccgttaaccgttaacgttccggttacggacggtcccggggtaccgtaccgggtaccgtaaacgggtccggtaaccgtacgttaccgtcgtaccg

SEQ ID NO: 40499 - DNA, 588 bp, Homo sapiens
  misc_feature: GYAE6OF01BAN4K.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccggggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaaggggccggttcaccatttccagagacaattcgaagaacacgctgtatctgacaaatggagagcctgagactcgacgacacggcctctattattgtagttaaagcgagctaggaagtacgggaccggggccgacgtcgaccgacgtcgggccgaggggacgcgtggtcgaccgtctcctcacgccctccaccgaacgggcccacgtccggtcccttcccccgtcggcccaccctccctacccgaacgcgaccacctccggtacggggccacgacgacgaccgcccgtcgggcgtccgg

SEQ ID NO: 40500 - DNA, 639 bp, Homo sapiens
  misc_feature: GYAE6OF01D6U3K.29.14.B03.1.454.CMB.1.raw
  modified_base (634)..(634): a, c, t, g, unknown or other
  misc_feature (634)..(634): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgacaaatggagagcctgagactcgacgacacggccgtctattattgtagtaaaggcgagcgtaggaagtaccggggaccggggcccgacgttcgaccacgtggggccaggggacgcgtggtccaccgtcctcctcgacgtccctaccaacccgaacgggccccacgttcccggttcccttcccccgtcggccctacccccttccctacccgaaacgacgtacccaccgtccggtcgggggccacgacgccacggcccgtggggcctcggccgtacgggtacgaaacggtaccttaccgttaccgacgttacctactacgttcgtggacggccgggtcgtcgggacgacgggccgntaacg

SEQ ID NO: 40501 - DNA, 761 bp, Homo sapiens
  misc_feature: GYAE6OF01ALYB4.29.14.B03.1.454.CMB.1.raw
  modified_base (469)..(469): a, c, t, g, unknown or other
  misc_feature (469)..(469): n is a, c, g, or t
tcagatagagtactcacgaccggtgctcgatttagtgtgagtagtttggtttcgggggcggcctgggtacggccggggggtcgcctgagactcgtccttcgtggcggtccctcttgggattaagttttaggagtcactgaccatgaacgtgggtccgccaaggtcgtccgttaggggaacggggtctgggacggttgggggtttccttcggtccttaattttaaaggtggtccaaggttggtggcggtctatatattagtgctagtacggccgtagtaagggccgttccgaccgtacggtttcccagacgactacttccgaagacacgtctgtagtctcgacctaaagtggaacgacgtcctggagctcggaccgacacgggcctcgtagttagtcgtaggtaaggcgacgtctaggtaactacgggtaccgggccgtacgttgaccgacgtcggggaccaggggaccncgtcggccaccgtctccgtcgacggcccgtccgaccgtacggcccctagtcccggtacctccccgtcggacccctacccgtacctaccgaacgccgtacccgtacccgtacgtacgggaccaaccgacgcccgtaccgtcccggtacgggcccgtaccggtaccgtacgggtaacctaacggttaccctttacgtttcccgtaacggttccctaccgtaccgtcgtacggtacggtcccgggtaacgtacggtaccgtaaccgggcccggtaacgtacggtacgtcggaccg

SEQ ID NO: 40502 - DNA, 579 bp, Homo sapiens
  misc_feature: GYAE6OF01AZJRN.29.14.B03.1.454.CMB.1.raw
tcagatagagtactcacgaccggtgctcgatttagtgtgagtagtttggtggagtcgtgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgacaaatggagagcctgagactcgacgacacggccgtcattatgtgttaaaggcgagctggaatacgggaccgggccgacttgaccacgtggggccgaggggacgctgggtccaccgtcgtcctcgagccctccaccgaacgggcccagtccgtccttcccccgtcggcctacccctcctcctaacgacgcacctcgtggggcacgacgcacgcccgtacgggctcgcccgtggtccgaaggtacctacgttacgtactcgtatacgtgacggcgggtcgtcggacgaaggcgcgagtacg

SEQ ID NO: 40503 - DNA, 607 bp, Homo sapiens
  misc_feature: GYAE6OF01EAJ3L.29.14.B03.1.454.CMB.1.raw
  modified_base (603)..(603): a, c, t, g, unknown or other
  misc_feature (603)..(603): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtaggaagtacgggaccgggcccgacttggaccacgtcggggccgagggggaccgcgtggtccaccgttctccctcacgcctccaccgacgggcccacgtccgtccttcccccgtggccaccccgtcctaccaacgacgccacccgtcgtcggggcacgacgccacgcccgtgggccgtcgccgtggtacgaacggtacctaccttaccgaagttacctcgtacgttccgtacggacggtccgggtcgtcgggacgaacgggcggacgatacggtngacg

SEQ ID NO: 40504 - DNA, 587 bp, Homo sapiens
  misc_feature: GYAE6OF01BBXEJ.29.14.B03.1.454.CMB.1.raw
  modified_base (147)..(147): a, c, t, g, unknown or other
  misc_feature (147)..(147): n is a, c, g, or t
  modified_base (487)..(487): a, c, t, g, unknown or other
  misc_feature (487)..(487): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacgggccgggggggtcnctgagactctcctgtgcggcctctggatttaagttttaggagtcatgccatgaactgggtccgccaggctccgaggggaaggggctgggagtgggtctcggctattagtggcagtggtggcgctatatattatgcagacgccctggaacgggccggttcacctatttccagagacaattcgaaagaacacgctgtatctgacaaatggagagcctgacgactcgacgacacggccgtctattatgtagtaaaggcgagctaggaagtaccgggaccggggcccgacgttcgaccgacgtcgggccgaggggacgcgtcggtcaccgtcctcctcacgccncccaccgaacgggccctacgtccggtcccttccccgtcgccctaccctccctccaacgcgccaccgtcgtcggggcacgacgcgacgcccgtggcgtcgg

SEQ ID NO: 40505 - DNA, 570 bp, Homo sapiens
  misc_feature: GYAE6OF01B65LL.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccgggcccgacttgaccacgtcggggccaggggacgcgtggtcaccgtctcctcagcctccaccgaacggcccatcggtccttcccctggccaccctcctacccaacgacgccacctcgtcgggggaccacgacgccacggccctgggcctcgccgtcggtcgaacggactaccgttccagtacctctatctgagcgggtctcggacgaacggcgctacg

SEQ ID NO: 40506 - DNA, 594 bp, Homo sapiens
  misc_feature: GYAE6OF01CTG22.29.14.B03.1.454.CMB.1.raw
  modified_base (460)..(460): a, c, t, g, unknown or other
  misc_feature (460)..(460): n is a, c, g, or t
  modified_base (588)..(588): a, c, t, g, unknown or other
  misc_feature (588)..(588): n is a, c, g, or t
tcagatagagtactcacgaccggtgctcgatttagtgtgagtagtttggtggagtctgggggcgcctgggtacggccgggggggtcgctgagactctcctgtgcggcctctggattaagtttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaataccgggaccgggcccgacgttgaccacgtcggggccgaggggacgcgtggtcgaccgtctccgtcacgcctaccaccgaacggccccagtccggtcccttcccccgtcggcccncccctccctccaagacgccacctcgtcggggcacgacgccacgcccgtggctcgccgtggtacgaaggtacctaccttccgacgtacctacttactcgtgacggccggtcgtcggacgaacgggccgngtaacg

SEQ ID NO: 40507 - DNA, 598 bp, Homo sapiens
  misc_feature: GYAE6OF01EYKGA.29.14.B03.1.454.CMB.1.raw
  modified_base (147)..(147): a, c, t, g, unknown or other
  misc_feature (147)..(147): n is a, c, g, or t
  modified_base (209)..(209): a, c, t, g, unknown or other
  misc_feature (209)..(209): n is a, c, g, or t
  modified_base (380)..(380): a, c, t, g, unknown or other
  misc_feature (380)..(380): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctggggtacggccgggggggtcnctgagactctcctgtgcggcctctggattaagttttaggagtcatgccatgaactgggtccnccaggctccgaggggaaggggctggagtgggtctcggctattagtggcaggtggtggcgctatatattatgcagacgccctgaaggggccggttcaccattttccagagacaattcgaagaacacgctgtatctgcaaatggagagcctgagactcgacgacacggccgtntattatgtagttaaaggcgagctaggaacgtacgggaccggggcccgacgttcgaccacgtcggggccgaggggacgcgtggtcaccgtctcctcacgcctaccaccgaacgggacccacgtccggttccttcccccgtcggtccaccccgtccctacccaacgcgaccacccgtcggtcgggggaccaccgacgccacggcccgtcgggccgtccgg

SEQ ID NO: 40508 - DNA, 575 bp, Homo sapiens
  misc_feature: GYAE6OF01DNQZ0.29.14.B03.1.454.CMB.1.raw
  modified_base (572)..(575): a, c, t, g, unknown or other
  misc_feature (572)..(575): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaaatggagagcctgagactcgagacacggccgtctattattgtgttaaaggcgagctggaatacgggaccgggcccgacttgaccacgtgggccagggggacgcgtggtcaccgtctcctcacgcctccaccgaagggcccatcgtccttcccccgtcggcctacccctccctaccaacgacgccacctcgtcgggggcaccgagcacgcccgtcgggctcgccgtggtacaacggtacctaccttcctaacgttactactcgtggacggcggggcgttcggacgaagggcgaccgagtagnnnn

SEQ ID NO: 40509 - DNA, 569 bp, Homo sapiens
  misc_feature: GYAE6OF01DKFBZ.29.14.B03.1.454.CMB.1.raw
  modified_base (436)..(436): a, c, t, g, unknown or other
  misc_feature (436)..(436): n is a, c, g, or t
  modified_base (557)..(557): a, c, t, g, unknown or other
  misc_feature (557)..(557): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggaagagcctgagctcgacgacacggccgtctattatgtagttaaaggcgagctggaatacgggaccgggccacttcgaccacgtggggccaggggacgctggtcaccgtctcctcagcctccaccaacggcccatccggtcctttccccgnggcctacccctccctcccgaacgacgcctaaccgtcgtcgggggccacacgcacggcccgtgggcctcgcctggtacaacggacctaccgttccagtacctctactctgaggcggctcggnaacggcgcgaag

SEQ ID NO: 40510 - DNA, 637 bp, Homo sapiens
  misc_feature: GYAE6OF01B0OW6.29.14.B03.1.454.CMB.1.raw
tcagatagagtactcacgaccggtgctcgatttagtgtgagtagttccgcgggggcaggagtcagacccactcaggacacagcatggacatgaggtcccgctcagctcctggggctcctgctgctctggctcccaggtgccagatgtgccatccagatgacccagtctccatattccctgtctgcatctgtagagacagagtcagcatcacgttggccgggacaagtcgaggacataccgaaatgagaataagctaggtatacaacaacgaaaccacgggaaaccctacctaacctcctagactctatcgctgcgtactagttaacgaaggtcgggtccagtcgtacggttcacggcggcgtaggtggtatcgtaggaccagacgttactttaccacttcctaccacctactccgaagccgacgtccctcggaccctacggaccgttaggtaacgttacttttacggaccttaactttactttaacttcgtaccttaacgtaaagttaaccttaactaaccttaaccgtaggttacgggtaaccggttaccgggaaccggtaaacggggtaaccggtaaagggttaacggaaacttaaccgaaaacggtacgttagggtaccggctcggacctaccg

SEQ ID NO: 40511 - DNA, 601 bp, Homo sapiens
  misc_feature: GYAE6OF01BY628.29.14.B03.1.454.CMB.1.raw
tcagatagagtactcacgaccggtgctcgatttagtgtgagtagtttgggctgagcgtgcgttttctagtggctattttaaaaggtgtccagtgtgacgtgcagttggtggagtctgggggcgcctggggtacggccgggggggtcgctgagactctcctgtgcggcctctggattaagttttaggagtcatgccatgaactgggtccgccaggctccgaggggaagggctggagtgggtctcggctattagtggcagtggtggcgctatatattatgcagacgccctggaagggccgttcaccatttccagagacaattcgaagacacgctgtatctgacaaatggagacgcctagacgactcgacgacacggccgttactattattgtagttaaaggcagctaggaagtacgggaccggggccgacgttcgaccgacgtcgggccgagggacgcgtcggtccaccgtctcctcgacgccctaccaccgaacgggtccctacgtcccggtacccttcccccgcggtcccacccctccctaccgaacgcgtacccacccgtcggtcggggccaccgacgccacggcccgtgggcctccggg

SEQ ID NO: 40512 - DNA, 610 bp, Homo sapiens
  misc_feature: GYAE6OF01C0QFL.29.14.B03.1.454.CMB.1.raw
  modified_base (378)..(378): a, c, t, g, unknown or other
  misc_feature (378)..(378): n is a, c, g, or t
  modified_base (607)..(607): a, c, t, g, unknown or other
  misc_feature (607)..(607): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtagttaaaggcgagctaggaataccggggaccgggcccgacgttcgaccacgtgggccaggggacncgtggtcaccgtctcctcgacgccctacaccgaacgggccctacgtccggtcccttcccccgtcggccctacccctccctaccgtaacgacgtccaccgtcggtcggggacaccgacgccgacggccctgggcctcggtcccgtcggtacaacgggtaccttaccgttaccgacgtttacctacgttactccgtaggacggcggtcgtcggacgacggcgacagtacgntgc

SEQ ID NO: 40513 - DNA, 585 bp, Homo sapiens
  misc_feature: GYAE6OF01A33EZ.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcacgccctcaccaagggcccactcggtccttcccccgtcggccacccctcctaccaagacgccacctcgtggggccacgagcacgcccgtgggcctcgcccgtcggtaccgaaggaccttaccttaccacggtacctctacgtcctaggacggccgggtcgtcgggaccgaacgggccgcgtaacg

SEQ ID NO: 40514 - DNA, 669 bp, Homo sapiens
  misc_feature: GYAE6OF01BMLY8.29.14.B03.1.454.CMB.1.raw
  modified_base (663)..(663): a, c, t, g, unknown or other
  misc_feature (663)..(663): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacgggaccggggccccgacttcgaccacgtggggccaggggacgcgtggtcaccgtctccctcacgcctcccgaccgaacgggccccaagtccggtcccgttcccccgtcggccctacccctccctacccaacgtacgaccacccgtccggtcgggggcccaccgacgtacccgacgtcccccgtacggggcctccggcccgttacgggttcccgaaacgggtacccgttacccgttacccgaacgttacccttcttaacgttccgttcggaacggggtccggggtccggttacgggacccgtaaacggggccgaccgtaagtaacggngtgacg

SEQ ID NO: 40515 - DNA, 619 bp, Homo sapiens
  misc_feature: GYAE6OF01D6WNS.29.14.B03.1.454.CMB.1.raw
  modified_base (390)..(390): a, c, t, g, unknown or other
  misc_feature (390)..(390): n is a, c, g, or t
  modified_base (616)..(617): a, c, t, g, unknown or other
  misc_feature (616)..(617): n is a, c, g, or t
  modified_base (619)..(619): a, c, t, g, unknown or other
  misc_feature (619)..(619): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtaggaagtaccggggacccggggccccgacgttcgacccaacgtcggggccgacgggggacncgtcggtcgacccgtctccctcagccctccaaccgaacgggcccacgtccggtacccttcccccgtggcccacccctcctaccgaagacgccacccgtcggtcggggacacgacgcgacgcccgtgggcctcggaccgtggtaccgaacggtaccttacttccgaacgttacctaccttagtccgtcggaggccgggcgtacgggacgaacgggcgacaagtacgnngn

SEQ ID NO: 40516 - DNA, 620 bp, Homo sapiens
  misc_feature: GYAE6OF01DEDVW.29.14.B03.1.454.CMB.1.raw
  modified_base (148)..(148): a, c, t, g, unknown or other
  misc_feature (148)..(148): n is a, c, g, or t
  modified_base (391)..(391): a, c, t, g, unknown or other
  misc_feature (391)..(391): n is a, c, g, or t
tcagatagagtactcacgaccggtgctcgatttagtgtgagtagtttgggctgagctggctttttcttgtggctattttaaaaaggtgtccagtgtgacgtgcagttggtggagtcgtgggggcgcctgggtacggccgggggggtcnctgagactctcctgtgcggcctctggattaagttttaggagtcatgccatgaactgggtccgccaggctccgaggggaaggggctggagtgggtctcggctattaggtggctaggtgggtggcgcttatattattatgcagaccgccctaggaacgggccgttcacctatttccagagacaattcgaaagaacacgctgtatctgacaagtggagagcctgagactcgaacgacacggtcctnttattagtttgaggttaaaggcgaagtctagggaacgtaccggggacccgggccgtactacgactacggtcggggaccgaggggaccgcgtcggtccaccgttctcctcgacgccctaccaccgacgggccctacgtccggttcccttccccgcggccctacccctcccaccgaacgcaccgacccgttcggaccgggccaacgcgaccgaccgcccggtggcctccgg

SEQ ID NO: 40517 - DNA, 786 bp, Homo sapiens
  misc_feature: GYAE6OF01DZXTV.29.14.B03.1.454.CMB.1.raw
  modified_base (60)..(60): a, c, t, g, unknown or other
  misc_feature (60)..(60): n is a, c, g, or t
  modified_base (149)..(149): a, c, t, g, unknown or other
  misc_feature (149)..(149): n is a, c, g, or t
  modified_base (172)..(172): a, c, t, g, unknown or other
  misc_feature (172)..(172): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
  modified_base (330)..(330): a, c, t, g, unknown or other
  misc_feature (330)..(330): n is a, c, g, or t
tcagatagagtactcacgaccggtgctcgatttagtgtgagtagtttgggctgagcgtgngtttctaggtggctaattttaaaaggtgtccagtgtgacgtgcagttggtgtagtctgggggcgcctggggtacgggccgggggggtcnctgagactctcctgtgcggcctntggattaagttttagatcatgccatgaactggccgcaggctcgagggaggggctggagtgggtctcggntagttagnggcagtggtgcgctatatattangacagacgccctggaaggccgttcacctatttccagacacaattcgaaagaacaccgntgtatctagacaaaagtggagacgtccgtagaacgtaccgtacggaacgaccgaacgggtcccgttacttaagtttagtttaggttaaagggtttaaaaacggcggtaacgtaccgttaagggtaaaccggttaaacccgggggaccccgggggtaccccggtaccgtttaacggaacccgtaacgggtcgggggaccggaacgggggaccggtcggtacgggtccgtaacccgttcctaccctccgacgtccccgtaaccaacccggtacgggtacccctagttcccggttacccctttcccccggtacggtcccctaacccccgtttacccgtaacccgaaacgggacccgtacccggtaaaccccggtttccgggtaccggggggaaccccaaacccggtaccgggtaacccgttcccgggaacccccgggtttggggacccgttccccgggg

SEQ ID NO: 40518 - DNA, 666 bp, Homo sapiens
  misc_feature: GYAE6OF01BM95M.29.14.B03.1.454.CMB.1.raw
  modified_base (150)..(150): a, c, t, g, unknown or other
  misc_feature (150)..(150): n is a, c, g, or t
  modified_base (218)..(218): a, c, t, g, unknown or other
  misc_feature (218)..(218): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (443)..(443): a, c, t, g, unknown or other
  misc_feature (443)..(443): n is a, c, g, or t
tcagatagagtactcacgaccggtgctcgatttagtgtgagtagtttgggctgagcgtggtcttttctgtggctattttaaaaggtgtccagtgtgacgtgcagttggtggagtcgtgggggcgccgtggggtacgggccgggggggtcnctgagactctcctgtgcggcctcgtggaatttaagttttaggagtcagtgccatggaacgtgggtccnccaggctccgaggggaaggggctggagtgggtctcggcttagttggnggcnggtggtggcgctatattattatcgacgagaccgcccgtaggaaggggtcccggttacaccgtaatttccgaagacgaacaagttacgaaagaacacgtctgtaatctgacaaagtggacagccgtaggacgacgtcgaccgacgaccgtcgtattagttataggtagtaacggngtagacgtacggacggtaccgggaccggtaccgtacgtacgaccgtacgggacgggacggaggtcgtcggtacgtcgccgtccgtcctccgtacgtacccgcccgtaccgaaccggtaccgtcctcgttaccccgttcccgtcccgcctacccctacccgtaccgaccgaccgaccgtacccgtcggccggacggacctacgaccgaccgccggtcgtcggtc

SEQ ID NO: 40519 - DNA, 706 bp, Homo sapiens
  misc_feature: GYAE6OF01DKQ1V.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagaccgccctggaacggggccggttcacctatttccagagactaattacgaagaacacgctgtatctagacaaagtggagacgcctgacgactcgacgacgacggccgtctattagttgtagttaaaggcgagcgtaggaaacgtaccggggaccggggcccgtacgttcggaacccgtacggtcgggggacccgaggggaccgcgtcgggtccacccgttcctcccgtacgaccgtccctacccgaaccgaaccgggcccctacgtcccggttccccttccccgtcggccctacccctcctaccaacgcgacctacccgtcggtcggggaccacgacgaccgaccggtcccggtggccgtcggtcccgttcggtaaccggtaaaccggtacccgttacccgttacccgaacggtttacctaccgttacgtccggtacggaccgggtccggggtcgttacgggaccgaaacgggtccgacgtacgg

SEQ ID NO: 40520 - DNA, 618 bp, Homo sapiens
  misc_feature: GYAE6OF01DZGC8.29.14.B03.1.454.CMB.1.raw
  modified_base (264)..(264): a, c, t, g, unknown or other
  misc_feature (264)..(264): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaanaacacgctgtaatctgcaaaatggagagcctgagactcgacgacacggccgtctattattgtggttaaaggcgagctggaaactacggggacccgggcccgacttgaaccgacgtggggccaggggacgcgtggtcaccgtctcctcaacgcctccgaccaacgggcccagtccggtaccttccccgtcggccacccctccctccgaacgtacgccacccgtcgtcgggggcctacgacgtcacgcccgtcgggctcggcctggtacgaacggtaccttaccgttaccgacggttacctacttacgttcgtacgacgggtccgggtcgtacgggacgtaacggccgctaaacgg

SEQ ID NO: 40521 - DNA, 621 bp, Homo sapiens
  misc_feature: GYAE6OF01CZWH9.29.14.B03.1.454.CMB.1.raw
  modified_base (504)..(504): a, c, t, g, unknown or other
  misc_feature (504)..(504): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
tcagatagagtactcacgaccggtgctcgatttagtgtgagtagtttgggggcgcctgggtacggccgggggggtcgctgagactctcctgtgcggcctctggattaagtttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgacaaatggagagcctgacgactcgacgacgacggccgtctattattgttagttaaaggcgaggctagggaacgtaccgggggacccggggcccgacttcgaccacgtcggggccgaggggacgcgtcggtcaccgtctcctcacgccctccgaccaacgggcccacgtccggtcccttcccccgtcggccctacccctcctaccaacgacgccaccgtcgtcggggcacgacgcncgcccgtcgggcctcgtccgtcggtaccgaacggtaccttaccgttccgtaacgttacctaccttagtccgtggacggtccgggtcgtcgggacgacgggaccgactagtagngngc

SEQ ID NO: 40522 - DNA, 847 bp, Homo sapiens
  misc_feature: GYAE6OF01AO47A.29.14.B03.1.454.CMB.1.raw
  modified_base (204)..(204): a, c, t, g, unknown or other
  misc_feature (204)..(204): n is a, c, g, or t
  modified_base (841)..(841): a, c, t, g, unknown or other
  misc_feature (841)..(841): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccgagggaagggctggagtgggtctcggctattagtgcagtggtggcgctatatattangcagaccgccgtggaagggccgttcacctatttccagagacaattcgaagaacacgctagtatctagactaaagtggaagacgccgtagacgtacctcgaccgacgaccgggtccgtactagtttacgttggtacggttaaacggcggtaacgtcgttaagggaaacgtacccgggggaaccccggggcccgtagtttacggaacccgtacgggtcggggacccgaagggggtaccgtccggttacggtaccccgtaaccggttcctacccgtacgaccgtacccccgtaccgaacccgtaaccggggcccctaacgttcccggttaccccgtttccccccggacggtacccctaacccccgtcccgttaacccgaaaccggtaccgtacccgtaaccccggttcgggtcccgggggtaccaaccggtacccggaaccgtccccgggtaccccggttcggggtcccgttaccggacccgggttaccgggtaccgtaaaccggttaacccgtttaacccgttacccggtacggtttaaccccgttaccggttaaccgttacccggtgggtaacccgggtcccggggtccgtacgggggtaacccggaaccgggtaccggtacccgtaaagttccgggngtcgcg

SEQ ID NO: 40523 - DNA, 736 bp, Homo sapiens
  misc_feature: GYAE6OF01C15XE.29.14.B03.1.454.CMB.1.raw
  modified_base (284)..(284): a, c, t, g, unknown or other
  misc_feature (284)..(284): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
tcagatagagtactcacgaccggtgctcgatttagtgtgagtagtttgggggcgcctgggtacgggccgggggggtcgctgagactctcctgtgcggcctctggatttaagttttaggagtcatgccatgaactgggtccgccaggctccgagggaaggggctggagtgggtctcggctattagtggcagtggtggcgctatatattatgcagacgccctgaagggccggttcaccatttccagagacaattcgaaagaacacgctgtatctgcaaaatggganagcctgagactcgaacgaccacggccgtctaatttattgtaggttaaaaggcgagctagggaaagtaccggggacccgggggccccgaacgtttggacccaacggttcgggggacccgaaggggggaccgtcgttcggggttacccacccggttaccttccctccgacggcccccttaccccgaacccgaacgggggccccctaaggttcccgggttcccctttacccccccgttcgggcccctaaccccccttcccttacccgaaacggacgccctacccgttccggtcgggggacccacgacgccacggcccggtcgggccgtcggcccgttggtaccgaacggtaaccttaccgtttaccgaaccggttaccttaccttacgtccgttaggacgggtcggggtccgttacgggaccgaaacgggcccgacgtagttaacggngngtacg

SEQ ID NO: 40524 - DNA, 705 bp, Homo sapiens
  misc_feature: GYAE6OF01B6FWY.29.14.B03.1.454.CMB.1.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
tcagatagagtactcacgaccggtgctcgatttagtgtgagtagttccgcgggggcaggagtcagacccactcaggacacagcatggacatgagggtccccgctcagctcctggggctcctgctgctctggctcccaggtgccagatgtgccatccagatgacccagtctccatacttccctgtctgcatctgtagganacagagtcagcatcacttgccgggnaagtcaggacataccgaatgagataagctaggtatcaacagaaaccaagggaaacctacctaacctcctagactctatcgctgcgtacctagtttaacgaaggtcggggtccctatcgtacggttcacggcggactaggtggactcgtaggtcaacgtagtactttaccgacttaccctacaaccctacgtacaacggccaacgtccccgttgaccgtacgtacccgttaggtaaacgttacgtttttacgaacctttaaaccttttactttaaccgtttacgtaacccgttaaacgtaaaacgttactttaacccgtaacctttaacccgtacggttaacggggttacccggttacccggggtaaacccggtaaaccggggtaaacccggtaaagggggttaaaccggtaaaaccgttaaaccggtaaaaccggtaaacggttacggtaccgggtaccttaacggaacccgttaaacccg

SEQ ID NO: 40525 - DNA, 571 bp, Homo sapiens
  misc_feature: GYAE6OF01ED55R.29.14.B03.1.454.CMB.1.raw
  modified_base (384)..(384): a, c, t, g, unknown or other
  misc_feature (384)..(384): n is a, c, g, or t
  modified_base (539)..(539): a, c, t, g, unknown or other
  misc_feature (539)..(539): n is a, c, g, or t
  modified_base (566)..(566): a, c, t, g, unknown or other
  misc_feature (566)..(566): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacnctggtcaccgtctcctcagcctccaccgaacgggcccatccggtccttcccccgtcggccacccctccctccaacgacgccacctcgtcgggggcacgacgccacgcccgtgggcctcgcccgtggtccgaaggtacctaccttccacgtacctntactctgagcgggctcggacaaggcgntaacg

SEQ ID NO: 40526 - DNA, 717 bp, Homo sapiens
  misc_feature: GYAE6OF01B5KG9.29.14.B03.1.454.CMB.1.raw
  modified_base (699)..(699): a, c, t, g, unknown or other
  misc_feature (699)..(699): n is a, c, g, or t
tcagatagagtactcacgaccggtgctcgatttagtgtgagtagtttggtggagtctgggggcgcctgggtacgggccgggggggtcgctgagactctcctgtgcggcctctggatttaagttttaggagtcatgccatgaacgtgggtccgccaggctccgaggggaagggctggagtgggtctcggctattagtggcaggtggtggcgctatattattatgcagacgccctaggaacgggccggttcacctatttccagagactaattcgaagaacacgctagtatcctgacaaagtggagagcctagagactcgaccgacacggtccgtactattattggttaggttaaaggcgagcgttaggaacgttaccggggaccggggacccggtacgttcgaaccacggtcggggaccgacgggggacgcgtacgggtccgtaacccggtcttcccgacgtacgacccctacccgaacccgaaccggggcccctaacggttcccgggtttacccctttccccccgtacgggtacccctaccccgttaccccttacccgaacggaccgtcccgtaacccgtcggtaccgggggaccaccggaacgtaccgaaccggcccggttaccgggctacggtcccggtgggaaccgtacggtaccttaccgttaccacgtacttactactcgtcggacgcgggtacngggacgacggcgactacg

SEQ ID NO: 40527 - DNA, 645 bp, Homo sapiens
  misc_feature: GYAE6OF01DU2GV.29.14.B03.1.454.CMB.1.raw
  modified_base (507)..(507): a, c, t, g, unknown or other
  misc_feature (507)..(507): n is a, c, g, or t
  modified_base (642)..(642): a, c, t, g, unknown or other
  misc_feature (642)..(642): n is a, c, g, or t
  modified_base (644)..(645): a, c, t, g, unknown or other
  misc_feature (644)..(645): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccggttcaccatttccagagacaattcgaagaacacgctgtatctgacaaatggagagcctgagactcgacgacaccggtccgtctattattgtaggttaaaggcgagcgtgggaagtaccgggggacccgggcccgacgttgacccgacgtgggggaccagggggaccgcgtcgggtaccacccggttctcccgtcgacgtcccctacccgaacccgaacgggtcccctacgttccggttccccttccccccgtggccctaccccctccgtaccgaacgacncctccgtccggtcggggacaccgacgccgtacgcccggtcgggcctcggccgtacggtacaacggtaccttacgtccctaagttacctctacgtccgtcggacggtcgggtccacgggacgacggccgacagtgngnn

SEQ ID NO: 40528 - DNA, 591 bp, Homo sapiens
  misc_feature: GYAE6OF01AV3WB.29.14.B03.1.454.CMB.1.raw
  modified_base (146)..(146): a, c, t, g, unknown or other
  misc_feature (146)..(146): n is a, c, g, or t
  modified_base (536)..(536): a, c, t, g, unknown or other
  misc_feature (536)..(536): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcnctgagactctcctgtgcggcctctggattaagttttaggagtcatgccatgaactgggtccgccaggctccgaggggaaggggctgggagtgggtctcggctattagtggcaggtggtggcgctatatattatgcagaccgccctggaacggggccggttcacctatttccagagacaattcgaaagaacacgctgtatctgacaaagtggagagcctagagactcgacgacacggctctattattggtagttaaaggcgagtcgtaggaagtaccgggaccggggcccgtacgttacgaccacggtcggggaccgacggggacgcgtcggtcacccgtctcctcgacgccaccaccgacggcccacgtccgtcccttccccgtcgcccnccctcctaccgacgcgcacccgtcgcggggccaccgcgcaccgccgtggcgtcgg

SEQ ID NO: 40529 - DNA, 660 bp, Homo sapiens
  misc_feature: GYAE6OF01EXEV3.29.14.B03.1.454.CMB.1.raw
tcagatagagtactcacgaccggtgctcgatttagtgtgagtagtttggtggagtctgggggcgcctgggtacgggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaagtggagagcctgagactcgacgacacggcctctattattgtagttaaaggcgagctaggaagtaccggggacccgggccgactcgaccacgtcggggccgtaggggacgcgtggtccaccgtctcctcacgcctccaaccgacggcccagtccggtcccttccccgtcggccctacccctcctaccaacgacgcccaccgtcggtccggggccacgacgaccacggcccggtcgggcctcggtccgttacggtaccgaaacgggtaccctttaacccgttacccgtaacggtttaaccttcccgttaacgttccggtacgggtaccgggacccgggggtccgtagggaacccggacgggtacccgacgtaaacgg

SEQ ID NO: 40530 - DNA, 684 bp, Homo sapiens
  misc_feature: GYAE6OF01D3RU4.29.14.B03.1.454.CMB.1.raw
  modified_base (459)..(459): a, c, t, g, unknown or other
  misc_feature (459)..(459): n is a, c, g, or t
  modified_base (534)..(534): a, c, t, g, unknown or other
  misc_feature (534)..(534): n is a, c, g, or t
  modified_base (649)..(649): a, c, t, g, unknown or other
  misc_feature (649)..(649): n is a, c, g, or t
  modified_base (680)..(683): a, c, t, g, unknown or other
  misc_feature (680)..(683): n is a, c, g, or t
tcagatagagtactcacgaccggtgctcgatttagtgtgagtagtttgggggcgcctgggtacgggccgggggggtcgctgagactctcctgtgcggcctctggatttaagttttaggagtcatgccatgaactgggtccgccaggctccgaggggaaggggctggaggtgggtctcggctagttaggtggcaggttggtggcgctatatattatcgcagaccgcccgtggaacgggtccggttccaccgtatttaccagagaactaattacgaagaacacgtctagtatcgtagacaaagtggaagacgccgtagacgacctacggacgaccgacggtccctacttagtttagttggtaggtaaaggcgtaagtcggtaggaacggtaccggggaccgggcccgtacgttcgaccgacggtcgggaccggagggacgtcgtcggtcctaccgtctccncgaccgtcctaccgacgacggtccctaggtcccgtcccttccccgcgtccctaccccgtccgtaccgaaggaccncccgtaccgggtcgggtaccggacaccgacggcccgaccggttccgggacgtcgtaccggtaccgtacggtaaccgacgttaccctacgtacctacgttctacgtgtacgtcggngggccgtcggacgacgtaccggctaagacgnnnng

SEQ ID NO: 40531 - DNA, 654 bp, Homo sapiens
  misc_feature: GYAE6OF01DDNEF.29.14.B03.1.454.CMB.1.raw
tcagatagagtactcacgaccggtgctcgatttagtgtgagtagttccgcgggggcaggagtcagacccactcaggacacagcatggacatgagggtccccgctcagctcctggggctcctgctgctctggctcccaggtgccagatgtgccatccagatgacccagtctccatattccctgtctgcatctgtaggagacagagtcagcatcacgttggccggacaagtcagacataccgaatgagataagcgtgtatacaacagaaaccgaaggaaaccctcctaacctcctagtaatctatgactcgcgtcgtaagtttaacgaaggtcgggtacccagttccgtacggttcaggtcggctaggtcggagttcgtggacctacgtagtacttttccaccttcctaccaactacttacgacgccgaagcccgttagcctacgccgtagtaacgtttactttacgaactttaacgtttagtttacctacgttaaccgttaaacaacgttactttaaacccgtaccgttaacgtaacggttacggggtacccggttaccgggaacccggtaaaaggggaccccgttaaagggggtaactaaaacgtaaccggaaaccgtaacgttacgggtacgggtactacggtccctaaaccg

SEQ ID NO: 40532 - DNA, 806 bp, Homo sapiens
  misc_feature: GYAE6OF01DM5CN.29.14.B03.1.454.CMB.1.raw
tcagatagagtactcacgaccggtgctcgatttagtgtgagtagtttggtggagtctgggggcgcctgggtacgggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagaccgccctggaacgggccggttcacctatttccagagactaattacgaaagaacacgctgtatctgacaaagtggagagcctgacactcgacgaccgacggccgtcttattattgttaggttaaaggcgagcgtaggaaacggtaccgggggacccgggacccgtacgtttaggaacccgtaacgggtccgggggacccggaacgggggaccgtcggttcgggtacccgtacccgttccttacccgttaccgacccgtccccgtaccccgaacccggaaacccgggcccccgtaacgttccccgggttccccctttcccccccggtacgggtaccccctaccccccgttaccccttaacccgaaaccggtacccgaccctaaccccgttccggggtacccgggggtaccaaccggtaaccgcccgtaacccggtccccgggttcgggggcccgttccggtcccggttacgggtaccgaaaccgggttacccttacccgtttacccgtacggttaacccttaccttacgttcccgtacgggtaccgggcggggtacgtacgggaccggaacgggccgacgtaacg

SEQ ID NO: 40533 - DNA, 864 bp, Homo sapiens
  misc_feature: GYAE6OF01DJUJO.29.14.B03.1.454.CMB.1.raw
tcagatagagtactcacgaccggtgctcgatttagtgtgagtagtttggtggagtctggggcgcctgggtacgggccggggggtcgctgagactctcctgtgcggcctctggatttaagttttaggagtcatgccatgaacgtgggtccgccaggctccgagggaagggctggagtgggtctcggctagttagttgcagtggtggcgctatattattatgcagacgccctgaacggtcgtcacctatttccgagagacaagttacgaaagaacacgctagtatcgtacgactaaagtggagacgtccgtagacgacgtccgaaccgaccgaccggtaccgttacttaagtttagtttaggttaaggtaaacggacgtacgtacgtaggtaaacggtaccggggacccgggacccgtacgttaccggaaccgtacgggtccggggaccggacggggaccgtcgtacggtaccgtacccggtccttcccgtaccgaccgtccctaccccgaaaccggacccgggacccttaacgggtcccccggttttaccccgttcccccccggtacgggacccccctttaaccccgttaccccgaacccgaaaaccgggtacccctacccggttacccccggttaccgggggtaccgggggacccctaaaccggcccggtaaccccggtaccccgggtcccccgggttacggggtccccgttcgggttaacccccgggttacccgggttaaaaccgaaaccgggtttcccctttaaacccggttaccctaacgtttacccgtacgtttaacgtccgggttaacggaccggggtcccggttagacccgggttaacgaaccggtccgtaacgtaag

SEQ ID NO: 40534 - DNA, 720 bp, Homo sapiens
  misc_feature: GYAE6OF01BMHOM.29.14.B03.1.454.CMB.1.raw
  modified_base (548)..(548): a, c, t, g, unknown or other
  misc_feature (548)..(548): n is a, c, g, or t
  modified_base (570)..(570): a, c, t, g, unknown or other
  misc_feature (570)..(570): n is a, c, g, or t
tcagatagagtactcacgaccggtgctcgatttagtgtgagtagtttggtggagtctgggggcgcctgggtacgggccgggggggtcgctgagactctcctgtgcggcctctggattaagttttaggagtcatgccatgaacgtgggtccgccaggcctccgaaggggaagggctgggagtgggtctcggctagttagtggcaggtggtggcgctatatattatgcagacgccctaggaacgggtccggtcaccatttccagagacaatacgaagaacagctagtatctagacaaagtggaagagccgtagacgacgtaccgaaccgacgaaccggtccgtactaatttagttaggttaaggttaaaggcgtagtcgtaggaacgtaccggggacccgggcccgtacgttacgaccgacggtcgggaccggacgggacgtcgtacggtcctacccggtccgcccgtcaccgtccctaccgtaccgacggaccctacggtcccgttccccttccccgtccgcccgtacccctccctaccgaacgtaccnccgaccgtaccggcggggaccncgacgaccgaccggcccggtacggtccgttcggcccggtacggtacggaaccggtaaccgttacccgttaccgtaaccggttaccttaccttacggtccgtacgggtacggccgggtacggacgggtacggaccgggcccgtacggaacg

SEQ ID NO: 40535 - DNA, 602 bp, Homo sapiens
  misc_feature: GYAE6OF01EHYRI.29.14.B03.1.454.CMB.1.raw
  modified_base (597)..(598): a, c, t, g, unknown or other
  misc_feature (597)..(598): n is a, c, g, or t
  modified_base (600)..(602): a, c, t, g, unknown or other
  misc_feature (600)..(602): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaagtacgggaccgggcccgacgttgaccacgtcgggccagggaaccctggtcaccgtctcctcacgccctccaaccgaacgggccctacgtccggtccttcccccctggcccaccccttccctaccaacgacgccaccgtccgtcggggccacgacggccggcccgtgggcctcgccgtcggtaccgaacgggtaccttaccttacccgacgttacctcttactccgtaggacggccgggtcgtcgggcgaacggcgacctatagnngnnn

SEQ ID NO: 40536 - DNA, 872 bp, Homo sapiens
  misc_feature: GYAE6OF01BJQMK.29.14.B03.1.454.CMB.1.raw
  modified_base (871)..(872): a, c, t, g, unknown or other
  misc_feature (871)..(872): n is a, c, g, or t
tcagatagagtactcacgaccggtgctcgatttagtgtgagtagtttgggtttagggggcgcctgggtacggccgggggggtcgctcgagactctcctgtgcggcctctggattaagttttaggagtcatgccatgaactgggtccgccaggctccgagggaaggggctggagtgggtctcggctattagtggcagtggtggcgctatatattatgcagaccgcccgtggaacgggtccgttcacctactttccagagacaattcgaaagaacacgctgtatctgacaaagtggagacgcctaggacgtacgtacggaaccgaccgaccgggtccgttacgtttaattttacgtttaggttaaacggttaaacgggacggtacggtaccggtaaggggtaaaaccgggtaaccccgggggggtaaccccggggtaccccggtaccggttaacccggaacccggtaacgggttaccgggggaaccggggacgggggtacccggtccggttcccgggttaacccgttaccccggttacccttaccccgtaccgtaacccggtccccccgtaaccccgaaacccgggaacccggggtacccccttaccgggtttcccccgggtttacccccttcccccccgggtcgtacccccttacccccgttacccgtaaccgaaaccggtcccgtaccccgttaccccggttcgggggacccgggccaacccggccggacccggtcccggtccccggggtcggtcccggttaccggtacccgttacggtaacccgaccgttaaccttccgtacttacgttacttaccgttcgcggtacgggacgggtcggtacggacccgggaacgacggcctaagagtgnn

SEQ ID NO: 40537 - DNA, 674 bp, Homo sapiens
  misc_feature: GYAE6OF01B8E4M.29.14.B03.1.454.CMB.1.raw
  modified_base (148)..(148): a, c, t, g, unknown or other
  misc_feature (148)..(148): n is a, c, g, or t
  modified_base (171)..(171): a, c, t, g, unknown or other
  misc_feature (171)..(171): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctggggtacggccggggggggtcnctgagactctcctgtgcggcctntggatttaagttttaggagtcatgccatgaactgggtccgccaggctccgaaggggaacggggctgggagtggggtctcgggtcttagttaggtggcaggttgggtggcgacttatatattatgcagaccgccctagaacggggtccgttcacctatttccagagacaagttacgaaagaacacgctgtatctgacaaagtggaagacgcctaggacgtactcggaaccgacgaccggtccgttacttaatttatttacggtaaggttaaaacggcggtaagtacgtagggtaacggtaaccgggggacccggggacccgtaacgttacgaccgtacggtcggggaccgacggggacgcgtcgtccgaccgtctcctcacgccctaccgaaccgaacggtcccacgttccggtcccttccccgtcgccctaccctcccgtaccgaacgaccgacctacccgtcggtcgggacaccgacgccaccggcccgtgggccgtacggg

SEQ ID NO: 40538 - DNA, 561 bp, Homo sapiens
  misc_feature: GYAE6OF01A7ELL.29.14.B03.1.454.CMB.1.raw
  modified_base (148)..(148): a, c, t, g, unknown or other
  misc_feature (148)..(148): n is a, c, g, or t
  modified_base (210)..(210): a, c, t, g, unknown or other
  misc_feature (210)..(210): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (517)..(517): a, c, t, g, unknown or other
  misc_feature (517)..(517): n is a, c, g, or t
  modified_base (530)..(530): a, c, t, g, unknown or other
  misc_feature (530)..(530): n is a, c, g, or t
tcagatagagtactcacgaccggtgctcgatttagtgtgagtagtttgggctgagctggcttttcttgtggctattttaaaaggtgtccagtgtgacgtgcagttggtggagtctgggggcgcctggggtacgggccggggggggtcnctgagactctcctgtgcggcctctggattaagttttaggagtcatgccatgaactgggtccnccaggctccgagggaaggggctgggagtggggtctcggcttattaggtggacaggtggtggcgctatatattatgcagacgccctgaagggccggttcacccatttccagtagacaattcgaagaacacgctgtatctgcaaatggagagcctganactcgacgacncggccgtctattatgtagtaaaggcgagctggaagtacgggacgggcccggacgttacgaccgacgtcggggccgaggggacgcgtggtccaccgtctcctcacgctccaccgaacggcccactcggtctccccgtgccnccctcctccagcncactcgcggggcacagccagcctggcgtcgg

SEQ ID NO: 40539 - DNA, 697 bp, Homo sapiens
  misc_feature: GYAE6OF01CR3PW.29.14.B03.1.454.CMB.1.raw
  modified_base (122)..(122): a, c, t, g, unknown or other
  misc_feature (122)..(122): n is a, c, g, or t
  modified_base (146)..(146): a, c, t, g, unknown or other
  misc_feature (146)..(146): n is a, c, g, or t
  modified_base (208)..(208): a, c, t, g, unknown or other
  misc_feature (208)..(208): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
tcagatagagtactcacgaccggtgctcgatttagtgtgagtagtttgggctgagctggcttttctgtggctattttaaaaggtgtccagtgtgacgtgcagttggtggagtcgtgggggcncctggggtacggccgggggggtcnctgagactctcctgtgcggcctctggattaagttttaggagtcatgccatgaactgggtccnccaggctccgaggggaagggctggagtgggtctcggcttataggtggcaggtggngcgntatatattangcagaccgcctggaacgggccgttcacctnttcagagaactaatcgaaagaacngtactgtactctgactaaaaggcggagagtcctaggaactaccgtacgaacggaccgaccgggcctttataagtttagtttaggtaaacggtttaaaggcgagtacgtaggtaacggtacggggacccggggacccggtacgtacgaaccgtacggtacggggcggacggggacggacgtcggtacgtaccgtcctcgtaccgacgtcccgtacccgaacccggaaccggacccgtaccgttaccggttccccttacccccggtccggccctaccccgtaccccctaccgtaacgaccgaccctacccgtccgggttaccgggggaccaccggacgaccgtaccggcccggtcgggccgtcccggg

SEQ ID NO: 40540 - DNA, 748 bp, Homo sapiens
  misc_feature: GYAE6OF01DE2O0.29.14.B03.1.454.CMB.1.raw
  modified_base (120)..(120): a, c, t, g, unknown or other
  misc_feature (120)..(120): n is a, c, g, or t
  modified_base (143)..(143): a, c, t, g, unknown or other
  misc_feature (143)..(143): n is a, c, g, or t
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
tcagatagagtactcacgaccggtgctcgatttagtgtgagtagtttgggctgagctgcttttctgtggctattttaaaaggtgtccagtgtgacgtgcagttggtggagtcgtggggcncctgggtacggccgggggggtcnctgagactctcctgtgcggcctctggatttaagtttaggagtcatgcatgaactgggtccncagctccgagggacgggctggagtggtctggctagttgngcagtggtgcgctatatattangcagaccnccgtaggaacgggccgttacaacctgtttccagagtactaagtcgaagacacgctgtactctcganaagtggagcgccgtagacgactcggacgaccgacggtccgtattacttagttcgtaaggtaaacggtcgaacgttcgtacgggtaacggtacccgggggacccggggtaccccgtaacgttacggaacccgtacgggtaccgggggacccggaacggggggtccgtaccgggttccgggttaacccgtacccggtttccccgttacccgttaccggtaacccgtccccgttaaccccggtaaaccccggtaaaccggggtccccgttaaccggttccccggtttaccccggttccccgtaccgggtacccctaccccgtacccgtaccgaaccgtaccgacccgtaacccggttccgggaccggggtaccaaccgcggtacccgaccgtcccggtggtccgttacccgg

SEQ ID NO: 40541 - DNA, 697 bp, Homo sapiens
  misc_feature: GYAE6OF01ESEXP.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccgaggggagggctggagtgggtctcggctattagtggcaggtggtggcgctatatattatgcagaccgccgtagaacgggccgttcacctatttccagagacaattcgaagacacgctgtatctagacaaagtggagacgcctaggagtactcgaacgacgacggtcctataatttagttggtagttaaacggcgtagtcgtagggaacggtaccggggacccggggtacccggtacgttacggaacccgtacggtacgggggacccggaacggggggtaccggtccggttacgggtacccgtacccggttccgttccccgtccgacgtccccgtacccgaacccggaaccgggaccccgtaacgttcccggttcccttcccccgtcggaccctacccctccccgtaccgaacggtccgacccgtacccgtccggtccgggggaccaccgacgaccgaccggcccggtcgggtccgtccgg

SEQ ID NO: 40542 - DNA, 662 bp, Homo sapiens
  misc_feature: GYAE6OF01B3DS3.29.14.B03.1.454.CMB.1.raw
  modified_base (145)..(145): a, c, t, g, unknown or other
  misc_feature (145)..(145): n is a, c, g, or t
  modified_base (373)..(373): a, c, t, g, unknown or other
  misc_feature (373)..(373): n is a, c, g, or t
tcagatagagtactcacgaccggtgctcgatttagtgtgagtagtttgggctgagcgtgcttttctgtgctattttaaaggtgtccagtgtgacgtgcagttggtggagtcgtgggggcgcctggggtacgggccgggggggtcnctgagacctctcctgtgcggcctctggattaagttttaggagtcatgccatgaactgggtccgcaggctccgaggggaagggctggagttgggtcgtcggactagttagtggcgaggtgggtggctctaatatatttatggcaacgacgcccgtaggaacggggcccgttacaccctatttaccgagagacctaagttcgaagaacacgctgtactctagactaaagnggagacgccgtgaagaccgtacggactaccgacggcgtttactatttagttacgttagttaaacgggcgaagtcgtaggaacgtaccgggacccgggaccgtaccgtacgaccgtaacgtcggggtaccgacggggacgtcggtcggtaccgccgtccgtccgtcctcgaccctaccacggtacccggacctcgtaccgtcccgttcccgtcccgacccgtaccttcccgacctaacgcgtacaccggtcccgtcggggacaccgacgcgaccgtccgcggtcgtccgg

SEQ ID NO: 40543 - DNA, 836 bp, Homo sapiens
  misc_feature: GYAE6OF01CRJLU.29.14.B03.1.454.CMB.1.raw
  modified_base (196)..(196): a, c, t, g, unknown or other
  misc_feature (196)..(196): n is a, c, g, or t
tcagatagagtactcacgaccggtgctcgatttagtgtgagtagtttggtggagtctgggggcgcctggggtacgggccgggggggtcgctgagactctcctgtgcggcctctggatttaagttttaggagtcatgccatgaactgggtccgccaggctccaggggaaggggctggagtgggtctcggctattagnggcaggtggtggcgctatatattatgacacgacgccctaggaacggggtccggttcaacctatttccaaggacgacaaattcgaaagaacacgctgtaatctgactaaagtgggaagagaccgttagacgtacgtacgaacggaacaccggtccgtacgttaattaatttggttagttaaaacggcgaagtacgtagggaaagtaccgggggacccgggacccgtacgttacggacccgtacggtcgggggaccgaacggggggtaaccgcggttacgggtacccgtaacccggttcccttacccgttacgaacccggtccccttaaccccgaaacccgggaaaaccggggtcccccctaaacggtttccccgggttaaccccgttttccccccccgttacggggaacccctacccccccgttaacccgtaaccccgtaaaacgtacccggtacccgtaaccccgttccgggttaacggggggaacccaacgaacgacccgtaccggtaccccgtggggtacctccgggccgttacgggtacgaaacggttaccgttaaccttaccgtacgttaacctcgtttaactcggttacggacgggttacgggccttacgggacccgtaaacggcgaaccgtaag

SEQ ID NO: 40544 - DNA, 611 bp, Homo sapiens
  misc_feature: GYAE6OF01DU4KT.29.14.B03.1.454.CMB.1.raw
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctggggtacggccggggggggtcgctgagactctcctgtgcggcctctggatttaagttttaggagtcatgccatgaactgggtccgccaggctccgaggggaaggggctgggagtggggtctcggctattagtggcagtggtggcgctatatattatgcagaccgccctggaaggggccggttcaccatttccagagacaattcgaagaacacgctgtatctgacaaatggagagcctgagactcgacgacacggcctctattattgtagttaaaggcgagcgtaggaaggtaccggggaccggggcccgtacgttacgaccgacgcggggccgacggggacgcgtcggtcgaccgtctccncncgccctaccaccgacggccacgtccggttccctccccgtcgccctaccctccctaccgaacgcgaccaccgtccggtacggggccaccgtacggcccggcccggtcgggccgtcggtcccgg

SEQ ID NO: 40545 - DNA, 695 bp, Homo sapiens
  misc_feature: GYAE6OF01BYTOG.29.14.B03.1.454.CMB.1.raw
  modified_base (152)..(152): a, c, t, g, unknown or other
  misc_feature (152)..(152): n is a, c, g, or t
  modified_base (211)..(211): a, c, t, g, unknown or other
  misc_feature (211)..(211): n is a, c, g, or t
  modified_base (265)..(265): a, c, t, g, unknown or other
  misc_feature (265)..(265): n is a, c, g, or t
  modified_base (430)..(430): a, c, t, g, unknown or other
  misc_feature (430)..(430): n is a, c, g, or t
tcagatagagtactcacgaccggtgctcgatttagtgtgagtagtttgggctgagcgtggtcgttttcttagtggctaatttttaaaaaggtgtccagtgtgacgtgcagttggtggagtctgggggcgcctgggtacggccgggggggtcnctgagactctcctgtgcggcctctggattaagtttaggatcatgccatgaactggtccncaggctcagggagggctggagtgggtctcggctattagtggccagtggtggcgntatatattatgcagaccgtccctggaacgggtccggttacaacctactttaccgagagacctaagttcgaaagaacacgctaggtatcgtgaactaaagtggacacgccgtgacgactcggaccgacgacggtccgtcttaagtttacgtggttagttaaacggngaaggcgtaggaacggtaccgggtaccgggcccgtacgttcgaccgtacggtcggggaccgaggggcgtacgtcggtacctaccgtctcccgtcgacgtcccaccgacccgaaccggggccctaacgtttcccggttcccttccccccgcggtaccccctacccccgttacccgtaccccgtaaggtacccgccgtaccccgttccggggacccgggggaccctaaccgacgtccgaaccggtccccggtcgggtccgtcccggg

SEQ ID NO: 40546 - DNA, 656 bp, Homo sapiens
  misc_feature: GYAE6OF01CA33R.29.14.B03.1.454.CMB.1.raw
  modified_base (146)..(146): a, c, t, g, unknown or other
  misc_feature (146)..(146): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcnctgagactctcctgtgcggcctctggattaagttttaggagtcatgccatgaactgggtccgccaggctccgagggaaggggctggagtgggtctcggctattagtggcagtggtggcgctatatattatgcagaccgccctgaacgggccggttacacctatttccagacgacaattcgaagaacacgctgtatctagactaaagtggagagcctagaacgactacggaacgacaccggccgtacttattagttgtagttaaaggcgagcgtaggaagtaccggggaccggggacccgtacgttcgaccgacgtcggggccgacggggaccgtcgtcggtaccgtaccgtccgtccctacgacgccctaccgaacccgaaccggccctaccgttcccggtcccttacccccgtcggaccctaccccgtccctacccgaacgccgaccctacccgtccggtacgggggaccaccgtacggaccgaccgaccccggtgggtcccgtcccgg

SEQ ID NO: 40547 - DNA, 564 bp, Homo sapiens
  misc_feature: GYAE6OF01BS1KW.29.14.B03.1.454.CMB.1.raw
  modified_base (324)..(324): a, c, t, g, unknown or other
  misc_feature (324)..(324): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggngagctaggaatacggggaccggggcccgacttgaccacgtggggccaggggacgctggtcaccgtctcctcgagccctccaaccgagggccccatccggtccttcccccgtcggcctacccctccctccaacgacgccacctcgtcggggacacacgcacgcccgtgggcctgccgtggtcgaggacctacttccacgtactctatcgtgacggcggcgtcggcgacggcgcagcgngnc

SEQ ID NO: 40548 - DNA, 701 bp, Homo sapiens
  misc_feature: GYAE6OF01ELGDZ.29.14.B03.1.454.CMB.1.raw
  modified_base (696)..(696): a, c, t, g, unknown or other
  misc_feature (696)..(696): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagacgccctggaagggccggttcacctatttccagagacaattacgaagaacacgctgtatctgacaaaatggagagcctagacgactcgacgacaccggccgtctattattggtagttaaaggcgagcgtaggaagtaccggggaccgggcccgtacgttacgaccgtaacggtcggggaccgaagggggaccgtcgtcgggtaccaacccgttctcccgtacgacgtcccctacccgaaaccgaacggggacccctaacgttcccggttacccctttccccccgtacggacccctaccccgtcccgtacccgaaagacccgcctaacccgtcccggaagacgacccgacgacggcccggcccgtcggggccttcggccgttacgggtaccaaaggtaccctttaaccgttcccgaagttacccttacgtacgttccgtacgggacggtccggggcgtacgggaccaacggggtccgatagtagntcgag

SEQ ID NO: 40549 - DNA, 738 bp, Homo sapiens
  misc_feature: GYAE6OF01B0SHL.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggccggttcaccatttccagacgacaattcgaagaacacgctgtatctgacaaatggagacgccgtgacgacgtcgaccgacgacggtcccgtactacttagttaggtaggttaaaggcgagcgtagggaaacgtaccggggacccggggcccgacgttacgacccgtacggtcggggaccgacgggggacgtcggttcgggtcccgacccgttcctcccgtcgacgtcccctacccacccggaaccgggtccccacgttccgggttccccttacccccgtcggtcccgaccccttccccgtaccaacggaccgacccgtaccccgtcgggttaccgggggcccaacggacggacccgtacccggtccccggttcggggccgttccggccggttccggaaccgtaacgggtaccttacccgttacccgtaacggttaccttacgttacgttccgtcggtaaccgggccgggtacgttacgggaaccggaacgggccgtagtaacgg

SEQ ID NO: 40550 - DNA, 603 bp, Homo sapiens
  misc_feature: GYAE6OF01CWIPE.29.14.B03.1.454.CMB.1.raw
  modified_base (264)..(264): a, c, t, g, unknown or other
  misc_feature (264)..(264): n is a, c, g, or t
  modified_base (393)..(393): a, c, t, g, unknown or other
  misc_feature (393)..(393): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaanaacacgctgtaatctgacaaagtggagacgcctgagactcgacgacacggccgtctaatttattggtagttaaaggcgagctagaaagtaccggggaccgggcccattcgacctacgcggggcagggcncgtggccaccgtctccgtcacgtccctaccgaccgaacgggccctaacgtcccgggttaccctttcccccgtcggtaccctacccctccctacccgaacgacgccaccgtcgtcggggaccacgacgcgacgccgtcggctcgccgtcggtacgaacggtactaccgtctaacgtctctactctaggacgcggcgtggacgacggcgcag

SEQ ID NO: 40551 - DNA, 710 bp, Homo sapiens
  misc_feature: GYAE6OF01CWVRV.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgcctgaagggccggttcaccatttccagagacaattcgaagacacgctgtatctgacaaatggagagcctagacgactcgacgacgacggccgtctaattagtgtagttaaaggcgaagctaggaaacgtaccggggaccggggcccgtacgttcgaccctacggtcgggggccgaagggggaccgtcgtacgggtccctaccgtcctaccgtccacgccctaccaaccgaacgggccctacgtccggttcccttcccccgtggtaccccgtacccctccctaacccgaacgtaccgaccctacccgttccgggtacgggggccaaccgtaacgcccgtaacggtccccggtagggccttcggcccgttacggtaaccgtaaacggtacccttaccgttccgtaaaccgtttaccgttaccttacgtttccgacgggaccggtaccgggggtcgttacgggacccgaaacggggcccgtagtaaacgg

SEQ ID NO: 40552 - DNA, 656 bp, Homo sapiens
  misc_feature: GYAE6OF01A3QSW.29.14.B03.1.454.CMB.1.raw
tcagatagagtactcacgaccggtgctcgatttagtgtgagtagtttggtggagtctgggggcgcctggggtacggccgggggggtcgctgagactctcctgtgcggcctctggattaagttttaggagtcatgccatgaactgggtccgccaggctccgagggaaggggctggaggtgggtctcggctattagtggcaggtggtggcgctatatattatgcagacgccctgaagggccgttcacctatttccagagacaattcgaagaacacgctgtatctgacaaagtggagagcctgagactcgacgacacggccgtctattatgtagttaaaggcgagcgtaggaacgtaccgggggacccgggcccgacgttcgaccgacggtcggggccgaggggaccgcgtcgggtccacccgttctcccgtcgacgccctcccgaaccgaacggccctacgtccggtcccttcccccgtcggccctacccccgtccctacccgaacggacgaccctacccgtccgggtcggggaccacgacgaccacggcccgtcgggcctcggcccggtggtccgaacggtaccttaccgttaccgtacgttaccttcgtacgttctacgggaggccggggtctacgggacgaacgggcgacgtacg

SEQ ID NO: 40553 - DNA, 674 bp, Homo sapiens
  misc_feature: GYAE6OF01AORE2.29.14.B03.1.454.CMB.1.raw
  modified_base (535)..(535): a, c, t, g, unknown or other
  misc_feature (535)..(535): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtaggaagtacggggaccgggccgacgttcgaccacgtggggccgaggggacgcgtcggtccaccggtccttccctcgacgtcccctacccgaacccgaaacggggccccacgttcccgggttccctttccccccgtggccccaacccccgttcccctacccaacgaccgccctaaccgttccgtcgggggccaacgngacccgacggtcccccgtgggccgtacggccgttgggtacccgtaagggacccttacccttcccgtaaacggttaccttccttaacgttcgtacggtaggccggggtccgttgggaaccggtaacgggccgagtaacgg

SEQ ID NO: 40554 - DNA, 788 bp, Homo sapiens
  misc_feature: GYAE6OF01AG28J.29.14.B03.1.454.CMB.1.raw
  modified_base (123)..(123): a, c, t, g, unknown or other
  misc_feature (123)..(123): n is a, c, g, or t
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
tcagatagagtactcacgaccggtgctcgatttagtgtgagtagtttgggctgagctggcttttcttgtggctattttaaaaggtgtccagtgtgacgtgcagttggtggagtcgtgggggcnccgtggggtacgggccgggggggtcctgagactctcctgtgcggcctctggtatttaaggttttaggagttcatgccatgaacgtgggtccncgaggctcgaggggagggctgggagtgggtctcggcttagttggnggctaggtgggtcggcgcttaagtattattagtgacacgccgcccgtaggacgggtccgttacacctacgttccaagacgtaactaagttacgaaagacgacgctagtactcgtagactaaagtggacgacgccgtaggaacgtaccgtacggaccggaaccgtacccgggtccttaagttagtttacgttaggttaaacggttaaacgggccgtaggtacggttaagggtaacccgggtaccgggggaaccccggggtacccgtacggttaccggaaccggtaccgggtacggggaccggtacgggggtaccgtacggttccggtacccgtacccggttcctcccgtcgtaccgtcccgtaacccgaccggaacccggtcccgtacgttccccgttccccgtaccccggtccggaccccttaccccgtcccgtaacccgaaccgtaccggtacccgtaacccgggttccgggccggggaaccctaccggtaccgaccgtaccgggtcccggtcgggtccgtaccggg

SEQ ID NO: 40555 - DNA, 843 bp, Homo sapiens
  misc_feature: GYAE6OF01AQ5V3.29.14.B03.1.454.CMB.1.raw
  modified_base (138)..(138): a, c, t, g, unknown or other
  misc_feature (138)..(138): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccnccaggctccgagggaaggggctggaggtgggtctcggctattagtggcagtggtggcgctatatattatgcagaccgccctaggaacgggtcccgttacacctactttaccgaagacgaactaattaccggaaagtaaaccacgtcttagtacttcgtagactaaagtgggacgaacgtccttaggaacgtaccgtaccggaaccggtaccgaccgggtacccgttactttaagtttacgttaggttaggttaaaacgggccgtaacgtccggttaacgggtaacggttacccgggggaccccgggggtaccccgtaacggtttaccggaacccgtacggggtaccgggggacccggtaaggggggacccgtcggttaccggggtacccctaacccggtttcccgtacccttaccgacccgtaccccgtacccgaaccccggtaacgggtccccgtaccgttacccgggttccccttcccccgttcggaccccttacccccgtacccgtacccgaaacgaccgtaccctacccggttcggtaccggggaccaccggacgtccgacccggtcccgtccggtaccgtccgtccggttacgtaccgtaccgtaacctaccgttacccgtacgttaccgtacttacgttaccgtacggtaccggcgggtccggtacggtaccggacggtaccgactaggtacgcgtgcg

SEQ ID NO: 40556 - DNA, 725 bp, Homo sapiens
  misc_feature: GYAE6OF01COB3V.29.14.B03.1.454.CMB.1.raw
  modified_base (214)..(214): a, c, t, g, unknown or other
  misc_feature (214)..(214): n is a, c, g, or t
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (721)..(722): a, c, t, g, unknown or other
  misc_feature (721)..(722): n is a, c, g, or t
  modified_base (724)..(724): a, c, t, g, unknown or other
  misc_feature (724)..(724): n is a, c, g, or t
tcagatagagtactcacgaccggtgctcgatttagtgtgagtagtttgggggcgcctgggtacgggccgggggggtcgctgagactctcctgtgcggcctctggatttaagttttaggagtcatgccatgaacgtgggtccgccaggctccgaggggaagggcgtggaggtgggtctcggctattaggtggcaggtggtggcgctatatattangcagaccgcctaggaacgggccgttcactatttccgaagagaactaatacgaaacgaaacaccgntaggtactcgtagactaaaagnggagacgcctagaacgacgacggaaccgacgaccggtccgttattaatttagttggtaagttaaaggcgtagtcggtaaggaacgtaacccgggggacccgggcccgtaagttaccggaacgttaccggcggggaaccggtaacgggggacgtcggttacggtcccgtaaccggttcttcccacgacgtaccccacgaacccgaacgggcccctacgtacccgggttacccttcccccgtacggccctacccctaccctaccgaaacgacgacctacccgtcgggtaccggggaccaaccggtcgaccgaccgccgtcggacgtcgtaccgtggtaaccgacggtaaccttacgtactaagtaccttctacgttcggacggacggttccggcgtggaaccggacggcgtaacgatacggnngng

SEQ ID NO: 40557 - DNA, 844 bp, Homo sapiens
  misc_feature: GYAE6OF01D85CC.29.14.B03.1.454.CMB.1.raw
  modified_base (150)..(150): a, c, t, g, unknown or other
  misc_feature (150)..(150): n is a, c, g, or t
  modified_base (279)..(279): a, c, t, g, unknown or other
  misc_feature (279)..(279): n is a, c, g, or t
tcagatagagtactcacgaccggtgctcgatttagtgtgagtagtttgggctgagctggctttttcttgtggctattttaaaaggtgtccagtgtgacgtgcagttggtggagtcgtgggggcgcctggggtaccgggccgggggggtcncgtgagactctcctgtgcggcctctggtatttaaggtttaggagtcatcgccagtgaacgtgggtcccgccgaggcctaccgaggggaaggggtctgggaggttcgggtcctcggtacttagtttaggnggctaggtgggtggccgtacttaagttaatttagtttagcggtaccgacggacccggtccccgtagggtaaccggggtcccggtttaccaacccgttactttacccgaagtaacgaactaagttacggaaacgaaccgacgtcttagtactcgtagaacaaagtggacgtacgccgtagacgtacgacgacgacgcggtaccttatacgtttagtggttaaggtaacggcgtacgtacgtaacgggaaccggtaaccggggacccgggtaccgtacgttaccgaccgtacgggtacggggacccggacggggacgtcggtaccggtacccgtcccgttcctacccgtaccgaccgtccccgtaacccggaaccggtacccgggtacccttacccggttccccggttacccccggttcccccggtacccgtaccccgtacccctttacccccggaaccgaacccggtccccgtacccggtaacccggttcccggggtaacccggggacctaaacccggtccggtacccggtacccgggtaccccggtcgggtcccgttaacccggg

SEQ ID NO: 40558 - DNA, 674 bp, Homo sapiens
  misc_feature: GYAE6OF01CPHET.29.14.B03.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
  modified_base (418)..(418): a, c, t, g, unknown or other
  misc_feature (418)..(418): n is a, c, g, or t
  modified_base (538)..(538): a, c, t, g, unknown or other
  misc_feature (538)..(538): n is a, c, g, or t
tcagatagagtactcacgaccggtgctcgatttagtgtgagtagtttggtggagtcgtgggggcgcctgggtacgggccgggggggtcgctgagactctcctgtgcggcctctggatttaagttttaggagtcatgccatgaactgggtccgccaggctaccgaggggaagggctggagtgggtctcggtctattagnggcagtggtgccgntatatattangcagacncctggaagggccgttacactattccaagacaacaattacgaaagactagctgtatctagacaaagtggaagngcctggaacgacgtcgaacgaccgtacgggccttactaagtttatagtagttaaaggcgagctaggaagtaccgggccgggaccattcggaccctaggcgggaccgaaggggtaccngtcggtacccacggtccttaccacgacgtccctaccgaaccgaaccggacctacgtccgtcccttcccgtccggacccaccctacccgttacccgaacgaccgtaccacccgttaccggngggggacccaacgacgaccgtacggtacccggtcgggtcgtcgtacccggtacgtacgtaaaccgtaacgttacctaaccgttacgtaaccttatacgtcgttacgcggaggtccgtagacgaacggcgacgtaag

SEQ ID NO: 40559 - DNA, 619 bp, Homo sapiens
  misc_feature: GYAE6OF01DUR4X.29.14.B03.1.454.CMB.1.raw
  modified_base (399)..(399): a, c, t, g, unknown or other
  misc_feature (399)..(399): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggccggttcaccatttccagagacaattcgaagaacacgctgtatctgacaaatggagagcctgagactcgacgacacggccgtctattagttgtagttaaaggcgagcgtaggaaagtacggggaccgggccacgttgaccacgtcggggcgagggacgcgtggtcnccgtctccgtcacgtcctaccaccgacggacccagtccgtacccttccccgtcgccacccctcctaccgaacgacgcctaccgtcgtacggggccacgacgcaccggcccgtgggcctcgtcccgttggacgtaaaccggtaccttaccgttccgaacgttaccttacttacgttccgtaggtacggaccgggtcgtacggtcgaacggccgtcgtaacg

SEQ ID NO: 40560 - DNA, 712 bp, Homo sapiens
  misc_feature: GYAE6OF01EIZII.29.14.B03.1.454.CMB.1.raw
  modified_base (709)..(710): a, c, t, g, unknown or other
  misc_feature (709)..(710): n is a, c, g, or t
  modified_base (712)..(712): a, c, t, g, unknown or other
  misc_feature (712)..(712): n is a, c, g, or t
tcagatagagtactcacgaccggtgctcgatttagtgtgagtagtttggggggcgcctgggtacgggccgggggggtcgctgagactctcctgtgcggcctctggattaagttttaggagtcatgccatgaactgggtccgccaggctccgaggggaagggggctggaggtgggtctcggctattaggtggcagtggtggcgctatatattatgcagaccgccctggaacgggccggttcacctatttccagagacaattcgaaagaacacgctgtactctgacaaatgggagagccgtgacgaccgtcgacgacgacggtcccgttctaatttagttggtaggttaaaggcggagcgtagggaacggtaccggggacccggggacccgtacgttcgacccgtacggtcgggaccggaggggacgcgtcgggtccgacccgtcctccctcgaccgtccctccgacccggaaccgggccctacgttcccggttccccttccccccgtcggcccctacccctcccgtacccgaagacccgtacccgtaccgtccgggtcggggaccctaccggacgtaccgcccggtcccggtccggggacttccggcccggttgggtaaccgaacggttacccttaccttaccctacgttaccctacttaccgtcgttcgacgggtccgggccgtcggaccggacggtccgacgaagtgnngn

SEQ ID NO: 40561 - DNA, 915 bp, Homo sapiens
  misc_feature: GYAE6OF01D1MO7.29.14.B03.1.454.CMB.1.raw
  modified_base (154)..(154): a, c, t, g, unknown or other
  misc_feature (154)..(154): n is a, c, g, or t
  modified_base (176)..(176): a, c, t, g, unknown or other
  misc_feature (176)..(176): n is a, c, g, or t
tcagatagagtactcacgaccggtgctcgatttagtgtgagtagtttgggctgagcgtggtctttttcttggtggctatttttaaaaggtgtccagtgtgacgtgcagttggtggagtcgtgggggcgcctggggtacgggccggggggggtcnctgagactctctgtgcggcctntggtatttaagttttaggagtcatgccatgaacgtgggtccgccaggctaccgaggggaaggggctgggaggttggggtcctcggcttagttaggtggacgtaggtgggtggcgtcttatattattatggcagaccgcccgtaggaacggggtccgttaccacctactttaccgaaggaacgtaactaaatttaccggaaacggaacgtaacgtcttagttacttcgtacgaacgtaaaagtagggaaggacgtccgtaggaacgtaccgtaccggaaccggaaccggtacccgggtaccgttactttaagttttaacgttttacggttaaaggtttaaaacggggacggacgggttacggttaacggggtaaacccggggttacccgggggggaacccccgggggggttacccccggttaaccgggtttaacccggtacccgtaaccggggttaccggggggacccgggaacgggggtacccgggtccggtccgggtacccgtacccggttcccgttacccgtaccgaccggtaccccgtaccccgacccggaaaccggggtcccctaacggttcccgggtttaccccttcccccggtaccggtacccccttacccccgtaccccgtaacccgtaaccggtacccgtaccctaccccggtccggggtacccgggggtacccaaacccgggtacccggacccgtacccggggtccccgttcgggggcccgttacccggg

SEQ ID NO: 40562 - DNA, 715 bp, Homo sapiens
  misc_feature: GYAE6OF01AJJ4Z.29.14.B03.1.454.CMB.1.raw
  modified_base (326)..(326): a, c, t, g, unknown or other
  misc_feature (326)..(326): n is a, c, g, or t
tcagatagagtactcacgaccggtgctcgatttagtgtgagtagtttggtggagtctgggggcgcctgggtacggccggggggtcgctgagactctcctggtgcggcctctggattaagtttttaggagtcatgccatgaactgggtccgccaggctccagggaaggggctggagtgggtctcggctattagtggcagtggtggcgctatatattatgcagacgccctggaacgggtccgttcacctatttccagacgacaattcgaagaacacgctgtatctgcaaatggagacgcctagagactcgacgacacggcctctattnttgtagttaaaggcgagcgtaggaaacgtaccgggggacccggggtcccgtaacttcggacccgtacgtcgggggacccaaggggggaccgcgttcgggtccaacccggttcctcccgtcgacgtccccgtacccgaacccgaacgggccccgtacgtcccgggttacccctttcccccgtcggcccgtaaccccttcccgtacccgaacgacgacccacccgtcggtcgggggccacgtacgaccgaccggtccccgtcgggtacccttcggcccgttcgggtacccgaaacgggtacccttacccgttacccgtacggttaccttaccgttacgttccgtacggtacggtccggggtcgtacgggacgaacgggtccgccgtaacgg

SEQ ID NO: 40563 - DNA, 679 bp, Homo sapiens
  misc_feature: GYAE6OF01CZYQ5.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctggaacgggccgttcacctatttccagagacaattcgaagaacacgctgtatctgacaaagtggagagcctagagactcgaacgaccgacggccgtctatttactgtaggttaaaggcgaggtctaggaaacgtaccggggaccggggccccgtagttcggaacccgtacggtcgggggccgaagggggccgtacgtgggtacccaccggttctcccttcgacgtccctaccgaaccgaaccgggccctaacgttcccggtccctttcccccgcggacccctaccccgtccctacccgaacgaccgcctaaccgttccggtcggggcctacggacgaccgaaccgtcccgtagggtcctcggtccgtacggtacgaacggtaccctaccgttaccgtaacgttaccgtctacttcgtacggaggaccgggtcacggacgacggcgctaacgg

SEQ ID NO: 40564 - DNA, 954 bp, Homo sapiens
  misc_feature: GYAE6OF01DH6D4.29.14.B03.1.454.CMB.1.raw
  modified_base (170)..(170): a, c, t, g, unknown or other
  misc_feature (170)..(170): n is a, c, g, or t
  modified_base (196)..(196): a, c, t, g, unknown or other
  misc_feature (196)..(196): n is a, c, g, or t
  modified_base (948)..(948): a, c, t, g, unknown or other
  misc_feature (948)..(948): n is a, c, g, or t
tcagatagagtactcacgaccggtgctcgatttagtgtgagtagtttgggggcgcctgggtacggccggggggtcgctgagactctcctgtgcggcctctggatttaagttttaggagtcatgccatgaactgggtccgccaggcctcgagggaagggctggagtggtcncggctagttagtggcagtggtggcgntagtatattagtcgcacgaccgtccctaggaacgggtcccggtttcaacctacttttccgaaggaacgaactaaacgtttacggaaagaaccgacggtccttaggttattacgtaggtaaccgtaaaagttacggggaagacgtaccgtaggacgaaccgttaccggaaccgaacccggaccgggttacccggtttacctttaagtttaacgtttaggttaacggtttaaaacgggaccggtacgtacggtaacgggaaaccgggtaacccgggggtaacccccgggggtacccttaaaccggttaccggaacccggtaccgggggttaccggggaacccggttaacgggggacggtaccggttacgggtacccgtaacccggttccctacgtaccgaccgtaccccgtaccccgaaccggacccgggtacccctaacggttcccggttacccccgtttaccccccgccggtacccccttaacccccgttaccccgaaccgtaaaccggacgtacccccgttacccgttaccggggtcgggtacccctaaccgaccgggtacccgtaccccgggtccccggggttcgggacccggttcccgggtacccggttacggttaaacccgggaaaccggtttaccccgttttaccgtacccgttaaaccctttaccgttacctttaaaccgttccgggtaacgggacgggttaccggggccgtttaccgggacgaccggggtcctaggaagttacgngtctcg

SEQ ID NO: 40565 - DNA, 861 bp, Homo sapiens
  misc_feature: GYAE6OF01B24JT.29.14.B03.1.454.CMB.1.raw
  modified_base (149)..(149): a, c, t, g, unknown or other
  misc_feature (149)..(149): n is a, c, g, or t
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
tcagatagagtactcacgaccggtgctcgatttagtgtgagtagtttgggctgagctggctttttcttgtggctattttaaaaggtgtccagtgtgacgtgcagttggtggagtcgtgggggcgcctggggtacggccggggggggtcnctgagactctcctgtgcggcctctggatttaagttttaggagttcatgccatgaactgggtccnccaggctccgaggggagggctggagtgggtctcggntattaggngcaggtggtggcntatattattagtgcagaccgcccgtaggaacgggtccggttacacctatttcccaagacgactaagttacgaacgaacacgctgtactcgtgaacaagtgggaagtacgaccgtggaacgtacctacggaccgtaccgaacccgggtccgttactttaagttttagttttaaggttacggttaaaagggaccgtaggttaccggttaagggtaaaccgggtaaccccggggggtacccgggggtacccccgttaacgtttaacccgggaacccgtaacggggttacccggggggaccggaaccggggggtaccggtccggttaccgggtacccgttaaccccggttcccttcccggtaacccaccggttccccgttaaccccgaaccggaaacccggggtcccctacgtttaccccgggttccccctttcccccgggtaccggtacccccctaccccgtttaccccgtaacccccgaaaacggtacccggtcccccgttaaccccggggttacccgggcgggggtaacccccaaaccggtaccggaccccgtaacccggggcccccgggttcggggcccccgttaccgggg

SEQ ID NO: 40566 - DNA, 743 bp, Homo sapiens
  misc_feature: GYAE6OF01CWJNX.29.14.B03.1.454.CMB.1.raw
  modified_base (168)..(168): a, c, t, g, unknown or other
  misc_feature (168)..(168): n is a, c, g, or t
  modified_base (208)..(208): a, c, t, g, unknown or other
  misc_feature (208)..(208): n is a, c, g, or t
tcagatagagtactcacgaccggtgctcgatttagtgtgagtagtttgggctgagctggctttttcttgtggctattttaaaaggtgtccagtgtgacgtgcagttggtggagtcgtggggcgcctggggtacggccgggggggtcctgagactctcctgtgcgcctntggatttaagttttaggagtcatgccatgaactgggtccnccaggctccgaggggaagggctgggagtcgggtctcggcttagttagtggctaggttgggtggcgactagtattattatgcagaccgcccgtagaacgggtccgttcaacctatttccgagacgactaattacgaagaaccacgctagtatctagacaaagtggaagtcgcctagaacgtaccgtcggaaccgaccgaccggtccgtacttaagtttagtttggtaaggttaaacggcgtaacgtcgtaaggaacggtaccggggacccggggtaccccgtaacgttaccgacccgtacggtcggggaccggacggggaccgcgttacggtccaccgttcccgtcccgttacgccgtaccctacccgaacccgaaccgggtacccctaccgttcccgggttaccccttcccccgtcgacccctacccccgttcccgtaccgtaaccgaccgtacccgtacccggttccgggtaccgggggaacccaaaccggaccgtaacccggccccggttacgggtcccgtcggtaccccggg

SEQ ID NO: 40567 - DNA, 631 bp, Homo sapiens
  misc_feature: GYAE6OF01AE6BR.29.14.B03.1.454.CMB.1.raw
  modified_base (148)..(148): a, c, t, g, unknown or other
  misc_feature (148)..(148): n is a, c, g, or t
tcagatagagtactcacgaccggtgctcgatttagtgtgagtagtttgggctgagctggctttttcttgtggctattttaaaaggtgtccagtgttacgtgcagttggtggagtcgtgggggcgcctggggtacggccgggggggtcnctgagactctcctgtgcggcctctggatttaagttttaggagtcatgccatgaactgggtccgcaggctccgaggggagggctggagtgggtctcggctattagtggcaggtggtggcgctatattattatgcagaccgcccgtaggaacgggtccggttacacctatttaccgagacgaactaattacgaacgaacacgctagtactctgactaaatggagacgcctgagacgtcggacgacgaccggtccgtattaatttagttagtagttaaacggcgagtcgtaggaacgtacggggaccgggccgacgttcgaccgacggtcggggacgacggggacgcgtcggtccgtaccgtctccgtcacgtccctccgaccgacggcccacgtccgtcctccccgtcgaccctccctcctaccgacgacgccgaccgtcggtcggggacctacgacgccgacgacccggtcggccgtcgtccgg

SEQ ID NO: 40568 - DNA, 616 bp, Homo sapiens
  misc_feature: GYAE6OF01EG2SX.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctatttagtggcagtggtggcgctatatattatgcagacgccctgaacgggccggttcaccatttccagagacaattcgaagaacacgctgtatctgcaaatggagagcctgagactcgacgacacggccgtctattattgtgttaaaggcgagctaggaataccggggaccggggcccacgttgaacccacgtcgggggaccagggggaccgcgtcggtccgacccgttctccctcgacgtccctcccaccgaacgggccccacgttccggttccttccccccgtggccctacccctccctcccaagacgccaccgtcgtcggggacacgacgccacgcccgtgggccgtcgccgtacggtcaacggtacttaccttccacgttactcttactctggacggcgggtcgacgggtcgaagggccgcgtaacg

SEQ ID NO: 40569 - DNA, 775 bp, Homo sapiens
  misc_feature: GYAE6OF01CYB79.29.14.B03.1.454.CMB.1.raw
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
tcagatagagtactcacgaccggtgctcgatttagtgtgagtagtttggtggagtcgtgggggcgcctgggtacggccgggggggtcgctgagactctcctgtgcggcctctggatttaaggttttaggagtcatgccatgaacgtgggtccgccgaggctccgaggggaagggtctgggaggtgggtctcggcttagttaggtggcgtaggtgggtggcgtcttatagttatttatgacgagtaccgcccgtaggaacgggtccggttacacctatttccgagacgaactaagttacgaaagaaccgacggcttagtatcngactaaagtggaagtacgctaggacncgtacgaacgtacaccggtccgtacttattacgttggttaagttaaacgggcgtagacgtagggaaccggtaccggggtaccgggaccgtacgttaccgaccgtacgggtcggggaccggacgggacgtccgtacgggtccctaccgtcgtccctacgacgtccctaccgaccggacggtacccgtaccgtcccgtacccgttcccccgtcggtacccctacccgtacccctacgaaaccggtccgacccgtaacccggtcggtacggggaccgaaccgtccggaccgtacccggtcccggtccgggtaccgtccggtaccggtaccggtaccgaaccggttaccctaccgttaccgtaacggtcccttacgttacggtcgacgggtaccggtccgggtcgtacggaccggaacggtcgaacggtag

SEQ ID NO: 40570 - DNA, 922 bp, Homo sapiens
  misc_feature: GYAE6OF01B6SH3.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaacgtcgggtccgccgaggctccgaggggaaggggctgggaggtgggtctcggacttagttaggtggcaggtgggtcggcgtacttattattattagtcggactacggaccgtcccgtaggaaccggggtcccggttaccacctactttacccaggtacgtaactaacgttacggaacgaaccgaccgtcgttacgttaactccgtacgaactaaagtaggacgacgtccgtagacgtaccgtcgaccgaccgaccggtccgttacttagttcgtttaggtaaggtaacgggcgtaacggtcgtaagggaacggtacccggggaccgggtacccgtacgttacgacccgtaacggggtccggggacccggtaacggggaccgtcggttacccgggtaccgtacccgttccgttacccgtaccgtaccggtaccccgtacccggaaacccggtaaccccggggtaccccttaaccccgggtttcccggggttttaccccccctttacccccgggaccgggttaacccccctacccccgtttacccgtaacccggaacggttacccgtacccgttacccggtaaccggggttcggaacccaaccgtacggtacccggacccgttcccgggtacgggtcccgttccggtaccggtttccggaaccggtaaaccggtttccccttaccgtttaaaccgggacctttacccggttattaccgggtaacggttcgggtaacccggggccgggttacgaccggggaaccggtaaccgtcggaaccgttagg

SEQ ID NO: 40571 - DNA, 859 bp, Homo sapiens
  misc_feature: GYAE6OF01DW6U4.29.14.B03.1.454.CMB.1.raw
  modified_base (130)..(130): a, c, t, g, unknown or other
  misc_feature (130)..(130): n is a, c, g, or t
  modified_base (159)..(159): a, c, t, g, unknown or other
  misc_feature (159)..(159): n is a, c, g, or t
tcagatagagtactcacgaccggtgctcgatttagtgtgagtagtttgggctgagctggtctttttcttgtggctaattttaaaaggtgtccagtgtgacgtgctaggttggtgggagtcgtggggggcnccgttgggggtaccgggccgggggggtcncgtgagtctctcctggtgccggcctgtaggtaatttaaggtttagagtcatcgcctatgacgtcgggtcccgcgaggtcctaccggaagggggtaacgggtcgtagggtacggttcggggtctacgggtacttaggttacgggtcggacgtacgggtggggtacgtccgtattaattagttatttaacgcggacgacggtacccggtacccgtaggggtaaccgggttcccgttaacctaccgttacttaccgaacggaacgtaacgtaacgttaaccgaaactaaccgtcgtacgttacgtacttcgaagtaacgtaaaggtcggaacgtacgtacgtacgaacgtacgtacccggaacgtaccggtaccgggttcttacgttaaagtttcgggttaacgggttaaagtaaacggggccgtaaggtacccggtaaggggtaacccggggtaacccgggtaccggggtacccgtaacggttacccggaccggtacggggtccgggaacgggcgggtacgtcgtacgtccgtaccgtcctccgcctacggtcccaccgaaccggaccgtacccctggttacccgttccccgtacccggtccgtacccctacccgtacccgtagacccggtcctacccggtcggtacccgggaccgtaccaaccggtccggacccgacgttcccggtcggtcgttacccggg

SEQ ID NO: 40572 - DNA, 932 bp, Homo sapiens
  misc_feature: GYAE6OF01B1I28.29.14.B03.1.454.CMB.1.raw
  modified_base (126)..(126): a, c, t, g, unknown or other
  misc_feature (126)..(126): n is a, c, g, or t
  modified_base (152)..(152): a, c, t, g, unknown or other
  misc_feature (152)..(152): n is a, c, g, or t
  modified_base (167)..(167): a, c, t, g, unknown or other
  misc_feature (167)..(167): n is a, c, g, or t
  modified_base (218)..(218): a, c, t, g, unknown or other
  misc_feature (218)..(218): n is a, c, g, or t
  modified_base (263)..(263): a, c, t, g, unknown or other
  misc_feature (263)..(263): n is a, c, g, or t
tcagatagagtactcacgaccggtgctcgatttagtgtgagtagtttgggctgagctggtctttttcttgtggctaattttaaaaggtgtccagtgtgacgtgcagttggtggagtcgtgggggcnccgtggggtacgggccgggggggtcnctgagactctcctgngcggcctctggtatttaaggttttaggagtcatgccatgaacgtgggtccncaggctcgaggggagggctggaggtgggtctcggattagttaggnggcgaggttggggtggacgtcttaattattattagtcgacgacgacccgccccgtagggtaacggggtcccggttaccaaccttactttaccgaagaacggtaactaacggttacggaaaacgaacgaccgtacgttaggttaactccgttagaaccgtaaaaggtcgggaacgacggtacccgttggaaacgtaccgtaaccggaaaccggaacccgtaccgggttacccgttacgtttaaacgttttaggtttacgggtttaaaggttaaaacggggcggttacgaccggggttaacggggtaacccgggttaacccgggggggaccccggggttaccccggtaacggtttacccggaaacccgggttacggggtaccgggggacccggacggggggtaacccggttcccgggtaccgggtaccggttaccccgttcccgtttacccgtaccgtacccgtacccccggaccccgtaaacccggtaaccggggtacccccgttaaccgggttaccccggtttaccccgtttaccccccggtacggaccccccgttaccccgttacccgtaccgggaaaccgtccccgaccgtaccccggtttacggggtccggggaacccaacgtccggaccgtaccccggggacccggttcgggtcccgttaccggg

SEQ ID NO: 40573 - DNA, 937 bp, Homo sapiens
  misc_feature: GYAE6OF01BCJ5Z.29.14.B03.1.454.CMB.1.raw
tcagatagagtactcacgaccggtgctcgatttagtgtgagtagtttggtgggtaggtctgggggcgcctgggtacggccgggggggtcgctgagactctcctgttgcggcctctggattaagttttaggagtcatgccatgaactgggtccgccaggctccgagggaaggggctggagttgggtctcggctattagtggcagtggtggcgcgtatatattatggcagacgcccgtgaagggtccgttcaccgagtttccagagacaattccgaagaacacgctgtatctgctaaactcgagagcctgagctacgacgacaccggccgtctattacgttgtacggtttaaaaggccgtaggcgtcgggaaactacggggtacccggggaccccgtacgtttacggaacccgtacgtcggggggaacctaacgggggtacgccgttcggggtacccaaccccggttccgttacccgtccgacgggtaccccttcccccgaaacccgtaaaccggggtcccccctaaacggttccccggggtttaccccgtttaccccccccggttacggggtacccccgtaaaccccccgttacccccgtttacccccgtaaaacgggtaccggtaaccccgttaacccgtttacccggttacggggggggtaaccccttaacccgggaaaccggtaaccccggtaccggggtaaccccccccggtttacgggggggtaaccccttccggggtaacccccggttttacgggggttaaccccttaaaacgggggttaacccctttaaaccccggtttaaaccccgttaaacggtttaccccgtttaacccgggttaacgttacccggttaacggggtaacccgggttaccggggggttacccccgttaggggtaccccgaacgggggttccccgtaccgtaaacccggg

SEQ ID NO: 40574 - DNA, 820 bp, Homo sapiens
  misc_feature: GYAE6OF01CAKVV.29.14.B03.1.454.CMB.1.raw
tcagatagagtactcacgaccggtgctcgatttagtgtgagtagtttgggggcgcctgggtacgggccgggggggtcgctgagactctcctgtgcggcctctggatttaagttttaggagtcatgccatgaactgggtccgccaggctccgaggggaagggctggagtgggtctcggctattagtggcagtggtggcgctatatattatgcagacgccctggaacgggccgttcacctatttccagagacaattcgaaagaacacgctgtatctagacaaagtggagacgcctaggacgtaccgtaccggaccgaaccgaccgggccgttacttagtttaacgtttggttaacggtttaaaagggcgaggtcgtagggaaacggtaacccgggggacccgggggtccccgtaacgtttccggaacccgtacggtccgggggaccggaagggggaccgtcggtcgggtacccgtacccggtccttccccgtaccgaccgtcccccgtacccgaacccggaaacggggcccctacgttcccggtttccccgttccccccgtacgggcccctaccccccgtcccgttacccgaaacggtacccgaccgtacccgtcggtccgggggaccaacggaccgaccgtaccggccccggtacgggtcccgttccggacccggtttacgggtacccgtaaacgggttaacccttacccgttaccggttaaccgttacccttaccgtaccgttacggtacgggttaccggggacccgggttcggttaccgggaaccggaacgggtcccggaacgaagttaggcgagtcgg

SEQ ID NO: 40575 - DNA, 810 bp, Homo sapiens
  misc_feature: GYAE6OF01CVNPG.29.14.B03.1.454.CMB.1.raw
  modified_base (584)..(584): a, c, t, g, unknown or other
  misc_feature (584)..(584): n is a, c, g, or t
tcagatagagtactcacgaccggtgctcgatttagtgtgagtagtttggtggagtctgggggcgcctgggtacgggccgggggggtcgctgagactctcctgtgcggcctctggattaagttttaggagtcatgccatgaacgtgggtccgccgaggctccgaggggaaggggctggaggtgggtctcggctattagtggcagtggtggcgctatatattatgcagaccgcccgtgggaacggggtccggttaccacctactttcccagaacgaactaagttacggaagaaccgacgcttagttatctgaacaaagtggaagacgacgtagacgacctacgacgaccgaccggtccgtacttattagttaggttaggttaaacggacggtacggtcgtacgggtaacgggtaacccggggggacccggggtacccgtacgttccggaacccgtcgggtaccgggggaccggaacgggggacgcggttaccggtacccgtaccgttccctcccgtcgaccgtccctaaccccgtaacccggaaccgggtccccctaggttccccggttaccccctttcccccggnggtaccccctcccccgttacccgaaccgaaccgacccggcccctaccggttccggggaccggggtaccacgtaccggacccgaccggtccccgggtcgggtaccgtccggtacccggttcggtaaccgtaaaccggttacccttaccgttacccggttacgtacctttaccgtacggttcgtagggaccgggccgggtcggtacggaggaacgggccgacgtaacg

SEQ ID NO: 40576 - DNA, 753 bp, Homo sapiens
  misc_feature: GYAE6OF01EAU78.29.14.B03.1.454.CMB.1.raw
  modified_base (234)..(234): a, c, t, g, unknown or other
  misc_feature (234)..(234): n is a, c, g, or t
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
  modified_base (433)..(433): a, c, t, g, unknown or other
  misc_feature (433)..(433): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatcgtaacgtggggtaccgccagggtcctccgaagggggaaggggtctgggaggtgggtctcggtctagttaggtaggcagtggtggcgctatatattangcgagacgcccgtagaacgggtccgttcacctattccagtacgactaattacgaaagtaacaccgntgtaatcgtaggactaaagtgganagcctgaacgtactcggacgtacgcgccgtatacttagtcgtagttaaggcgtagcgtaggaagtacgggccgggccgtgtacgacctaggtcgggacgtacggggacncgtacggccgaaccgttctcccgtacaacgcccgtaccgacggaacggccctaggtcccgggtttaccccttccccgaggtaccctacccccgtcccgttaacccgaaacggtaccgtacccgaccgttcccggtacggggtacctaccggaaccgccgaaccggtcccgggttacggtacccgttcgaaccccgggttacggtaacccggtaaaagggttacccctttaaacccggttaccgtaaccgggtaccttaaccgttgtacccggtaagccgggtacgggtcgttaaccggacggtaacggtcgaccgtaagg

SEQ ID NO: 40577 - DNA, 781 bp, Homo sapiens
  misc_feature: GYAE6OF01ET263.29.14.B03.1.454.CMB.1.raw
  modified_base (283)..(283): a, c, t, g, unknown or other
  misc_feature (283)..(283): n is a, c, g, or t
tcagatagagtactcacgaccggtgctcgattttagtgtgagtagtttggtggagtcgtgggggcgcctgggtacgggccgggggggtcgctgagactctcctgtgcggcctctggattaagttttaggagtcatgccatgaactgggtccgccaggctccgagggaagggctggagtgggtctcggactatttagttgcaggtggtggcgctatatattatgcagaccgccgtaggaacgggtccggttcacctactttccagacgacaattcgaaagaacncgtctgtactctagacaaagtggagacgaccgtagagactccgacgacgaccggtccgttacttatttagttgtaaggttaaaggcgagtcgtaggaacggtaccggggaccgggaccgtacgtcgaccgacgggtcggggaccggtacggggacgtcgtacggtacccgaccggttcctccgtaccgaccggaccctacccgaacccggaaccgggacccctacggttccccggttcccctttcccccgtacggcccctacccccgttacccgtacccgaaacgaccgtccgtacccgtcgggtaccggggtaccaacgacccggaccgtacccgggtacccggttgggacccttccgggtaccgtacgggttaacccggaaacgggttaacccttacccgtttaccggtaaccgtttacccttacgtttaacgtccggttagggacccgggtccggggtacgtacggggaaccggaaaccggccggtaacgtaagg

SEQ ID NO: 40578 - DNA, 716 bp, Homo sapiens
  misc_feature: GYAE6OF01DNWUY.29.14.B03.1.454.CMB.1.raw
  modified_base (89)..(89): a, c, t, g, unknown or other
  misc_feature (89)..(89): n is a, c, g, or t
  modified_base (157)..(157): a, c, t, g, unknown or other
  misc_feature (157)..(157): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (380)..(380): a, c, t, g, unknown or other
  misc_feature (380)..(380): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
  modified_base (527)..(527): a, c, t, g, unknown or other
  misc_feature (527)..(527): n is a, c, g, or t
  modified_base (672)..(672): a, c, t, g, unknown or other
  misc_feature (672)..(672): n is a, c, g, or t
tcagatagagtactcacgaccggtgctcgatttagtgtgagtagtttgggctgagcgtgtcgttttctaggtggctaattttaaaaggngtccagtgtgacgtgctagttggtggagtcgtgggggctccggtggggtaccggggccgggggggtcnctgagccttctccgtgtggcggccctgtaggtaatttaagttttggatcatcgccatgaacgttcggccgccgaggcctacggaggggagggntgggaggtggtccgtggtattntggtgagtggtggtggcgntatattattagcncgacgaccgaccgtgggaccggggttcctactaccggtattccgaaggacacctagtacgaacggaactcgcttanctgtacaagaagttggaaccgngtccaaggcgtcggacaacgtcnccggtcgttcttaattggtaggtaaacggttacgggacgaggttccggtaggtaaccggggacccgggggccgggtaccctacggttcggacggtaccgggngggacgggccgggtcgtccgttacgccttcccgtactcccgacgccgtccggacccacccggtaacgggtcctacccggttccgttcccgttcccccggagtcccccgtacccttacccgacccaggtcccgacccttacggggnggcccgggtaacacgcggttacccgccgtcccggggtccctcgg

SEQ ID NO: 40579 - DNA, 615 bp, Homo sapiens
  misc_feature: GYAE6OF01B8N2L.29.14.B03.1.454.CMB.1.raw
  modified_base (351)..(351): a, c, t, g, unknown or other
  misc_feature (351)..(351): n is a, c, g, or t
  modified_base (442)..(442): a, c, t, g, unknown or other
  misc_feature (442)..(442): n is a, c, g, or t
  modified_base (582)..(582): a, c, t, g, unknown or other
  misc_feature (582)..(582): n is a, c, g, or t
  modified_base (610)..(610): a, c, t, g, unknown or other
  misc_feature (610)..(610): n is a, c, g, or t
tcagatagagtactcacgaccggtgctcgatttagtgtgagtagtttggtgggagtctggggggcgcctggggtacggccgggggggtcgctgagactctcctgtgcggcctctggatttaagttttaggagtcatgccatgaactgggtccgccaggctccgagggaaggggctggagtgggtctcggctattagttgcagtgggtggcgctatatattatgcagaccgccctggaacgggccggttcacctatttccagagactaattacgaaagaacacgctgtactctgacaaaagtggagacgcctgacgactcgacgacacggccgtctattattgtagtaaggngagcgtaggaagtacggggacccggggacccgtacgttcgacctacggtcggggaccgacggggacgcgttcgggtccacccgtcctcccncgacgccctaccacccgaacgggccccacgttcccggttccccttacccccgtcggcccctacccctcccgtaccgacgaccgccaccgtcggtcggggccacgcgcacgccgtggctcgcgtgcacgactactcattcntactcaggcgcggtcgacggacgacggngctag

SEQ ID NO: 40580 - DNA, 589 bp, Homo sapiens
  misc_feature: GYAE6OF01BJ6C5.29.14.B03.1.454.CMB.1.raw
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
  modified_base (582)..(582): a, c, t, g, unknown or other
  misc_feature (582)..(582): n is a, c, g, or t
tcagatagagtactcacgaccggtgctcgatttagtgtgagtagtttggtggagtctgggggcgcctgggtacgggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggccggttcaccatttccagagacaattcgaagaacacgctgtatctgacaaatggagagcctgagactcgacgacacggccgtctatttatttgtagttaaaagggcgagcgtaggaacgtaccggggacccggggcccgacgttgaccaacggtcggggccgacggggacgcgtggtccgaccgtctcctcacgcctccacgaacggccagtccgtcctcccgngccnccctccncacgcaccncctcggtcgggccacgcgcacgccgtcggctcgcgtcgactaacggtacctcctaccgtacgtcttctactcgcggacgggcgggtcgtcgggacgaacgggntcgaacg

SEQ ID NO: 40581 - DNA, 860 bp, Homo sapiens
  misc_feature: GYAE6OF01C0ND3.29.14.B03.1.454.CMB.1.raw
  modified_base (815)..(815): a, c, t, g, unknown or other
  misc_feature (815)..(815): n is a, c, g, or t
  modified_base (857)..(857): a, c, t, g, unknown or other
  misc_feature (857)..(857): n is a, c, g, or t
tcagatagagtactcacgaccggtgctcgatttagtgtgagtagtttggtggagtcgtgggggcgcctgggtacgggccgggggggtcgctgagactctcctgtgcggcctctggattaagttttaggagtcatgccatagaacgtcgggtccgccgaggctccgaggggaaggggctggaggtgggtctcggctagttagtggcaggtggtggcgtctatattattagtgacgagaccgtcccgtaggaacggggtccgttaccaacctacgtttaccgaaggaacgtaaactaacgttaacggaaacgaaccgacgtaccgttggttaacttacgtacggtaacgaaaagttacgggaacgacggtacccgttaaggaccgtaacgtcccggaaaccggaccgaccgggtccgttaccgtttaatttaggtttaggttaagggttaaaacggcgtacgacgtaagggtaacggacccgggggtacccgggaccctacgttacgaaccgtacggggtcgggaccgggacggggacgtaccggttcggtaccgtacccgtccgtacctacgaccgttccccaacccggtaacccggaacccgggtcccttaacgggtttccccccggtttaccccctttacccccggcggtaacccccttaccccgttaccccgaacggaacccgtaccgtacccgtacccgttcgggggtcgggaccacggtaccgtcgacccggtcccgggtgttccgtacgggttacccgaggtaacctaaacgggtcccttacgttcccgtaaagttcccctggttaaccnggttacggacgggcggttaagacggaccggtaagcccgttanacg

SEQ ID NO: 40582 - DNA, 757 bp, Homo sapiens
  misc_feature: GYAE6OF01D7T47.29.14.B03.1.454.CMB.1.raw
  modified_base (205)..(205): a, c, t, g, unknown or other
  misc_feature (205)..(205): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgntatatattatgcagacgcctggaagggccgttcacctatttccagagaactaattacgaaagaacacgctagtatactgacaaaagtggagagcctgacgacgtcgacgacgacggccgtactattagttcgtaggttaaaggcgagtacgtaggtaaacggtaccggggacccgggtacccggaacgtttcggaacccgtaacgggttcggggaacccggaacggggaaccgtcggttacgggtcccgaaccggttccctaccgttaccgaccgtaccccgttaacccgaacccggtaaaccgggcccctaacggttccccgggttccccctttccccccggtacgggacccctaccccccttacccgtaacccgtaaacggacctaccgtaacccgtcgggttacggggaccaacggacgaccgtaccgcccgggtacgggtcgtccgtaccggtacggtaccgaaacggttacctaaccttaccgtaacgttaccgtcttaacgtcgaggtaccggccgggtacggtggaacgtacggccgtacgtaag

SEQ ID NO: 40583 - DNA, 853 bp, Homo sapiens
  misc_feature: GYAE6OF01E380S.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctggggtacggccgggggggtcgctgagactctcctgtgcggcctctggattaaagttttaggagtcatgccatgaactgggccgcaggctccgaggggaagggctgggagtgggtctcggctagttagtggcaggtgggtggcgctattatattatgcagaccgccctaggaacggggtcccggttacaccctatttacccaagtacgaactaaacgttcggaaaagtaaccaacgtcgtagttaactccgttagaaccgtaaaagtggggaaccgacgaccgttaggaaccgtaacccgtcgggaaacccggaaccgaccgggtcccggttaacttaaggtttttacgttacgggttaaacggtttaaaacggggccgtaaagggtcggttaacggggtaaaccgggtaacccggggggtaaccccgggggacccccggttaccggttaccgggtaacccgtaaccggtcggggggacccggtaacggggggaccgtccggttacggggtaccctacccggtccgtccctaccgaccggtcccctacccgaaacccggaaccgggtaccccgtaacgttccccggtttacccgttccccccgtacggtacccctacccctacccgtaacccgaaccgggtccgtacccgtaacccggttccgggtaccggggggtacccaaccggtaccggaccggtacccggccccggtgggtcccgttacccggg

SEQ ID NO: 40584 - DNA, 780 bp, Homo sapiens
  misc_feature: GYAE6OF01DNHO8.29.14.B03.1.454.CMB.1.raw
tcagatagagtactcacgaccggtgctcgatttagtgtgagtagtttgggtttagggggacggcctgggtacggccgggggggtcgctcgagacctcgtccttgtgcggtcctctggattaagttttaggagtcatgccatgaactgggtccgccgaggctccgagggaaggggctggtagttggttcgtcggcttattaagtggcagtggtggcgctatatattagtgcagacggccgtgaaggtccgtcacctagtttccagagactaacttcgaagacacgctgtatcgtgactaatggagtagcctgagtactacgacggaccgacggccgttctagttagttggtaggttaaaggccggtaggtcctagggaaagtaccggggacccggggccgtaggtttacggccgtacggtacggggaccgacggggtaccgcgtttacgggtaccctaacccggtccgccgttaccggacgtaccccttacccgtaaccgtaaccgggaccccgtaacgtacccggttaccccgtttaccccccgtacggtaccccgtaaccccgttacccgtacctaaccggtaccgtaccgtacccgtacggtacgggggaccaaccgacggaccgacggtaccccggtcgggtaccgtaccggtccgtacgggttaccgtaacggtaccgttaaccgtttaccgtacgtttaacgtaccgttacgttcggtaggtacggccgggtaccgttacgggaccgggtaacgggaccgtagacgtagtcgacg

SEQ ID NO: 40585 - DNA, 755 bp, Homo sapiens
  misc_feature: GYAE6OF01D95VM.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctggaagggccggttcaccatttccagagaccaattcgaaagtacacgctgtaactctgacaaagtggagacgccgtagacgacctacgtacgacgtaccgggtaccgttacttagtttagttggtacggttaaaggtacggacgtcgtacgggtaaacggtaccggggacccggggaccccgtaacgttcggaacccgtacggtacgggggacccgtaaggggggtaccgtaccggtcgggtacccgtaacccggtccttaccccgtcaaccggtccccttacccgaacccggtaaccggggacccctacgttacccggttcccccgttcccccgtaccgggtacccctacccccgttccccgttaacccgaacggtaccgacccgtaacccgttcggtacgggggaccacgtaaccgccgaaccggtccgtcgggcctcgaccgtccggtaccaacggtactacctccgtaacgtaccgtacttacgtcacggtcgtaccgggtcgtacggacgaacggcgcgtaacg

SEQ ID NO: 40586 - DNA, 766 bp, Homo sapiens
  misc_feature: GYAE6OF01B8LRX.29.14.B03.1.454.CMB.1.raw
  modified_base (128)..(128): a, c, t, g, unknown or other
  misc_feature (128)..(128): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (371)..(371): a, c, t, g, unknown or other
  misc_feature (371)..(371): n is a, c, g, or t
  modified_base (441)..(441): a, c, t, g, unknown or other
  misc_feature (441)..(441): n is a, c, g, or t
tcagatagagtactcacgaccggtgctcgatttagtgtgagtagtttggtggagtcgtgggggcgcctgggtacgggccggggggtcgctgagactctcctgtgcggcctctggattaagttttaggngtcatgccatgaacgtgggtccgccagggctccgaggggaagggctggaggtgggtctcggctattagtggcaggtggtggcgcgtatatattatgacacgaccgcccgtaggaacgggtcccggttcacctatttccagagactaagttacgaaanaacncgctagtatcgtgaacgaagtggacgacgctagacgcacgacgacgacggtccgtattaagtttgttagtagtaaggcgagnggtaggaacggtaccggggcccgggcctaagtccgacgacggtcgggcgacgggacgtcgtcgggtaccnccgtcctccgtccgacgtcccctaacccgaacccgaccgggtaccctaccggttccccggttccccgtttaccccggtaccggacccccttacccccgtacccgttaacccgaaacggcccggtaaccctacccgggttcggggtacccggggaaccctaacccggaacggtacccgaaccggttcccccgggtacgggttccgttaaccgtccgggttaacggtaccgtaaccggtacctttacccggttacgtaaccgtaccgtttacgtaacgttccgttacgggacggtcggttaccggtaggaccgaccgtgtacgtagg

SEQ ID NO: 40587 - DNA, 736 bp, Homo sapiens
  misc_feature: GYAE6OF01A0ZTI.29.14.B03.1.454.CMB.1.raw
  modified_base (593)..(593): a, c, t, g, unknown or other
  misc_feature (593)..(593): n is a, c, g, or t
tcagatagagtactcacgaccggtgctcgatttagtgtgagtagtttggtggagtctgggggcgcctggggtacgggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagacgcctaggaacgggtccgttcacctattccagacgaacattacgaagaacacgctgtactctagacaaaagtggacgagcctaggacgacctcggaaccgacgaaccgggtccttacttaattacttggtaacggtaaggtacgacgacgtacggtaacggtaacgggtaccccggggccggtacccgtacggtaccgaccgtacggggcggacgggaacgggtcgtcggtccgaccgtaccgtcctccgacgccgacccgtaacgaaccgggaccgtaccgtaccggttccccttacccgtcccggacctacccctaccctaccgtaaacgaccgaccgtcccgtaccgggttcggacccgggtaanaacccgacggtacccggaccggtcccgggtacggtccgtaccgggtcgtaacgggaaaccgttaccggtaacccttaccgtaccgtacgttacctacgttcggaccggcggttacggcgggtgaacccggacggcggactacg

SEQ ID NO: 40588 - DNA, 612 bp, Homo sapiens
  misc_feature: GYAE6OF01DWYLR.29.14.B03.1.454.CMB.1.raw
  modified_base (418)..(418): a, c, t, g, unknown or other
  misc_feature (418)..(418): n is a, c, g, or t
tcagatagagtactcacgaccggtgctcgatttagtgtgagtagtttggtggagtctgggggcgcctgggtacggccgggggggtcgctgagactctcctgtgcggcctctggattaagtttttaggagtcatgccatgaactgggtccgccaggctccaggggaaggggctggagtgggtctcggctattagtggcagtggtggcgctatatattatgcagacgccctggaagggccggttcaccatttccagagacaattcgaagaacacgctgtatctgacaaagtggagagcctgagactcgacgacacggccgtactattattgtagtaaggcgagcgtaggaacgtacggggacccggggcccacgttgacccgacgtggggccgaggggacgcgtggtcacccgtctcccncacgtcctaccaccgaacgggccctacgtcggttccccgttccccgtcgggccctacccctccctacccgaacgacgcctacccgtcggtcggggcacgcgcgacgcccgtggcctcgccgtcggtacgaacggtctaccgtcctagtcctactacgtcacggtggaccgggtcgtacggacgacggcgcgtag

SEQ ID NO: 40589 - DNA, 715 bp, Homo sapiens
  misc_feature: GYAE6OF01BNTFV.29.14.B03.1.454.CMB.1.raw
  modified_base (305)..(305): a, c, t, g, unknown or other
  misc_feature (305)..(305): n is a, c, g, or t
tcagatagagtactcacgaccggtgctcgatttagtgtgagtagtttgggggcgcctgggtacggccggggggtcgctgagactctcctgtgcggcctctggatttaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtntattattgtagttaaaggcgagctaggaacgtacggggacccgggcccaagttcggaccacggtcggggaccagggggacgcgtggtaccacccggttctccctcgacgtcccctaccaacccgaacggtccccgacgttcccgggttcccttaccccccgtcgacccctaccccttaccctacccgtaaacgaccgccctaacccgttccggtacggggggaccaaccggacccggcgaacccgggtccccggttcggggcccgttacggtaccccggttccggtaaccggtaaaccggtacccgtttaaccttaccccgtaaagttaccgttaccttaccgttcgttacgggaccggtccggggacgtacgggtaaccggaacgggtccggactaaggtacgcgagcg

SEQ ID NO: 40590 - DNA, 809 bp, Homo sapiens
  misc_feature: GYAE6OF01A41FP.29.14.B03.1.454.CMB.1.raw
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagaccgccctggaacgggcccggttcacctatttccagagacaattcgaagaacacgctgtatctgacaaagtgganagcctganactcgacgacacggccgtctattattgtagttaaaggcgagtcgtaggaacgtaccgggggacccggggtaccctacgttcggaacccgtacggtacgggggaccccgaaggggggacccgtccggttcgggtacccgtaccccggtttcctccccgtaccgaaccggtacccccttacccgaaacccggaaccggggtcccccttaacggtttccccgggtttaccccctttcccccccgggtaggaccccccttaaccccccgttcccgtaacccgaaacggacccgtccccgtaacccgttccgggtacgggggacccctacgacggtcccgaaccggtccccggtagggcccttacggaccgttacggtcgggttaaccgaaaccgggttacccttaacccggtttacccgtaacgtttacccgttaccttaaccggttcgttaccgggaccgggtcccggggaccgttacggggacccggtaacgggtcccaaggttaacgtggccgtag

SEQ ID NO: 40591 - DNA, 932 bp, Homo sapiens
  misc_feature: GYAE6OF01CCHGU.29.14.B03.1.454.CMB.1.raw
  modified_base (249)..(249): a, c, t, g, unknown or other
  misc_feature (249)..(249): n is a, c, g, or t
tcagatagagtactcacgaccggtgctcgatttagtgtgagtagtttggtggagtcgtgggggcgccgtgggtacggccggggggtcgctgagactctcctgtgcggcctcgtggatttaaggttttaggagtcagtgccatgaacgtgggtcccgcaggcctccgaggggaacggggtctgggaggttgggtcgtcggcttagttaggtggcgtaggtgggtcggccgtcttaattattagtttacgngcaacggaccgcccgtagggaaccggggtcccggtttaccaaccttactttaccgaaggacgtaaaccgtaactttacggaaaacgaaccgtacgtccgttaaggttaaccttcgtaacggaacgtaaaaaggtcgggaaagaccgtaccgtaaggaaccgtaccggtaccggaaacccggaccgtaaccgggttcccgtttaatttaacgttttaagttttcggtttaaaggttaaacgggaccgaaggttccggtttaaggggaaaaccgggtaaccccggggggtacccggggtaccccgttaacggtttaccggaaacccgggtacggggttaccggggtaccggggaaacggggtccgtaccggttcggggtacccgttaccccggttcttccccgtacgacccgtaccccctaacccggaaccggtaaccgggtaccccttacggttccccggttaccccgttccccccgtcggtacccctccccttacccgaaccgtaaccggacccgtaccgacccggttcgggaccgggaaccacgggccgaaccggcccgtacccggtcggtccgttccggtccgtaccggtaacgaaccgtccttacccgtacgtaccgttccttacgtccgtcgttacgggaccggttacggtccgtaggacccggaggcccgtagtacgg

SEQ ID NO: 40592 - DNA, 731 bp, Homo sapiens
  misc_feature: GYAE6OF01B9WMH.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagaccgccctggaacgggtcccggttcaccatttccagagacaattacgaagaacacgctgtatctagactaaagtggagacgcctaggagacctccgacgaccgaccggccttctaacttagttgttaggttaaaggcgaggcgtaggaaacggtaccggggacccggggacccgtacgttacgaacccgtacggtcggggaccgacgggggaccgcggttcgggtccctacccgtccgttccccgtacgaccgtccctacccgaccgaaccgggtaccctaacgttccccgggtaccccgttcccccccgtcggtccccctacccccttaccctacccgaacgaccgtacccgacccgtaccggtacggggccctaacgacggacccgaccggtcccgtcgggaccggttcgaccgttacggtacgtaaacggccttaccgttaccgtacgtaccgttcttaactcgtacggacggtccgggtcgtacggtaccgaacgggcctcgtacg

SEQ ID NO: 40593 - DNA, 819 bp, Homo sapiens
  misc_feature: GYAE6OF01DN0BB.29.14.B03.1.454.CMB.1.raw
  modified_base (151)..(151): a, c, t, g, unknown or other
  misc_feature (151)..(151): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (377)..(377): a, c, t, g, unknown or other
  misc_feature (377)..(377): n is a, c, g, or t
tcagatagagtactcacgaccggtgctcgatttagtgtgagtagtttgggctgagctggctttttcttgtggctattttaaaaggtgtccagtgtgacgtgcagttggtggagtcgtgggggccgccgtggggtacgggccgggggggtcnctgagactctcctgtgcgcctctggattaagtttagagtcatgccatgaacgtcgggtccgccaggctaccgaggggaagggctggagtgggtctcggntagttagtgctaggtggtggcncttaatattattatgcgagaccgcccgtaggaacgggtccgttacacctacttccagacgacaagttcgaaagacacgctagtatcgtagacaagtaggacgacnccgtagacgaacgtcgaaccgacgtaacccggtccgtacttaattagtttaggttaaggttaaaacggcggtaacggtacggttacgggtaaaccgggtaacccgggggaacccgggggtacccccggtaacgtttacggaacccgtaaccggtacggggaccggtacgggggaaccggtccggtacgggtacccgtaccccggttccgttacccgtctaaccggtccccgttacccgaaccccggtaaccggggtaccccgtaccggttacccccggtttccccgttcccccccgtttacgggaccccccttacccccgttaccccgttacccgtaaacccggtaacggtaccccgtaccccggtccgggttaccgggggacccgtaacccgggtaccggacccgaaccgggtccccggttacgggcccggttaccccggg

SEQ ID NO: 40594 - DNA, 1008 bp, Homo sapiens
  misc_feature: GYAE6OF01CCCWE.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtcgtgggggcgccctggggtacgggccggggggggtcgctgagactctcctgtgcggcctctggattaagttttaggagtcatgccatgaactgggtccgccaggctccgaggggaaggggcgtgggaggtgggtctcggcttagttaggtggcgtaggtgggtcggcgactatattattatgacacgaccgcccgtaggaacgggtccggttacacctactttcccagacgactaagttacggaaagaaaccacggtctaggttaactctacggacaaaaggtgggaagacgtaccgtaggaacggacccgtacccgggaaaccggaacccgtacccggggtacccctttacgtttaagttttaagtttacgggtttaaggttaaaaccgggtcggtaacgggttaccggtaagggggtaaacccgggttaaaccccgggggggggtaacccccccgggggggtaccccgttaacccgggttttaccggaaacccccgggtaaccggggttaccgggggggaaccccggggttaaccgggggggaacccgtccccgggttaccggggttacccccgtaaccccggttttccccgttaccccccgttaccgggtaacccgtaccccccccttacccggaaaaccccccgggaaacccgggggtcccccgttaaccccgggtttccccgggtttaccccccgttttaccccccccgggccccgggttacccccgtaccccccccggtttaccccctaaccccggtaaacccggtacccggtacccccggttaaccccggtcccgggggttacccggggggacccctaaaccccggaccggggtaccccgaccccgggtcccccccgggttaggggggtcccccgttaccccggggg

SEQ ID NO: 40595 - DNA, 604 bp, Homo sapiens
  misc_feature: GYAE6OF01DUOOD.29.14.B03.1.454.CMB.1.raw
  modified_base (578)..(578): a, c, t, g, unknown or other
  misc_feature (578)..(578): n is a, c, g, or t
  modified_base (599)..(599): a, c, t, g, unknown or other
  misc_feature (599)..(599): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctggaacgggtccggttcacctatttccagacgacaattcgaagaacacgctgtatctgacaaaagtggagagcctagagactcgaacgacacggccgttctattattgtagttaaggcgagcgtaggaacgtaccggggacccgggacccgtacttcgaccgacggtcggggaccgaggggaccgcgtcggtccacccgtctccctcaccgcctccaaccgacggccctacgtccggttcccttccccgcggccctaccctccctaccaacgacgcccgaccgtcggtcgggcacgacgccacgcccgtggcctcgccgtgacgaacgtctaccgttcacgtactctatcgnggcgcggtcgtacggagacgngctag

SEQ ID NO: 40596 - DNA, 823 bp, Homo sapiens
  misc_feature: GYAE6OF01EV262.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaacgtgggtccgccaggctccgagggaaggggctggagtgggtctcggctattagtggcagtggtggcgctatatattatgcagaccgccctggaacgggtccgttcacctatttccagagactaagttcgaaagaacacgtctagtattctgactaaaagtggaagacgaccgtagacgactcggaacgaccgaccggtaccgtacttatttattcggtaggtttaaaacgggcgacggacccgggaaagtacccggggggacccgggggaccccgtacgttaccggaaccccgtaaccgggtggggggacccggtaagggggggaccgtccggtacgggtacccaccccggttccttaccccgtccggaacgtcccccgtaacccggaacccgaaacccggggtcccctacggttaccgggtttaccccccgtttaccccccgtccgggtacccctacccccttaccccgtaccccgtaacggacccgtcccaaccccggttcgggtaccggggggtccaacgtaccggacccgacccggtccccggtacggggtcccttccggcccggttaccgggtaccgtaaaccgggtacctttacccggttacctaaccgttcccgttaacctacgttcgcggtacgggtccgggtccgtacgggacggtaacggcccgtagtagacg

SEQ ID NO: 40597 - DNA, 631 bp, Homo sapiens
  misc_feature: GYAE6OF01AYNKN.29.14.B03.1.454.CMB.1.raw
  modified_base (627)..(627): a, c, t, g, unknown or other
  misc_feature (627)..(627): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacgttcgaccacgtggggccgaggggacgcgtggtcaccgtctcctcacgccctccaccgacgggcccacgtccggttcccttccccccgtcggtcccaccccctcctacccaacgacgacccaccctcggtcggggacaccgagccaccgtcccgcgggtccgtcggcccgttcggtaccgaacgggtaccttaccttacccgtaacgttaccttctaccgttcgtcggtacggaccggggtcgtacgggaccgaacgggtcccgcgtaagtacgcngtcg

SEQ ID NO: 40598 - DNA, 918 bp, Homo sapiens
  misc_feature: GYAE6OF01CKTMZ.29.14.B03.1.454.CMB.1.raw
  modified_base (262)..(262): a, c, t, g, unknown or other
  misc_feature (262)..(262): n is a, c, g, or t
tcagatagagtactcacgaccggtgctcgatttagtgtgagtagtttggtggagtcgtgggggcgccgtggggtacgggccgggggggtcgctgagactctcctgtgcggcctctaggtaatttaaggttttaggagtcatcgcatagaacgtcgggtccgccgaggtcctccggaaggggaaggggcgtagggtaggtcgggtcgtacggtacttagttacgtcggagaggttcgggaggcgtacttaattattatttagngacgacgaccgccgtaaggaacgggttccggtacctaacctacgtttaccgaagtaacgtaactaacgtaacgaaacgtaaccacgtacgttagtactacgtagaaacgtaaagtaggaacgacgtacgtagaacgacgtaccggaacgacgtaccggtactaactttaatttacgttaggtaaacggtaacgacgaagtcggtaacggaacgggtaccggggaccggtaccgtacgtacgaaccggacgggtacgggacggtacggaccgtacggtacgtaccgtaccgttaccgtacgacccgtacggtaccctaaccgaaccgggccggtaaccccgttcggttacccccggtccccctttaccggacccggaacccttaccccgttaaccgaccgggaaactccccgtaaacggtcccccgttaagggggaccgggaaaccctaacggtccgggaaacccggtccggttaccccgggtacggggttacctcccggtaaccggttaacggtaacccgggtaacctttaaccccttacccggtttaaacgaacccggtttaaccttaacgttccccgtaaagggttcccccggggaaagttaccccggggaccggtttaaacggaaccccgggttaacggacggtaaactcggg

SEQ ID NO: 40599 - DNA, 774 bp, Homo sapiens
  misc_feature: GYAE6OF01BILQ1.29.14.B03.1.454.CMB.1.raw
  modified_base (487)..(487): a, c, t, g, unknown or other
  misc_feature (487)..(487): n is a, c, g, or t
tcagatagagtactcacgaccggtgctcgatttagtgtgagtagtttggtgggaggtcgtgggggcgcctgggtacggccggggggtcgctgagactctcctgtgcggcctctggattaagttttaggagtcatgccatgaactgggtccgccaggcttccgagggagggctggagtgggtctcggctattagtgcagtggtggcgctagtatattatgcagacgccctaggaacgggtccggttacaccgtacttttccgaaggactactaatttacgaaagtaaccgacgcgttaggtactcgtagacaagttaggagtacgctagacgaccgttacggaaccggaccgaccggtccgttaccgtaagtttacgttaggtaaggttaaacggcgacgtcgtaggtaacgtacgggacccggggccgtacgttcgaaccgtcggtcggggccgaaggggacgtacggtcgggtacctaccggtccnccgtcgacgtccctacccgaacccggtaacggaccctacgttccggttaccccgttaccccgtcggaccctacccgtccctaaccgaacgaccgtaccgtaccgttccggtaccggggccaacggtaccgaccgtaccgggtacccgttcgggtccttaccggtaccggttcggtaacggtaccggtaaacctttacccgtaccggtaacggttaccgttaacttacccggtcgtacgggtacggacgggtccgttacgggaccgttaaccggggcgtacgaaccgg

SEQ ID NO: 40600 - DNA, 815 bp, Homo sapiens
  misc_feature: GYAE6OF01BIV2J.29.14.B03.1.454.CMB.1.raw
  modified_base (193)..(193): a, c, t, g, unknown or other
  misc_feature (193)..(193): n is a, c, g, or t
  modified_base (807)..(807): a, c, t, g, unknown or other
  misc_feature (807)..(807): n is a, c, g, or t
tcagatagagtactcacgaccggtgctcgatttagtgtgagtagtttgggggcgcctgggtacggccggggggtcgctgagactctcctgtgcggcctctggattaagtttaggagtcatgcatgaactggtccgcaggctccgagggaagggctggagtgggtctcggtctagttagtggcagtggtgcgtntatagtattagtgacagacgcctggaacgggccgttacacctatttccgagagaactaagttcgaaagaactacggctagtaactctgataaagtggagtacgctagaacgactacgaacggactacggtaccgttacttacgtttaagtttaggtaaggttaaaacggtcgtaacggtcgtaacgggtaaaccgtaccggggaccccggggtccgtaaacggttacgaaccggaacggtacgggaacccgaagggggtaaccgcgtttcgggaccgtaaccgggtttctaccccgtagtaaccgtccccgaacccgtaaacccggtaaacgggcccccaaacgtttcccggtacccctttcccccgtacgggacccctacccccttaaccgttaaccggtaaacgaccggtacctaacccgttcgggtcgggggaacctaacgacgggtaacccaccgggtaccccggttgggaccggttccggtaccccggtttaggaaccggttaaaccgggtaacctttaaccgttaccgtaacgtttaactacggttaacctacgtacggtcgggtaaccgggcgttaccgggaacgtacgggtacccggatggtaacngtatacgg

SEQ ID NO: 40601 - DNA, 877 bp, Homo sapiens
  misc_feature: GYAE6OF01CR0ZQ.29.14.B03.1.454.CMB.1.raw
  modified_base (214)..(214): a, c, t, g, unknown or other
  misc_feature (214)..(214): n is a, c, g, or t
tcagatagagtactcacgaccggtgctcgatttagtgtgagtagtttggtggagtcgtgggggcgcctgggtacgggccgggggggtcgctgagactctcctgtgcggcctctggattaagttttaggagtcatgccatgaacgtgggtccgccaggcctccgaaggggaaggggcgtggtaggtgggtctcggtctagttagtggcaggtggnggcgtactatattagttatgcagaccgcccgtagggaacggggtccggtacctacctactttccgaagacgaactaacgttacgaaagaaccgacgtaccgttgttaactccgtagtaacgaaaagtgggacgtacgtaccgagagtaccgtccggaacgacgtaccggtccgtactttaagttaggtttacggttaaggttaaacggacgacggtacgtacgggtaaacgggtaacccgggggtaccggggtaccccgtacggttacgaaccgtaccgggtaccggggaccggaacggggacggtccgtacggtcccgtacccgtcccgtaccgtccgaccgtccccgtaacccgaaacccggtaaccggggccccttacgttaccccgggttcccccttttacccggaccgggtacccccctaacccgtacccgtaacccggaaacgtacccgtaccccgttaacccgggttccgggacggggttaacccaacggaaccggcccggtaacccggtccgtccggggttaccgttcccgtacccgggttaaccggtaacgaaaccgtttcccgttaaaccctccggttaaccttacgtacccgtttacgcccgtaggggtcccgggccgttacgggcccggtaaggaacccgtgggtaactcg

SEQ ID NO: 40602 - DNA, 746 bp, Homo sapiens
  misc_feature: GYAE6OF01EZUOO.29.14.B03.1.454.CMB.1.raw
  modified_base (123)..(123): a, c, t, g, unknown or other
  misc_feature (123)..(123): n is a, c, g, or t
  modified_base (147)..(147): a, c, t, g, unknown or other
  misc_feature (147)..(147): n is a, c, g, or t
  modified_base (286)..(286): a, c, t, g, unknown or other
  misc_feature (286)..(286): n is a, c, g, or t
  modified_base (538)..(538): a, c, t, g, unknown or other
  misc_feature (538)..(538): n is a, c, g, or t
  modified_base (730)..(730): a, c, t, g, unknown or other
  misc_feature (730)..(730): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcncctggggtacggccgggggggtcncgtgagactctcctgtgcggcctcgtggattaagttttaggatcatgccatgaactgggtccgcgaggctaccgaggggaggggctgggagtgggtctcggcttagttaggtggctaggtggtggcgtctatatattancgcagaccgcccgtaggaaccgggtccgttcacctattccaaggagaacaagttacgaaagaacacgtctagtactctagactaaagtggacgacgtcctagaacgtaccgtcggaacgaccgtaccggtaccttacgttaagttttacgtagggtttaaggttaaaacgggccgtagtccggttaagggaaccgggtaaccggggaccgggtaccgtacgttacgaccgacggtccgggacgacggggtcncggtcgtaccgtaccgttcctaccgtccgaccgtcccgtaccgacccggtaaccggccccgtacggttccccgttacccgttcccccgtcggtacccctaccccttcccgaaccgaaccggtaccgtaccccgtaaccccggttcgggaaccggggccccaaggtacccggacccgaccccggttcccgggngggtacccgtcccggg

SEQ ID NO: 40603 - DNA, 769 bp, Homo sapiens
  misc_feature: GYAE6OF01BF6C0.29.14.B03.1.454.CMB.1.raw
  modified_base (306)..(306): a, c, t, g, unknown or other
  misc_feature (306)..(306): n is a, c, g, or t
  modified_base (541)..(541): a, c, t, g, unknown or other
  misc_feature (541)..(541): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccgagggagggctggagtgggtctcggcttattagtgctagtggtggcgctatatattatgcagaccgcctggaacgggtccgttacacctatttccagacgaactaattacgaagaaccacggctgtatcgttagactaaacgtggaagagccgtaganactcggacgaccacggtcctactattacgttgtaagttaaggcgtagtgtacggtaacgtaccgggggtaccgggaccctacgttcgaccgtacggtcgggtaccggaacggggccgtacgtcgggtacctaccccggttccccgtaccgacgtacctaccccgtaaacccgaaccggtacccggtaccgttaccgggttccccctttacccccgtcccggacccgttaaccccncccccgttaccgaaacggtaccgacccgttacccgtaccgggttccggggacaacccgtaacgccgtaaccggtcccgggtcggacgtacgccccggttaacgtccgggtaaccgtaacgttaacccttccggtaacttccgttacttaaccgtccgttacggtacggtacggggtacccggttaggcccgggtaaacgggacctacgggtactttaaggcatccgag

SEQ ID NO: 40604 - DNA, 899 bp, Homo sapiens
  misc_feature: GYAE6OF01CY5XG.29.14.B03.1.454.CMB.1.raw
tcagatagagtactcacgaccggtgctcgatttagtgtgagtagtttggtggagtctgggggcgcctgggtacggccggggggtcgctgagactctcctgtgccggcctctggattaagttttaggagtcatgccatgaacgtcgggtccgccgaggctccgagggaagggctgggaggtgggtctcggacttagttaggtggcgtaggtgggtggccgtcttaatattagttagtgccgaacgaccgcccgtagggaacgggtcccggttacaacctacgtttccgaagacgtaactaacgttacggaagtaacccgacgtacgttagttaacttccgtaacgtaaacgtaaaggtacgggaacgtacgtaccgtaacggaaccgtaaccgtaccggaaccggtaaccggtaccggttacccgtttaacgtttaacgttttaggtttacggtttaaacggttaaacggtaccggtaacggtacggtaaacgggtaaaccgggtaacccgggggtacccgggtacccgtaccggttaccggaacccggtacggggtccggggaccgggtacgggaccgtccggttaccggtacccgtaccgttcccgtaccgtaccgacccgtacccgtacccgaacccggtaacccggtacccttacggttaccccgttacccccgttccccggtacgtacccctaccccgtaacccgtaacgaacggtaccgtcccgtaccggtcgggtacggaccacgtcggaccgtaccggtccggttacggccgttccgtaccggttacggtaaccgttaccgttaccgttaccgttaccgtacgttaccgttaccgtacgttaccgggacggtacggtccggtaacgtacggacggaacggtccgtaacgtag

SEQ ID NO: 40605 - DNA, 738 bp, Homo sapiens
  misc_feature: GYAE6OF01B8D6B.29.14.B03.1.454.CMB.1.raw
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccgagggaaggggctggagtgggtctcggctattagtggcaggtggtggcgctatatattatgcagacncccgtaggaacgggtccgttacacctatttaccagacgactaattacgaagaacacgctgtatctgacaaatgganagcctgagactcgacgacacggcctacttattattggttagtaaggcgagcgtaggaacgtaccggggacccgggccgtacgttcgaacccgtacggtacggggaccgacggggacgcgttacggtacccaccgttccgtcccgtcgaccgacccctacccgaacccggaaccgggtcccctaacggttcccgggttaccccttccccgtacggcccctaccccgtccctaccgaaacggacctaccgtaccctccgggtacggggaccaaccgtcggaccgtccggtacccgtcgggtcctaccggacccggttgggtaacccgtaaaccgggttaccttacccgttacccggaaccgtttaccgtacttaaccggttaccgcgggtaaccgggccggttacggtaccggaaccggtacggtcccgtagtaaacgg

SEQ ID NO: 40606 - DNA, 687 bp, Homo sapiens
  misc_feature: GYAE6OF01BYLVM.29.14.B03.1.454.CMB.1.raw
  modified_base (158)..(158): a, c, t, g, unknown or other
  misc_feature (158)..(158): n is a, c, g, or t
  modified_base (185)..(185): a, c, t, g, unknown or other
  misc_feature (185)..(185): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
  modified_base (686)..(686): a, c, t, g, unknown or other
  misc_feature (686)..(686): n is a, c, g, or t
tcagatagagtactcacgaccggtgctcgatttagtgtgagtagtttggtggagtcgtgggggcgcctgggtacggccgggggggtcgctgagactctcctgtgcggcctcgtggatttaagtttaggagtcatgcatgaacgtgggtccgccaggcncgagggagggcgtggagtggcgtcggntattaggtggcaggtggtgcgntatatattngcagaccnccgtgaggtccgtcacgtattcagagacaagttacgaagaactacncgtgtatcgtcgagaaaaggtggagagccgtagacgacgtacgaacggacaccggccgttactatttagtacggttaggtaaaggcgtagtacgtagggtaacggaccgggggaacccgggtcccggtaacggttacgaccggtaacggtcggggaccgggtaacggggaccggtcggttacggtacccgtaccccggttcctaccgtccgaacccgcccgtacccgaccgaccgggacctacggtcccggtttcccctaccccgtacgggtccctaacccgttcccgaccgaacggcctaccgccgtacggcgggcacgtacgcgtacccgcggcgtcgtcgccgtgtaccgtaggaccttcccgtacgaccgttctctactcgacggcggcggtacgtcgacggacgtcgacgng

SEQ ID NO: 40607 - DNA, 858 bp, Homo sapiens
  misc_feature: GYAE6OF01CSY66.29.14.B03.1.454.CMB.1.raw
  modified_base (110)..(110): a, c, t, g, unknown or other
  misc_feature (110)..(110): n is a, c, g, or t
  modified_base (546)..(546): a, c, t, g, unknown or other
  misc_feature (546)..(546): n is a, c, g, or t
tcagatagagtactcacgaccggtgctcgatttagtgtgagtagtttggtggagtcgtggggcgcctgggtacgggccggggggtcgctgagactctcctgtgcggcctntggattaagtttaggagtcatgccagtagaacgtcgggtccgccgaggcctaccggaaggggaagggcgtgggaggtcgggtcgtcggtcttagttaggtggcgaggttggtcggctctaattagttaattagtgacgacgaccggtccctaggaacgggtcccgttaccaaccgtacgtttaccgaggtaacgaactaacgttacgaaaggtaaacctccgtcgttaagtactcgtacgtaaacgaaaggttggaacggtaacgtccgtaacgaacggttaaccgaccggaacccggaacgtacccggtcgttaacttagttaacgttacggttaaacggtaaacggcgtaaacgtcggtaacgggaaaccgttacccggggacccgggtacctaacgtcgaaacccgtagggtccggggaacgtacgggaccgnggtacggtaccgacccgtcttacccgcgtaccgtacccgaccgaacggacccggtccctaccggtcccgttccccgtaccgcggtaccctacccgttaccgaaccgtacgaaccgtccgtaacccgggtcggtaccggggtaaccacgacccgtaacggtccccgggtaacccgtccggggaaccttccgggtcccggttaacggtaaccgtaaaccggttacttaccccggtacgtaacccgttccttaccgtacggtccggttacgggaccggtccgtacgggttacgaacggtacggtcgacgttacgg

SEQ ID NO: 40608 - DNA, 791 bp, Homo sapiens
  misc_feature: GYAE6OF01ESS5S.29.14.B03.1.454.CMB.1.raw
  modified_base (147)..(147): a, c, t, g, unknown or other
  misc_feature (147)..(147): n is a, c, g, or t
tcagatagagtactcacgaccggtgctcgatttagtgtgagtagttccggcgggggcaggagtcagacccactcaggacacagcatggacatgacgggtccccgctcagctccgtggggctcctgctgctctggcctcccgaggtcnccagtatgtcgacctatccagtactcgaccctagtcctactattccttcccgtggtcctgactagttcgtaggtaggacgacagagtcagctatccgtacgtcggaccggataggtacgagacacgtaacgaatgagaatacgtcgtagtactaaccgaaacgtaacggaaacccgtaacggtaaaccctacccttaaaccgtcgtacgtaaccttactacgtcgtaccgtcgtaccgttacgttaacggtttaacgaacgggttcccggtacctacgtacggtacggttacgacggttcgacgtaggtacgtacgtacgtaggtacctaagtaccgttacttaccaccttaccgaacctaacgtcgtaacccgaagtcccgtacgtaccgcgtaccgtaaccgtacgttaagtacgtttacttttacgtaaacctttaactttacggttaaccttacgtaaccctaaaacgttaccgttttaaactaacccgttaacgttaacccgggtaaggtttacccgggttaaacccggaacccgggaacggttaaaacgggggtaacccttaaaagggggtaacccaaaaccggttaactaacccggggttaacgtcggtaaccgtaccggtcctaaaccccgttacg

SEQ ID NO: 40609 - DNA, 809 bp, Homo sapiens
  misc_feature: GYAE6OF01CY6HZ.29.14.B03.1.454.CMB.1.raw
tcagatagagtactcacgaccggtgctcgatttagtgtgagtagtttgggggcgcctgggtacgggccggggggtcgctgagactctcctgtgcgcctctggatttaaagttttaggagtcatgccatgaacgtgggtccgacaggcctccgaaggggagggctggaggtggtctcggctattaggtggacaggtggtggcgacttatattattagtgcaagaccgccctaggacgggccggtttacaaccctatttaccagaagaactaattacgaaagaaacgaaccgcgtacgtatccgtaagacgtaaaagtagggagaacgtctagaacgtacgtacgacgtaccacggtcctacgtttaattagtttagtagttaaaacgggacgtagtcgttagggaaacgtaacccggggaacccgggtacccgtaacgttaccgaccgtaccggtcgggacccggtaagggggaccgtacgtcgggttacccaacccggtccgttcccgtaccgacgtaccccgtaccgaaccgaaccgggtacccgtacgttacccggtacccgtttacccccggtgtacccaccccttcccgtaacgaaacgcctacccgtaccgtcgggtacgggaccgtaacacggtacaccgggtccgtaacgggcttaccggaccggtacggttaaccgaaacggtacctaccgttaacccgttaacgttaacccgttccgttaagtaccggtaacggaccggtaccgggtccgttaacggggaacggtaaccggtacccggaattacgggaacgagcgtaacg

SEQ ID NO: 40610 - DNA, 762 bp, Homo sapiens
  misc_feature: GYAE6OF01C1NM0.29.14.B03.1.454.CMB.1.raw
  modified_base (208)..(208): a, c, t, g, unknown or other
  misc_feature (208)..(208): n is a, c, g, or t
tcagatagagtactcacgaccggtgctcgatttagtgtgagtagtttggtggagtctgggggcgcctggggtacgggccgggggggtcgctgagactctcctgtgcggcctctggattaagtttttaggagtcatgccatgaactgggtccgccaggcctccgaggggaaggggcgtggagtgggtctcggctattagtggcagtggnggcgctatatattatgcagaccgccctggaacggggtccggttccacctactttaccagacgaactaattacggaagaaccacgactgtatctgacaaagtggaagacgcctagacgacctcggacgaccgaccggccttacttattattgttaaggttaacggcgtagacgtaggaacggtacccggggacccgggacccgtacgttacgaccgacggtcggggaccgtaacggggcgtcgtacgggtccgttacccgtcctcccgtcgacgtccccaccgtaacccgaaccgggaccccgtacgttcccggttccccgttccccggtcggtaccccctaccccgtccccgtaaccgaaacgaccggcctacccggttccgggtaccggggaccaccggtacgaccggtaaccccggtcccgggttcgggaccgttccggtaccgttccggtaacgaaaccgggttacccttaccgttacccgtaacgttacccttacgttaacttcggtgggtaaccggccgggtacgtacgggaccggacgcgtaccgtag

SEQ ID NO: 40611 - DNA, 698 bp, Homo sapiens
  misc_feature: GYAE6OF01AF44D.29.14.B03.1.454.CMB.1.raw
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
  modified_base (418)..(418): a, c, t, g, unknown or other
  misc_feature (418)..(418): n is a, c, g, or t
tcagatagagtactcacgaccggtgctcgatttagtgtgagtagtttcggtggagtctgggggcgcctgggtacggccggggggtcgctgagactctcctgtgcggcctctggattaaggttttaggagtcatcgccatgaactgggtccgccaggctccagggaagggctggagtgggtctcggctattagtggcagtggtggcgctatatattatgcagacgccctgaagggccgttnaccgtatttccgagagacaattcgaagaacncgctgtatcctagacaagtggagagccgtagacgtactccgacggaccaccggccgtctagtttacgttgtagttaaaggcgtagcgttaggaagtaccgggaccgggcccgacgttcgaccgacgtcggggaccgtagggggaccncggtcggtaccacccgttctacccgtcacgtacccctaccgaacccgaacgggcccctaagtccccggttacccttcccccgtcggacccctaaccccgtccctaccgaaacggccacccgtacccgtcggtacggggccaacggcaccgcgcccgtagggccttcgtcccgtgggtacccaaaggtcccgttaaccttcccgtaagttacccgtccgttaatcccggtaagggaccggtccggggtcctacgggtacccgaacgggtccgtaacgtacg

SEQ ID NO: 40612 - DNA, 884 bp, Homo sapiens
  misc_feature: GYAE6OF01E39HV.29.14.B03.1.454.CMB.1.raw
  modified_base (151)..(151): a, c, t, g, unknown or other
  misc_feature (151)..(151): n is a, c, g, or t
  modified_base (217)..(217): a, c, t, g, unknown or other
  misc_feature (217)..(217): n is a, c, g, or t
tcagatagagtactcacgaccggtgctcgatttagtgtgagtagtttgggctgagctggctttttcttgtggctaattttaaaaggtgtccagtgtgacgtgcagttggtggagtcgtgggggcgcctggggtacgggccggggggggtcnctgagactctcctgtgcggcctctggtattaagttttaggagtcatgccatgaacgtggggtcccnccaggcctccgaggggaaggggctggagtggggtcctcggtctagttaggtggcgaggtggtggcgctatatattatcgcacgaccgtcccgtaggaacggggtcccggttcaaccctactttaccaggaacgactaaattcggaaagtaacgaccgctagtactcgtagacaaagtcgggaagtacgcctaggacgaccgtacggaaccgacgtaccgggtcccgttacttaagttttacgttaggttaacgggttaaaacgggccggtaacggtacggttaacggggaaacgggttaaccccgggggggtaaccccggggggtaccccgttaaccgggttaccggaacccggtaaccggggttacgggggaccccgggtaacggggggtaccggtaccggttacgggttaccccgttaacccggttcccgttacccgtacccgacccgtaccccgttaaccccgaaccccggaaaccggggtaccccctacggttaccccggttccccgtttccccccggtccgggtacccctacccccgttaccctaaccccggtaaaccggtacgtaccccgtaccccggttccggggttaccgggggaccctaaaccggtaccgacccgggtaacccggtcccccgggttcgggggtcccgtaccccggggg

SEQ ID NO: 40613 - DNA, 962 bp, Homo sapiens
  misc_feature: GYAE6OF01AOGJB.29.14.B03.1.454.CMB.1.raw
  modified_base (156)..(156): a, c, t, g, unknown or other
  misc_feature (156)..(156): n is a, c, g, or t
tcagatagagtactcacgaccggtgctcgatttagtgtgagtagtttgggctgagctggtctttttcttggtggcttaattttaaaaggtgtccagtgtgacgtgcagttggtggagttcgtgggggccgccgtggggtacgggccgggggggtcnctgagactctcctgtgcggcctcgtggtatttaaggttttaggagtcaatcgccaagtacgaacggttcgggtacccgaccgagggccttaccggaagggggaaggggtcctaggggtaggttcgggggttacctacgggtacctttaagtttaacggttcgggaacctagggtggggttcgggaccgacttttaaataagttttaacgtttaagcggaaccgtaacggaaccggtcccccgttaaggggtaaaaccgggggtcccggtttaacccaaaccggtttaacttttaacccgaaaggtaaaccgttaaaaccgtaaaacggtttaccggaaaaaacggtaaaccccgtaaccgtacgttagggttaaaacttccccgtaaaggggtaaaaccaaaaagggtttccgggaaaagtaaccggtcccggttaaaggaccgtaaacgtaccccggaaaccggtaaccggaaccggttaaccgttactttaaagtttacgtttagggtaaagttaaacggcggtaagtacggtaagggtaaccggtaacccgggggaacccgggtaccgtaaccgttaacccggaccggtaacgggtaccggggccggaacggggtaccgtcgttacggtacccgtccgtacccgttccgtacccgacgtcccctacccgaacccgaaccggggcctaaccgttcccggttacccctcccggtacgaccccctacccttacccgtacgaacgaccgtacgacccgtgggtaaccggccaaccgacgtaccgacgtccgtacgggctaacccggg

SEQ ID NO: 40614 - DNA, 749 bp, Homo sapiens
  misc_feature: GYAE6OF01AY38S.29.14.B03.1.454.CMB.1.raw
  modified_base (746)..(747): a, c, t, g, unknown or other
  misc_feature (746)..(747): n is a, c, g, or t
  modified_base (749)..(749): a, c, t, g, unknown or other
  misc_feature (749)..(749): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgcccgtggaacgggtccggttcacctatttccagacgacaattcgaagaaccacgctgtatctagacaaagtggagacgcgtaggacgaccgtaccggacgaaccgaccggtcccgttacttaagtttagtttggttaaggttaaacggacggtacgtacggttaagggtaaccgggtacccggggaccccggggtacccgtaccgttaccggaacccgtacggtacggggaccggacgggggtaccgtccggttcggtacccgtacccggtccgttacccgtaccgtaccgtccccgtacccgaacccggaaccgggcccgtaccggttcccggttccccgttcccccggtccggtacccctaccccctacccgtaccgaacgaccgacccgtacccgttccgggtacgggtaccaccgacgaccgaccgtcccggtcggtccgtcgtccgtacggtaccgtaaccgtaccttacctacgtactaccgtctacgtacgtcggacggcggtcgtacggacgacggcacgatgnngn

SEQ ID NO: 40615 - DNA, 847 bp, Homo sapiens
  misc_feature: GYAE6OF01BLNB5.29.14.B03.1.454.CMB.1.raw
  modified_base (127)..(127): a, c, t, g, unknown or other
  misc_feature (127)..(127): n is a, c, g, or t
  modified_base (154)..(154): a, c, t, g, unknown or other
  misc_feature (154)..(154): n is a, c, g, or t
  modified_base (176)..(176): a, c, t, g, unknown or other
  misc_feature (176)..(176): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
tcagatagagtactcacgaccggtgctcgatttagtgtgagtagtttgggctgagctggtctttttcttgtggcttaattttaaaaggtgtccagtgtgacgtgcagttggtggagtcgtgggggcnccgtggggtaccgggccgggggggtcnctgagtactctctgtgcgcctntggatttaagtttggatcatcgcatagacgtcggccgcaggctcgagggagggctggagtggtctcgtnttagttacggngacaggtggtggctatatatatttagngtcagtaccgccgttaggaacgggtccggttacaacgttactttccgaaggtaacgtaacttaacgttaccggaaaagtaaacccgcgaccgtttaggtacttacgtacgaacgttaaaaaggtcggggaataccggaccggttaagaacgttaccgacgggaaaccggtacccaaccggggttcccttaattaagtttaacggtttaggttaaagggttaaacggacgaacggttacggttaacggaacgggttaacccgggtaacgggttacccggggacccgttaaccggttaccggaacccgggttaccggtaccgggggacccggtacggggaaccggtccggttacgggtaccccgtaccgttaccgtaccccgtcgacccgtacccgtacccgtaaccggaaccggtccccgtacgttcccggtcccgtttacccccggccgttaccccgttaccccgtaccgttaacccgaacccgggtacgacccgtacccgttaccgggtacccggggactaacccggacgtaccccgggtacggtccccgtacggggtcccgg

SEQ ID NO: 40616 - DNA, 913 bp, Homo sapiens
  misc_feature: GYAE6OF01DM6GB.29.14.B03.1.454.CMB.1.raw
tcagatagagtactcacgaccggtgctcgatttagtgtgagtagtttgggctgagctggtctttttcttgtggcttaattttaaaaggtgtccagtgtgacgtgctagttggtggagtcgtcggggggcgcccggtggggtaccggggccgggggggtcgctggacgcctctccgtgtcggccggtcctcgtggtaagtttaaggttttagggatcatcgcaagtacgaacgtcgggtccgcgacggccgtaccggaggggtaggggcgtgggacggtggggttctcggagtttaagtggtgcgtaggttgggcgggccgtattaatagtttacttagcgaccgacggaccccggtcccgtaaggggaacggggttccccgttactaacccgtagtttaccggaaacggtaataaactaaaacgtttaccggaaaaacgaacccgtacgtaccgtttacgtaaactcccgttaaaagggaaccgttaaacgggtagggaaccggacccttaaccggacggaaacgtaccccggtaacggaacccgaacggtttaccccccggtgttaaactttaaaggttttacgttagggtaaacggggtaaacggcgtacggtagggtaaccggtaaccgggtacccgggggtacccggggttaccctacggtacccgtacccgggtacggggtccggggaacggtccggggacttcccggtacggtcccgtacccgttccaccgtcccgacccgtccctaacccgacccggtaaccggtccccgttacccgtccggttaccccccgttacccccggctacccccggtcccccttaccgaacccgaacggtccgaccccttccggtccggggaaccgggacccaacggcacccggtaccgcccggggtagtcccgtccggg

SEQ ID NO: 40617 - DNA, 191 bp, Homo sapiens
  misc_feature: GYAE6OF02I3V0O.29.14.B03.1.454.CMB.1.raw
  modified_base (190)..(191): a, c, t, g, unknown or other
  misc_feature (190)..(191): n is a, c, g, or t
tcagatagagtactcacgaccggtgctcgatttagtgtgagtagttccgcgggtcagcctccaccaagggcccatcggtcttcccctggcaccctcctccaagagcacctctggggcacagcggccctgggctgcctggtcaaggactacttccagtactctatctgagcgggctggcaaggcgcatagnn

SEQ ID NO: 40618 - DNA, 568 bp, Homo sapiens
  misc_feature: GYAE6OF02I1HVZ.29.14.B03.1.454.CMB.1.raw
  modified_base (349)..(349): a, c, t, g, unknown or other
  misc_feature (349)..(349): n is a, c, g, or t
  modified_base (506)..(506): a, c, t, g, unknown or other
  misc_feature (506)..(506): n is a, c, g, or t
tcagatagagtactcacgaccggtgctcgatttagtgtgagtagtttgggctgagcgtggcgttttcttaggtggctattttaaaaggtgtccagtgtgacgtgcagttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggccgtctattattgtgttaaaggcgagctggaatacgggaccggggcccgacgttgaccacgtcggggccaggggacgcgtggtcaccgtctcctcacgcctccaccaacggcccactcgtccttcccctcggccncccgtcctccaacgacgccacctacgtcgggggcacgacgaccacgccccgtgggcctccgg

SEQ ID NO: 40619 - DNA, 521 bp, Homo sapiens
  misc_feature: GYAE6OF02GAW0M.29.14.B03.1.454.CMB.1.raw
  modified_base (492)..(492): a, c, t, g, unknown or other
  misc_feature (492)..(492): n is a, c, g, or t
  modified_base (521)..(521): a, c, t, g, unknown or other
  misc_feature (521)..(521): n is a, c, g, or t
tcagatagagtactcacgaccggtgctcgatttagtgtgagtagtttggggcgcctgggtacggccggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggctggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaagggcccatcggtcttccccctggccaccctcctccaagagcacctctggggcacagcagccctgggctgcctggtcaaggactactccagtacnctatctgagcggctggcaaggcgcatagn

SEQ ID NO: 40620 - DNA, 575 bp, Homo sapiens
  misc_feature: GYAE6OF02II1O4.29.14.B03.1.454.CMB.1.raw
tcagatagagtactcacgaccggtgctcgatttagtgtgagtagtttgggctgagcgtgcgttttcttaggtggctaattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggagtacgggaccggggccgacgttgaccacgtgggccgaggggacgcgtggtcaccgtctcctcacgcctccaccgaacgggcccacgtccggtccttccccctcggccaccctccctaccaacgacgccacccgtccgtcggggcacgacgccgacgcccgtcgggctcgg

SEQ ID NO: 40621 - DNA, 560 bp, Homo sapiens
  misc_feature: GYAE6OF02IH6J4.29.14.B03.1.454.CMB.1.raw
  modified_base (60)..(60): a, c, t, g, unknown or other
  misc_feature (60)..(60): n is a, c, g, or t
  modified_base (70)..(70): a, c, t, g, unknown or other
  misc_feature (70)..(70): n is a, c, g, or t
  modified_base (145)..(145): a, c, t, g, unknown or other
  misc_feature (145)..(145): n is a, c, g, or t
  modified_base (379)..(379): a, c, t, g, unknown or other
  misc_feature (379)..(379): n is a, c, g, or t
tcagatagagtactcacgaccggtgctcgatttagtgtgagtagtttgggctgagcgtgngtttctaggnggctattttaaaggtgtccagtgtgacgtgcagttggtggagtctgggggcgcctgggtacggccgggggggtcnctgagactctcctgtgcggcctctggattaagttttaggatcatgccatgaactgggtccgccaggctccaggggaaggggctggagtgggtctcggctattagtggcagtggtggcgctaatatattatgcagcgccctgaagggccgttcaccatttccagagacaattcgaagaacacgctgtatctgcaaatggagagcctgagactcgacgacacggctctattattgngttaaaggcgagctggaagtacgggaccgggcccgacttgaccactggggcaggggacgcgtggtcaccgtctcctcacgccctccgaccaacgggcccacgtccgtccttccccgtggccacccctcctccaacgacgccacctcgtcggggccacgacgccgacgcccgtcgggctcgg

SEQ ID NO: 40622 - DNA, 535 bp, Homo sapiens
  misc_feature: GYAE6OF02HVKP2.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacgctggtcaccgtctcctcagcctccaccaacgggcccatcggtcttcccctcggccaccctcctccaacgagcacctctgggggcacagcagcccgtgggctgcctggtcaaggactacttccagtactctatctgagcggctggcaaggcgcag

SEQ ID NO: 40623 - DNA, 590 bp, Homo sapiens
  misc_feature: GYAE6OF02JI93T.29.14.B03.1.454.CMB.1.raw
  modified_base (285)..(285): a, c, t, g, unknown or other
  misc_feature (285)..(285): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaagtngagagctgagactcgacgacacgccgtctatattgtagtaagacgagacgtagaagtacggaccggggaccgacgtacgaccgacgtgggccgacgggacggcgtcgtcgaccgtcgtcctcacgcctaccaccgaacggacccgacgtcggtccgttccccgtcggccaccctccctaccaacgacgccacctcgtcgggcgacacgcgacgccgtcggtcgtcgccgtcggtacgaacgtacgtaccttaccgtaacgtacctactactacgtacgtacggcggcgtcggacgacggacgacg

SEQ ID NO: 40624 - DNA, 672 bp, Homo sapiens
  misc_feature: GYAE6OF02HY2B1.29.14.B03.1.454.CMB.1.raw
  modified_base (529)..(529): a, c, t, g, unknown or other
  misc_feature (529)..(529): n is a, c, g, or t
  modified_base (669)..(669): a, c, t, g, unknown or other
  misc_feature (669)..(669): n is a, c, g, or t
tcagatagagtactcacgaccggtgctcgatttagtgtgagtagtttaggggttggggcgcctgggtacggccgggggtcgcgtgagactctcctggtgcggcctcgtccgggatttaagttttaggacgttccaggtgccctatgtaaacttgggtccggccacgggcgtccacgggaaagggggcttgggaggtggggtcttccgggactattaggtcggcagtcggtcggccgcttatatattattcgcaggaacggcccctggaaaggggtcccggttaccaacctactttccctaggacggaccaaatttccgaaagaacacgactggtactcttagtactaaagttggagaagcctagaacgacgtcgaacgaccaacggccgtcgtattacttgtggttaaaggtcgacgtcctggaacttacgggaccgggacccgacggttcgacctactagggggtccaggggacgctggtcgacgtctcgtcagcttccacacggccatcgtctcccctgcacctccncaacgagactaccttcgtcggggtacctacgtacgtcgacgaccctagggcttacgaccttcggtcctaacggtacttaccgttccgacggtacctctacgtcgtgaggtcggacgtggacgtaaggcggctacgtacgntcg

SEQ ID NO: 40625 - DNA, 570 bp, Homo sapiens
  misc_feature: GYAE6OF02GO0VE.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacgggaccgggcccgacgttcgaccacgtggggccgaggggacgcgtggtcaccgtctcctcacgcctccaccgaacgggcccacgtccggtccttcccctcggccaccctcctcccaacgcgccaccctccgtcggggccacgacgccgacgcccgtcgggctcgg

SEQ ID NO: 40626 - DNA, 576 bp, Homo sapiens
  misc_feature: GYAE6OF02I8FTE.29.14.B03.1.454.CMB.1.raw
  modified_base (149)..(149): a, c, t, g, unknown or other
  misc_feature (149)..(149): n is a, c, g, or t
  modified_base (255)..(255): a, c, t, g, unknown or other
  misc_feature (255)..(255): n is a, c, g, or t
  modified_base (526)..(526): a, c, t, g, unknown or other
  misc_feature (526)..(526): n is a, c, g, or t
  modified_base (570)..(570): a, c, t, g, unknown or other
  misc_feature (570)..(570): n is a, c, g, or t
tcagatagagtactcacgaccggtgctcgatttagtgtgagtagtttgggctgagcgtgcgttttctaggtggctaattttaaaaggtgtccagtgtgacgtgcagttggtggagtctgggggcgcctgggtacaggccgggggggtcnctgagactctcctgtgcggcctctggatttaagttttaggagtcatgccatgaactgggtccgccaggctccaggggaagggctggagtgggtctcggctattagnggcagtggtggcgctatatattatgcagaccgccctgaagggccggttcaccatttccagagacaattcgaagaacacgctgtatctgcaaagtggagagcctgagactcgacgacacggccgtactattattggtagtttaaaggcgaagctaggaagtacggggaccggggcccgacgttcgaccgacgtcggggccgaaggggacgcgtggtccaccgtctcctcacgcctccaccgaacgggccacgtcggtccttcccctcggccncccgtcctccaacgacgcacctcgtggggcacgagccagcccgnggtccg

SEQ ID NO: 40627 - DNA, 571 bp, Homo sapiens
  misc_feature: GYAE6OF02F60T8.29.14.B03.1.454.CMB.1.raw
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccacacgggcccatcggtcttccccgtcgccaccctcctccaacgacgccacctcgtcggggccacgacgcacgcccgtgggcctcgccgtcggtacaacggaccttacttcccgacgttacctctactctgacggcgggtcgtggaccgaacggccgacgtaacg

SEQ ID NO: 40628 - DNA, 559 bp, Homo sapiens
  misc_feature: GYAE6OF02INF3T.29.14.B03.1.454.CMB.1.raw
  modified_base (556)..(556): a, c, t, g, unknown or other
  misc_feature (556)..(556): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgcgtggtcaccgtctcctcacgcctccaccgaacggcccatccggtcttccccgtcggccaccctccctccaacgacgccacctcgtcggggcacgacgcacgccctgggcctcgccgtcggtacgaacggacctacttccagtacctctatctgagcgggctggcgacggcgnacg

SEQ ID NO: 40629 - DNA, 496 bp, Homo sapiens
  misc_feature: GYAE6OF02HET0F.29.14.B03.1.454.CMB.1.raw
  modified_base (392)..(392): a, c, t, g, unknown or other
  misc_feature (392)..(392): n is a, c, g, or t
tcagatagagtactcacgaccggtgctcgatttagtgtgagtagttccgcgggggcaggagtcagacccactcaggacacagcatggacatgagggtccacgctcagctcctggggctcctgctgctctggctcccaggtgccagatgtgccatccagatgacccagtctccatattccctgtctgcatctgtaggagacagagtcagcatcacttgccgggcaagtcaggacatccgaaatgagataagctggtatcaacagaaaccagggaaacctcctaacctcctgatctatgctgcgtccagttacaaagtgggtcccatcacggttcagcggcagtggatctggcacagatttcactctcaccatcagcagctgcagcctgaagtntttgactaacttattactgtactaacagtattacacttacagtcggtacgttccggacgtaagggaccaaggtagaaatacgaaacgtactcggtggactgacc

SEQ ID NO: 40630 - DNA, 570 bp, Homo sapiens
  misc_feature: GYAE6OF02H6LJO.29.14.B03.1.454.CMB.1.raw
tcagatagagtactcacgaccggtgctcgatttagtgtgagtagtttggtgggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggccgacttcgaccactggggccaggggacgctggtcaccgtctcctcacgcctccaccaacggcccatcggtcttcccctgccacctcctccaacgacgcacctcgtcggggcacgagacacgcccgtcgggcgtcgccgtcggtacaacggactaccgttaccacggtacctccttactctcgaggccgggcgtcggacgaacggccgactacg

SEQ ID NO: 40631 - DNA, 547 bp, Homo sapiens
  misc_feature: GYAE6OF02IQJMY.29.14.B03.1.454.CMB.1.raw
  modified_base (545)..(545): a, c, t, g, unknown or other
  misc_feature (545)..(545): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccactgggggccaggggacgctggtcaccgtctcctcagcctccaccaacgggcccatcggtccttccccctcggccacccctccctccaacgacgccaccctcgtcgggggcacagccacgccctgggctcgcctggtcaagactactccacgtctctatctgagcgggctggcaggcgnag

SEQ ID NO: 40632 - DNA, 597 bp, Homo sapiens
  misc_feature: GYAE6OF02JL6JP.29.14.B03.1.454.CMB.1.raw
  modified_base (593)..(593): a, c, t, g, unknown or other
  misc_feature (593)..(593): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaagtacgggaccgggcccgacttcgaccacgtcggggccagggggacgcgtggtccaccgtctcctcagccctccaccgaacggcccacgtccggtccttccccgtcggccaccctcctaccaacgacgcaccgtcgtcggggaccacgacgcacgcccgtcgggcctcgccgtcggtacgaacggtacctaccttccgacgttacctacctattccgtcggtacgccgggtccgtcggaccgaacggccgacgacgtacggnagcg

SEQ ID NO: 40633 - DNA, 679 bp, Homo sapiens
  misc_feature: GYAE6OF02IYLR7.29.14.B03.1.454.CMB.1.raw
tcagatagagtactcacgaccggtgctcgatttagtgtgagtagtttgggctgagcgtgcgttttcttgtggctaattttaaaaggtgtccagtgtgacgtgcagttggtggagtctgggggcgcctgggtacggccgggggggtcgctgagactctcctgtgcggcctctggatttaagttttaggagtcatgccatgaactgggtccgcaggctccagggaaggggctggagtgggtctcggctattagtggcagtggtggcgctatatattatgcagacgcccctgaacgggccggttcaccatttccagagacaattcgaagaacacgctgtatctgacaaatggagagcctgagactacgacgacacggccgtctatttacttgtagttaaaggcgagcgtggaagtaccggggaccggggacccggacgttacgaccgtacgtcggggaccgacggggacgacgtcgggtacctacccggtcctaccgtcgacgcccgttacccacccgaacgggaccccgtacgtacccgggttccttccccccgtcgggacccctacccccgttccctacccgtaaccggaaccggtcccgtaacccgttcccggtaccggggggtaccctaaccggaccggacccggaccgtacccccgggttaccgggccgttcccggg

SEQ ID NO: 40634 - DNA, 529 bp, Homo sapiens
  misc_feature: GYAE6OF02INP30.29.14.B03.1.454.CMB.1.raw
  modified_base (527)..(527): a, c, t, g, unknown or other
  misc_feature (527)..(527): n is a, c, g, or t
tcagatagagtactcacgaccggtgctcgatttagtgtgagtagtttggtggagtctgggggcgcctgggtacggccgggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggatagcctgagactcgacgacacggccgtctattattgtgttaaaaggcgagctggaatacgggaccgggcccgacttgaccactggggccaggggacgctggtcaccgtctcctcagcctccaccaagggcccatcggtcttccctggcaccctcctccaagacgcacctctggggcacagcacgccctgggctcgcctgtcaagactacttccagtactctatctgagcggctggcaggcgnag

SEQ ID NO: 40635 - DNA, 814 bp, Homo sapiens
  misc_feature: GYAE6OF02FFK5M.29.14.B03.1.454.CMB.1.raw
  modified_base (283)..(283): a, c, t, g, unknown or other
  misc_feature (283)..(283): n is a, c, g, or t
  modified_base (766)..(766): a, c, t, g, unknown or other
  misc_feature (766)..(766): n is a, c, g, or t
  modified_base (805)..(805): a, c, t, g, unknown or other
  misc_feature (805)..(805): n is a, c, g, or t
  modified_base (809)..(809): a, c, t, g, unknown or other
  misc_feature (809)..(809): n is a, c, g, or t
  modified_base (811)..(814): a, c, t, g, unknown or other
  misc_feature (811)..(814): n is a, c, g, or t
tcagatagagtactcacgaccggtgctcgatttagtgtgagtagtttggggcgcctgggtacggccgggggtcgctgagactctcctgtgcggcctctggattaagtttaggagtcatgccatgactggtccgccaggctcgagggagggctggagtgggtctcggctagttaggtggcaggtggtcggctactaatagttattagcgccgacgaccgtcccgtaggaacgggtcccgttacaccttattaccgaaggtaacgaactaacgtcgaaagaaccncgtccgtagtactacgtacgaacgtaaagtggaacgacgtccgttaggaaccgtaccgtaccggaaccggtaccgtaccggttaccgtttagttaaagtttacggttaggttaacgggttaaacggcggtaacggtacggttaacggggaacccggtacccggggtacccgggtacccttaccggttacgaacccggtccgggtaccggggaccggtaaccggggtaccttccggtcccggtaccctacccggtcctaccccgtacccgtaaccgtaccccctaacccggaacccgtaacccgggtcccctaccggtttccccgaccccgtttaccccgacggaccccctacccgtaccgaaccgaacggtcccgaccgtccggtacgggccggaaccaccggcgtccgtacccgggtcgtcggaccgttccgtaaccgtaacggtaaccgaaccgttaccttaccggtactacgtaccctanaccggtcggtaacggccggtcggaacgtcggagtaccgntacngnnnn

SEQ ID NO: 40636 - DNA, 592 bp, Homo sapiens
  misc_feature: GYAE6OF02HJOER.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccacgtggggccaggggacgctgggtcaccgtctcctcagccctccacccaacgggccccactccggtccttcccccgtcggcccacccctccctcccaacgacgccaccctcgtcgggggccacgacgaccacgcccgtcgggccgtcgcccgtggtaccgaacgggtacctaccgttccgacgtaccttacctactctggacggcgggtcgtggacacggcgcacg

SEQ ID NO: 40637 - DNA, 551 bp, Homo sapiens
  misc_feature: GYAE6OF02JA000.29.14.B03.1.454.CMB.1.raw
  modified_base (478)..(478): a, c, t, g, unknown or other
  misc_feature (478)..(478): n is a, c, g, or t
  modified_base (548)..(549): a, c, t, g, unknown or other
  misc_feature (548)..(549): n is a, c, g, or t
  modified_base (551)..(551): a, c, t, g, unknown or other
  misc_feature (551)..(551): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaaggcgagctggaatacgggaccggggcccgacgttgaccacgtggggccagggggacgcgtggtcaccgtctcctcacgcctccaccgaaggcccatccggtcttcccctcggccaccctcctaccaacgacgcacctcgtcggggcacacgcacgccnggctcgccgtgtcgaacggactactcagtactctactcgtgacgcggctcggcaacggcgacgagtacgnngn

SEQ ID NO: 40638 - DNA, 575 bp, Homo sapiens
  misc_feature: GYAE6OF02JEJO5.29.14.B03.1.454.CMB.1.raw
tcagatagagtactcacgaccggtgctcgatttagtgtgagtagtttgggctgagctggcttttcttgtggctattttaaaaggtgtccagtgtgacgtgcagttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctatattgtagttaaaggcagcgtaggaagtacgggaccgggcccgacgtcgaccgacgtcgggccgagggacgcgtcggtcaccgtctcctcacgcctccaccgaacggcccacgtaccggtccgttccccgtcggccaccccgtcctaccaacgacgccaccgtccgtcggggccaccgacgccacgcccgtcgggcctcgg

SEQ ID NO: 40639 - DNA, 551 bp, Homo sapiens
  misc_feature: GYAE6OF02JEGA7.29.14.B03.1.454.CMB.1.raw
  modified_base (313)..(313): a, c, t, g, unknown or other
  misc_feature (313)..(313): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtnttaaaaggcgagctggaatacgggaccgggccgacttgaccacgtgggccaggggacgctggtcaccggtctcctcacgcctccaccaacgggcccagtccggtccttcccctcggccaccctcctaccaacgacgccacctctggggcacgagcacgccctgggctgccgtgtcgaaggcctacgttccagtactctactcgtgaacggcggtcgtcggcaacggcgacagtagnan

SEQ ID NO: 40640 - DNA, 625 bp, Homo sapiens
  misc_feature: GYAE6OF02JUPI8.29.14.B03.1.454.CMB.1.raw
  modified_base (276)..(276): a, c, t, g, unknown or other
  misc_feature (276)..(276): n is a, c, g, or t
  modified_base (377)..(377): a, c, t, g, unknown or other
  misc_feature (377)..(377): n is a, c, g, or t
  modified_base (394)..(394): a, c, t, g, unknown or other
  misc_feature (394)..(394): n is a, c, g, or t
  modified_base (625)..(625): a, c, t, g, unknown or other
  misc_feature (625)..(625): n is a, c, g, or t
tcagatagagtactcacgaccggtgctcgatttagtgtgagtagtttgggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggcctctattattgtagttaaaggcgaagctaggaatacggggaccgggcccgattcggaccactggggcccagggggacnctgggtcaccgtctccncacgcctcccacaacgggcccatccggtcctccccgtggcccacccgtcctacccaacgcgccaccgtccgtcgggggacaccgacgccacggcccgtagggcctcggacctcggggtaccaacgggtaccttaccgttacccgtaacgttacccttaccgttacttcgttcgggaaccggtcggggtccgtacgggtacccgtaacgggccggactacggtacggcacgn

SEQ ID NO: 40641 - DNA, 616 bp, Homo sapiens
  misc_feature: GYAE6OF02JKRY6.29.14.B03.1.454.CMB.1.raw
  modified_base (613)..(613): a, c, t, g, unknown or other
  misc_feature (613)..(613): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggccgacttgaccacgtcgggccaggggacgcgtggtcacccgtctcctcgacgccctcgaccaagggccccagtccggtccttcccccgtacggccacccctcctaccgaacgacgccacccttcgtcggggccaccgacgcacggcccgtgggcctcggtccctggtccgaaacggaccttacgttcccaacggttcctacgttactaccgtcggtaacggccggggtccgtacgggaccgtaaacgggccggacgaacgttacggacngcg

SEQ ID NO: 40642 - DNA, 573 bp, Homo sapiens
  misc_feature: GYAE6OF02HA6T6.29.14.B03.1.454.CMB.1.raw
  modified_base (149)..(149): a, c, t, g, unknown or other
  misc_feature (149)..(149): n is a, c, g, or t
  modified_base (254)..(254): a, c, t, g, unknown or other
  misc_feature (254)..(254): n is a, c, g, or t
tcagatagagtactcacgaccggtgctcgatttagtgtgagtagtttgggctgagcggtgtgtttctaggtcggctaattttaaaaggtgtccagtgtgacgtgcagttggtggagtctgggggcgcctgggtacggccgggggggtcnctgagactctcctgtgcggcctctggattaagttttaggagtcatgccatgaactgggtccgccaggctccagggaaggggctggagtgggtctcggctattagnggcagtggtggcgctatatattatgcagacgccctgaagggccgttcaccatttccagagacaattcgaagaacacgctgtatctgcaaatggagagcctgagtactcgacgacacggtcctctattattgtagttaaaggcgtagctaggaagtacgggaccggggcccgacttcgaccacgtcggggccgaggggacgcgtcggtcaccgtctcctcacgcctccaccgacgggcccacgtccgtccttccccgtcgccaccctcctccaacgacgaccaccgtcgtcggggcaccgacgcacgcccgtcggctcgg

SEQ ID NO: 40643 - DNA, 569 bp, Homo sapiens
  misc_feature: GYAE6OF02FNYM4.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccgggccgacttgaccacgtggggccaggggacgcgtcgggtcaccgtctcctcacgcctccaccaacgggcccagtccggtccttcccctcggccaccctcctaccgaacgacgccacctcgtcgggggccacgagacacgcccgtgggcctcgccgtggtcgaacgacttaccgttccagtactctactcgtgaggcggcgtggcaacggcgctacg

SEQ ID NO: 40644 - DNA, 573 bp, Homo sapiens
  misc_feature: GYAE6OF02I6672.29.14.B03.1.454.CMB.1.raw
  modified_base (348)..(348): a, c, t, g, unknown or other
  misc_feature (348)..(348): n is a, c, g, or t
tcagatagagtactcacgaccggtgctcgatttagtgtgagtagtttgggctgagcgtgcgttttcttagtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggcgtctattattgtgttaaaggcgagctaggaagtacgggaccggggcccgacgtcgaccgacgtcggggccgaggggacgcgtcggtcaccgtctcctcgacgcctccaccgaacggcccacgtccgtccttcccccgtcggcccaccctccctccgaacgcgccaccgtcgtcgggcacgacgccgacgcccgtcggctcgg

SEQ ID NO: 40645 - DNA, 558 bp, Homo sapiens
  misc_feature: GYAE6OF02HOW1X.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccggggggtcgctgagactctcctgtgcggcctctggattaagttttaggagtcatgccatgaactgggtccgccaggctccagggaaggggctgggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttggaccacgtcggggccgaggggacgcgtggtcaccgtctcctcacgcctccaccgaacgggcccagtccggtccttcccctcggccaccctcctccagacgcacctcgtcgggcacgacgccacgcctcgggctcgg

SEQ ID NO: 40646 - DNA, 586 bp, Homo sapiens
  misc_feature: GYAE6OF02JB0NV.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgcaaatggagagcctgagactcgacgacacggcctctattattgtagttaaaggcgagcgtggaagtacgggaccgggcccgacgttgaccgacgtcggggccgacggggacgcgtcggtcaccgtctcctcacgcctccacccgaacggcccacgtccggtccttcccccgtcggcccaccccgtccctacccaacggacgccaccgtccgtcggggacaccgacgccgacggcccgtcgggcgtccgg

SEQ ID NO: 40647 - DNA, 725 bp, Homo sapiens
  misc_feature: GYAE6OF02H9GC5.29.14.B03.1.454.CMB.1.raw
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (546)..(546): a, c, t, g, unknown or other
  misc_feature (546)..(546): n is a, c, g, or t
tcagatagagtactcacgaccggtgctcgatttagtgtgagtagtttggtggagtctggggcggccgtgggtacgggccggggggtcggcgtgagactctcctgtgcggcctctggattaagttttaggagtcatgccatgaactgggtccgccaggctccagggaaggggctggagtgggtctcggctattagtggcaggtggtggcgctatatattatgcagacgccctgaagggccggttcaccatttccagagacaattcgaagacacgctgtatcngcaaaatggagagcctganactcgacgactacggccgtatattatgtagtaaaggcgagtctaggaacgtacgggggacccgggccctaacgttgaacccgtacggtcgggggaccgaaacgggggaccgcgtttcggggacctacccggttcgtccccgttacgaacgtccccctacccgaaacccggtaaaccggggccccaacgtcccggggttcccttcccccgtcgggaccctaccccgtccctaaccaaacggtacccncccgtacccgtcgggcgggaccacgaccggaccgtaccggtcccggtcggtcctcggtccgtacggaaccggtaaaccgttaaccctttacccgttaccgtaacggtaaccttaccgttacttccggtacggccgggtccggggtccgtacgggaaccggaacgggccgtacgtaacgg

SEQ ID NO: 40648 - DNA, 557 bp, Homo sapiens
  misc_feature: GYAE6OF02H878J.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaaggcgagcgtaggaagtacgggaccggggcccgacgttcgacacgtcggggcgaggggacgcgtggtcaccgtctcctcacgcctccaccaacggccactcgtcttcccctcgccaccctccctccaacgcgacacctcgtcggggcacacgcacgcccgtcggctcg

SEQ ID NO: 40649 - DNA, 220 bp, Homo sapiens
  misc_feature: GYAE6OF02HJOMS.29.14.B03.1.454.CMB.1.raw
  modified_base (194)..(200): a, c, t, g, unknown or other
  misc_feature (194)..(200): n is a, c, g, or t
  modified_base (202)..(220): a, c, t, g, unknown or other
  misc_feature (202)..(220): n is a, c, g, or t
tcagatagagtactcacgaccggtgctcgatttagtgtgagtagttccgcgggtcagcctccaccaagggcccatcggtcttcccctggcaccctcctccaagagcacctctgggggcacagcggccctgggctgcctggtcaagggactacttccagtactcgtatctgagcgggtctggcaaggcgcatagnnnnnnngnnnnnnnnnnnnnnnnnnn

SEQ ID NO: 40650 - DNA, 686 bp, Homo sapiens
  misc_feature: GYAE6OF02JOWDX.29.14.B03.1.454.CMB.1.raw
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
tcagatagagtactcacgaccggtgctcgatttagtgtgagtagtttggggcgcctgggtacggccgggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaatacgaagaacacgactagtatctgacaagtaggagagcctgacgacgtacgacgacgaccggaccgtacgttacttagttagttaggttaaggtacggacgacgtacggtaacggtaacgggtacccggggaccccggtaccgtacgtaccgaccgtacgggaccgggacgggacggacgtcggtacgtaccgtaccgtcctccgtacgaccgtacccgacccgaaccggacccgaccgtaccgtcccgttccccgtcccgtccgtaccctaccctacccgtaaccgacgaccgtaccgtaccgtacgggtaccggaccgacgaccgaccgacccgtccggtccgtccgtccgtccggtacgtaacgaccgtaccttaccgtacgtaccgtactacgtcgtacgtacggacggtcgtcggacgacggacgacgacgtacgngn

SEQ ID NO: 40651 - DNA, 633 bp, Homo sapiens
  misc_feature: GYAE6OF02HQNG9.29.14.B03.1.454.CMB.1.raw
  modified_base (433)..(433): a, c, t, g, unknown or other
  misc_feature (433)..(433): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggcccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggccgacttgaccactggggccaggggacgctggtcaccgtctcctcacgcctccaccaagggccccatcggtcttccccnggtccaccccgtcctcccaaacgtacgcctaacccgtcgtcggggggccacacggccacgccccgttggggccttcggacccttgggtaccaaacgggtaccttaaccgtttcccgaacggttaaccttccttaacgttcccgtttacggaacggtccggggtaccttcggggacccgtaaacggggccggacctaacgg

SEQ ID NO: 40652 - DNA, 544 bp, Homo sapiens
  misc_feature: GYAE6OF02IAVSZ.29.14.B03.1.454.CMB.1.raw
  modified_base (60)..(60): a, c, t, g, unknown or other
  misc_feature (60)..(60): n is a, c, g, or t
  modified_base (147)..(147): a, c, t, g, unknown or other
  misc_feature (147)..(147): n is a, c, g, or t
  modified_base (209)..(209): a, c, t, g, unknown or other
  misc_feature (209)..(209): n is a, c, g, or t
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
  modified_base (541)..(541): a, c, t, g, unknown or other
  misc_feature (541)..(541): n is a, c, g, or t
tcagatagagtactcacgaccggtgctcgatttagtgtgagtagtttgggctgagcgtgngtttctaggtggctattttaaaaggtgtccagtgtgacgtgcagttggtggagtctgggggcgcctgggtacggccggggggggtcnctgagactctcctgtgcggcctctggattaagttttaggagtcatgccatgaactgggtccncaggctccagggaaggggctggagtgggtctcggctattagtggcagtggtggcnctatatattatgcagacgcctgaagggccggttcaccatttccagagacaattcgaagaacacgctgtatctgcaaaatgganagcctgagactcgagacacgccgntattaattgtgttaaaggcgagctggaatacgggaccggggcccgacttggaccactggggccaggggacgcgtggtcaccgtctcctcagcctcaccaaggcccancgtcttcccncgtacgcctccctccacgacgcacctcctacgggcggacacgcacgctccggntcg

SEQ ID NO: 40653 - DNA, 565 bp, Homo sapiens
  misc_feature: GYAE6OF02GJKS2.29.14.B03.1.454.CMB.1.raw
  modified_base (560)..(560): a, c, t, g, unknown or other
  misc_feature (560)..(560): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtagttaaagcgagctggaatacggggaccgggcccgacttgaccacgtcggggaccaggggacgcgtggtcaccgtctcctcagcctccaccgaacgggcccagtcggtccttccccgtcggcccaccctccctccaacgacgccaccgtcgtcggggccacgacgcacgccctcgggcctcgcctcggtcaacggacctacttaccagtactctactctcgagcggctggcacggcgngtacg

SEQ ID NO: 40654 - DNA, 563 bp, Homo sapiens
  misc_feature: GYAE6OF02IIYFY.29.14.B03.1.454.CMB.1.raw
  modified_base (560)..(561): a, c, t, g, unknown or other
  misc_feature (560)..(561): n is a, c, g, or t
  modified_base (563)..(563): a, c, t, g, unknown or other
  misc_feature (563)..(563): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacaccggccgtctattattgtgttaaaggcgagctggaatacgggaccggggcccgacgttgaccacgtggggccagggggacgcgtggtcaccgtctcctcacgccctccaccaacgggcccagtccggtccttccccctcggccaccctccctccaacgacgccacctcgtcggggcacagcacgccctgggctcgcctggtcaagtacctacttccgattacctcttactctcggtagcgggtcctggcgaacggcgacagtgnngn

SEQ ID NO: 40655 - DNA, 546 bp, Homo sapiens
  misc_feature: GYAE6OF02HH2Z5.29.14.B03.1.454.CMB.1.raw
  modified_base (544)..(546): a, c, t, g, unknown or other
  misc_feature (544)..(546): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggcccagggggacgctgggtcaccgtctcctcagcctccaccaagggcccatcggtcttccccctggccaccctcctccaacgacgccacctcgtcgggggcacagccacgccctgggcctcgcctggtcgaaggacctacttccagtactctatctgagcgggctcggcgaggcgcatagnnn

SEQ ID NO: 40656 - DNA, 611 bp, Homo sapiens
  misc_feature: GYAE6OF02GO8LB.29.14.B03.1.454.CMB.1.raw
  modified_base (610)..(610): a, c, t, g, unknown or other
  misc_feature (610)..(610): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccactgggccaggggacgctggtcaccgtctcctcagcctccaccaagggcccatccgtccttcccccgtcggcctacccctcctcccaacgacgccaccgtccgtcgggggccaccgacgccacgccccgtcgggccgtcggcccgttcgggtaccgaaaggtacctaccttcccgtaacgttaccttaccttacttccgtcggtaacggtccggggtccgtcgggacgtaacgggccggaccgaagtacggctnc

SEQ ID NO: 40657 - DNA, 584 bp, Homo sapiens
  misc_feature: GYAE6OF02GDJDE.29.14.B03.1.454.CMB.1.raw
  modified_base (207)..(207): a, c, t, g, unknown or other
  misc_feature (207)..(207): n is a, c, g, or t
tcagatagagtactcacgaccggtgctcgatttagtgtgagtagtttgggctgagctggcttttcttgtggctattttaaaaggtgtccagtgtgacgtgcagttggtggagtctgggggcgcctgggtacggccggggggtcgctgagactctcctgtgcggcctctggatttaagttttaggagtcatgccatgaactgggtccnccaggctccagggaaggggctggagtgggtctcggctattagtggcagtggtggcgctatatattatgcagacgccctggaagggccggttcaccatttccagagacaattcgaagaacacgctgtatctgcaaatggagagcctgagactcgacgacacggccgtctattattgtagttaaaggcgagctaggaagtacgggaccgggccgacgttcgaccacgtcggggccgaggggacgcgtggtcaccgtctcctcacgcctccaccgaacgggcccacgtccggttccttcccccgtcggcctaccccgtccctacccaacggacgaccacccgtcgtcggggccacgacgccgacggcccgtcgggctcgg

SEQ ID NO: 40658 - DNA, 564 bp, Homo sapiens
  misc_feature: GYAE6OF02GRXEV.29.14.B03.1.454.CMB.1.raw
  modified_base (372)..(372): a, c, t, g, unknown or other
  misc_feature (372)..(372): n is a, c, g, or t
  modified_base (562)..(564): a, c, t, g, unknown or other
  misc_feature (562)..(564): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtgggccagggggacncgtggtcaccgtctctcagccctccaccgaagggcccactccggtccttccccctcggccaccctcctccaacgacgccaccgtcgtcggggaccacgacgccgacgcccgtcgggcctcgcctcgggtcaaggtacctacttccacgtactctatcgtgacgcgggcgtcggacgacggcgacagtagnnn

SEQ ID NO: 40659 - DNA, 577 bp, Homo sapiens
  misc_feature: GYAE6OF02INJB8.29.14.B03.1.454.CMB.1.raw
  modified_base (575)..(577): a, c, t, g, unknown or other
  misc_feature (575)..(577): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaaatggagagcctgagactcgacgacacggccgtctattattgtgttaaaggcgagctggaatacggggaccgggcccgacttgaccacgtgggccaggggacgcgtggtcaccgtctcctcagccctccaccgaacgggcccactccggtccttccccctcggccaccctcctccaacgacgccacctcgtcgggggccacgacgccacgcccgtcgggccgtcggccgtgggtaccaacgggtaacctaccttccagttaccttctatcgtgacgcgggcgtcggcgaacggcgcagtcgnnn

SEQ ID NO: 40660 - DNA, 581 bp, Homo sapiens
  misc_feature: GYAE6OF02GLQXM.29.14.B03.1.454.CMB.1.raw
  modified_base (456)..(456): a, c, t, g, unknown or other
  misc_feature (456)..(456): n is a, c, g, or t
  modified_base (484)..(484): a, c, t, g, unknown or other
  misc_feature (484)..(484): n is a, c, g, or t
tcagatagagtactcacgaccggtgctcgatttagtgtgagtagtttggtggagtctgggggcgcctgggtacggccggggggtcgctgagactctcctgtgccggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgcgtggtcaccgtctcctcagcctccacacgggcccagtcggtcctccccgtgccaccctcctccaagcgaccncctcggcgggacacgacgcgaccgccgnggcgtcgtccggtcggtacgacgtaccttaccgtaccgtacgttacctacttacgtcgtacggacgggcggtcggtcggacggacggccgtagtacg

SEQ ID NO: 40661 - DNA, 573 bp, Homo sapiens
  misc_feature: GYAE6OF02FO85I.29.14.B03.1.454.CMB.1.raw
  modified_base (252)..(252): a, c, t, g, unknown or other
  misc_feature (252)..(252): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctgggagtgggtctcggctattagnggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaagtacgggaccggggcccgacgtgaccacgtcggggccgaggggacgcgtcggtcaccgtctcctcacgccctccaccgaacgggcccacgtccggtccttccccgtcggccaccctccctccaacgacgccaccgtcgtcggggcacgacgccacgcccgtcgggctcgg

SEQ ID NO: 40662 - DNA, 598 bp, Homo sapiens
  misc_feature: GYAE6OF02I7XAI.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccacttgaccacgtcggggccaggggacgctgggtccaccgtctcctcacgcctccaccaacggcccaatcggtccttcccctggccaccctcctccaagacgccacctccgtcgggggccacgacgccacgcccgtgggcctcgccgtggtaccgaacggaccttaccttccgaacggttaccttaccttacttccgtcggacggccggggtcttacgggacgaacgggccgacgtaacg

SEQ ID NO: 40663 - DNA, 551 bp, Homo sapiens
  misc_feature: GYAE6OF02G64L9.29.14.B03.1.454.CMB.1.raw
  modified_base (549)..(551): a, c, t, g, unknown or other
  misc_feature (549)..(551): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccactgggccagggggacgctggtcaccgtctcctcagcctccaccaagggcccatccggtcttccccctggccaccctcctccaacgacgccaacctcgtcgggggccacgacgcacgcccgtggggcctcgccctgggtcaaggctacttccagtactctatcgtgacgcgggctggcaacggcgcatacgnnn

SEQ ID NO: 40664 - DNA, 710 bp, Homo sapiens
  misc_feature: GYAE6OF02G56QS.29.14.B03.1.454.CMB.1.raw
  modified_base (309)..(309): a, c, t, g, unknown or other
  misc_feature (309)..(309): n is a, c, g, or t
tcagatagagtactcacgaccggtgctcgatttagtgtgagtagtttgggtcggtccgtgggtacgaccgggggtcgctaggaagactcttcctgtgcggcctctggacttaacgttttaggagtcaatgccatagaactggtccgcctaggtcctccagggaagggctgggagtgggtcctacggctagttacgtggccggtggtggcgctatatattagtgcagaccgcccgtgaaagggccggttacaccctagtttccacgtagacctaattccgaagaaccacgctgtatcgtgcaaactgganacgccttgagacctcgacgtacacgggccgtctacttacttgtacgttaaacggcggaaggccttgggaagtacgggacccggggtcccgacgttgacctacgttggggaccagggggaccgcgtggtccaacccgtctccgtccacgtccctaccgaaccgaacgggcccctaagtccggttacctttcccccgtcggcctaccccttccctacccaacgacgccaacccgttcgtcggggccacgacgccgacgcccgtggccgttcgccgtcggtccgaacggtaccgttaccgttccctaacgttaccttccgtacgttccgtacgtaacggtcccggtacggttaccggaccgtaaaccggcccgtaaccgtacgttaacggacgtacgtcgtacg

SEQ ID NO: 40665 - DNA, 624 bp, Homo sapiens
  misc_feature: GYAE6OF02HNW67.29.14.B03.1.454.CMB.1.raw
  modified_base (619)..(619): a, c, t, g, unknown or other
  misc_feature (619)..(619): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtggggccagggggacgcgtggtcaccgtctcctcagcctccaccaacgggcccactccggtccttcccccgtcggccaccctcctccaacgacgccaccgtccgtcgggggcacgacgccacgcccgttcgggcctcggccgtcggtaccgaacggtaccttaaccgttcccgtaacgttaccttaccgttaacttcccgttcggacgggtccggggtccgttacgggaccgaacgggccggaccgacgtacggacgngtacg

SEQ ID NO: 40666 - DNA, 593 bp, Homo sapiens
  misc_feature: GYAE6OF02H0INH.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccaggggaaggggctggagtggggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccgggccgacgttgaccacgtggggccaggggacgcgtggtcaccgtctcctcacgcctccaccgaacgggcccacgtccggtccttccccgtcggcccaccctcctccaacgacgcacctcgtcggggccacgacgcacgcccgtgggcctcgccgtcggtacgaacggtaccttacgttcccgtacgtacctacttactcgtcggacggcgggtcgtacggaccgaggccgcgtaacg

SEQ ID NO: 40667 - DNA, 584 bp, Homo sapiens
  misc_feature: GYAE6OF02GC3S4.29.14.B03.1.454.CMB.1.raw
  modified_base (579)..(579): a, c, t, g, unknown or other
  misc_feature (579)..(579): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaagtacggggaccggggcccgacttgaccacgtggggccgaggggacgcgtggtcaccgtctcctcacgccctccaccgaacgggcccacgtccggtccttcccccgtcggcccaccctccctccaacgacgccaccgtcgtcggggccacgacgccacggccctcgggcctcgcctcggtcgacggacttaccttaccacgtacctctactcgtcgacgcgggtcgtcggcgacggcgngaacg

SEQ ID NO: 40668 - DNA, 939 bp, Homo sapiens
  misc_feature: GYAE6OF02GVLE3.29.14.B03.1.454.CMB.1.raw
tcagatagagtactcacgaccggtgctcgatttagtgtgagtagtttggtgggaggtactgggggcgcctgggttacgggcccgggggggtcgcgtacgagacgtactccctgtgcggcctctggatttaacgttttacgagtcatgccgatcgaactggtccgccaggctaccagggaagggctggagtgggtctcggctattacgtcggcagtggtggcgctagtatatatcgcacgacgccctggaacgggccggttcaaccgattttccgaagacgacaaactttacgaaaggaaccacggcctaggtactactacgacgaaaacgtgggacgtacgccgttcgacgtacttacgaaccgtaacgaccgggtccgtaccttaatttacgttacgtagggttaaaacggccgtaaggtacctacgggaaacgtaacccgggggtaacccgggggtccccgtaaacggtttcgggaacccgtaacgggttcgggggggacccgtaagggggggaaccgtccggttacggggtttcccgaacccgtttcccggttaccctttaccggaaacgttcccccgtacccgaaacccggaaaccgggggtcccccctaaggttcccgggtttaccccgttttaccccccgttaggggaacccttaacccccgtttccccgtaaccgtaaacggttaaccgttaccctacccggttacgggtccgggggaacctaaccgttaacggtaaccgtaacccggtaccccgggttccggggtacccgttcgggtacccggttacgggttaacccggaaaacggggttaacccttaaccggttacccggaaaccggtttacccgttaaaccgttacccggtacgggtaaccgggtcccgggtaccggttacgggaacccgttaacgggtcccgtaccgtacgttaacgg

SEQ ID NO: 40669 - DNA, 569 bp, Homo sapiens
  misc_feature: GYAE6OF02H38Z3.29.14.B03.1.454.CMB.1.raw
  modified_base (382)..(382): a, c, t, g, unknown or other
  misc_feature (382)..(382): n is a, c, g, or t
  modified_base (567)..(567): a, c, t, g, unknown or other
  misc_feature (567)..(567): n is a, c, g, or t
tcagatagagtactcacgaccggtgctcgatttagtgtgagtagtttgggggcgcctgggtacggccgggggggtcgctgagactctcctgtgcggcctctggattaagtttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagtaaaggcgagctagggaaatacggggaccggggccgacttcgaccacgtcggggccagggggacncgtggtccaccggtctcctcacgcctccaccgaacgggcccagtccggtccttcccccgtggccaccctcctccaagacgcacctcgtcggggcacgacgcacgcccgtgggctcgccgtggtaccgaaggactaccttccagtactctatcgtgacgcgggctcggacgaggcgacagtacgcngc

SEQ ID NO: 40670 - DNA, 555 bp, Homo sapiens
  misc_feature: GYAE6OF02HI2JE.29.14.B03.1.454.CMB.1.raw
  modified_base (383)..(383): a, c, t, g, unknown or other
  misc_feature (383)..(383): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacncgtggtcaccgtctcctcagcctccaccaacgggcccatccggtccttcccctcggccaccctcctccaacgacgccacctcgtcggggccacgagccacgcccgtgggcctcgcctcggtcaacggactactcctagtactctatctgacgcggcgtcggcaacggcgcag

SEQ ID NO: 40671 - DNA, 663 bp, Homo sapiens
  misc_feature: GYAE6OF02IPFLK.29.14.B03.1.454.CMB.1.raw
  modified_base (374)..(374): a, c, t, g, unknown or other
  misc_feature (374)..(374): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtagttaaaaggcgaagctggaatacgggacgggccgacttgaccacgtgggccagggggacncgtgggtcaaccggtctccgtcacgtccctcccgaaccgaacgggccccaacgtccggtcctttcccccgtcgggccaccccgttccctaccaacgaacgcctaaccctccgttacgggggccaccgtacgaccacggtccccgtaggggccttccggcccgttgggtaccgaaacgggtaacccgttaaccgttacccgtaacgttacccttacttaacgttcccttaggaccggtaccggggtccttcgggaccgaacggggtcccggacgaacgtaacggcagacg

SEQ ID NO: 40672 - DNA, 562 bp, Homo sapiens
  misc_feature: GYAE6OF02GIODG.29.14.B03.1.454.CMB.1.raw
  modified_base (560)..(562): a, c, t, g, unknown or other
  misc_feature (560)..(562): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccacttgaccacgtggggccagggggacgctgggtcaccgtctcctcagcctccaccaagggcccatcggtcctttcccccgtcggccacccctcctcccaacgacgccaccctccgtcgggggccacgacgccacgcccgtgggctcgcctggtccgaaggtactaccttccagtacctctactctgacgcgggctcggcgacggcgcgatagnnn

SEQ ID NO: 40673 - DNA, 648 bp, Homo sapiens
  misc_feature: GYAE6OF02JK7P6.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtgcagtctggggcgcctgggtacggccggggggtcgctgagactctcctgtgcggcctctggatttaagttttaggagtcatgccatgaactgggtccgccaggctccgagggaagggctggagtgggtctcggctattaggtggcaggtggtggcgctatatattatgcagacgcctgagggccgttcaccatttccagagacaattcgaagaacacgctgtatctgactaaaagtggagagccgtagacgactcgaacgacgacggccgttactattattcgtagttaaaggcgtagcgtaggaacgtacgggaccgggccgacgttcgaccgacgcgggcgacgggacgcgtcggtccgaccgtcctccgtcgacgccctacccgacccgaacgggtcccgtaacgtcccggttcccgttacccccgtcgggaccctaccccgtacccgttaccccgaacggtaccgacccgtaacccgtccggttaccgggggacctaccggaccggtaccgaccggtccccggtacgggtcccgg

SEQ ID NO: 40674 - DNA, 638 bp, Homo sapiens
  misc_feature: GYAE6OF02IVEER.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaagcgagctggaagtacgggaccggggcccgacttgaccagtggggccaggggacgctggtcaccgtctcctcacgcctccaccaacgggcccatcggtcctcccctggccaccctcctaccaacgacgccaaccctcgtacggggacacgacgacacgcccgtaccggtcgtcgtccggtccggtacggtaaccggaaccgttacccgttaccgttaacccggtaacgtttaacccttacgtttaaccgttacggtacgggtaccgggtccggtaccgggtacggaaccgggtaccgggccgtaacgg

SEQ ID NO: 40675 - DNA, 581 bp, Homo sapiens
  misc_feature: GYAE6OF02HF2TS.29.14.B03.1.454.CMB.1.raw
  modified_base (578)..(580): a, c, t, g, unknown or other
  misc_feature (578)..(580): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccattttctagagacaattcgaagaacacgctgtatctgcaaaatggagagcctgagactcgacgacacggccgtctattattgtgttaaaggcgagctggaatacgggaccgggccgacttgaccacgtcgggccagggggacgcgtggtcaccggtctcctcacgcctcccaccgaacgggcccacgtccggtccttcccccgtcggcctacccctccctccaacgacgccacctcgtcggggcacgacgcacgtcccgtcgggcctgccgtcggtacgaacggtacctaccttaccgacgtacctctactcgtggacgcgggtcgtggacgaggcgacgatacgnnng

SEQ ID NO: 40676 - DNA, 609 bp, Homo sapiens
  misc_feature: GYAE6OF02J12K1.29.14.B03.1.454.CMB.1.raw
  modified_base (605)..(606): a, c, t, g, unknown or other
  misc_feature (605)..(606): n is a, c, g, or t
  modified_base (608)..(608): a, c, t, g, unknown or other
  misc_feature (608)..(608): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaggcgagctggaagtacgggaccgggccgacgttcggaccacgtggggccagggggacgcgtggtcaccgtctccgtcacgtccctccgaaccgaacgggcccaacgtccggtcccttcccccgtcggcccacccctcccgtacccaacgacgaccacctccgtacggggccacgacgaccgacgcccgtcgggcgtcgccgtacggtacgaacgggacctaaccgttaccacgtacctacgtacgtctcggaggccgggcgtacggacgacggccgcgtagtacggnngng

SEQ ID NO: 40677 - DNA, 608 bp, Homo sapiens
  misc_feature: GYAE6OF02HVK9B.29.14.B03.1.454.CMB.1.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (330)..(330): a, c, t, g, unknown or other
  misc_feature (330)..(330): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccnccaggctccgaggggaaggggctgggagtgggtcncggctattaggtggcaggtggtggcgctatatattatgcagacgccctggaagggtccgttnacctatttccagagacaattcgaanaacacgctgtatctgcaaaatggagagcctagagactcggaacacgacggccgtattattacttgagtttaaaggcgaagtctaggagtaacggggaccgggcccgtacgttgaccgacgtggggaccgagggacgcgtaggcaccgtctcctcagccctccgaccgaacgggacccagttaccggtcccttccccgtacggcctacccctccctaccgaacggacgtccacctccggttacggggccaccgacggccaccggcccgtcggtctccgg

SEQ ID NO: 40678 - DNA, 587 bp, Homo sapiens
  misc_feature: GYAE6OF02GCMB0.29.14.B03.1.454.CMB.1.raw
  modified_base (301)..(301): a, c, t, g, unknown or other
  misc_feature (301)..(301): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
tcagatagagtactcacgaccggtgctcgatttagtgtgagtagtttgggctgagcgtggcttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccgagggaaggggctgggagtgggtctcggctattagtggcagtggtggcgctatatattatgcagacgccctgaagggccggttnaccatttccagagacaattcgaagaacacgctgtatctgacaaatgganagcctgagaccncgacgacacggccgtctattattgtgttaaaaggcgagctaggaagtaccgggaccggggcccgacgttgaccacgtcggggccgagggacgcgtggtcaccgtctcctcacgcctaccacccgaacggcccacgtccggttcccttcccccgtcgccaccctccacccaacgacgcctacctccgtcggggaccacgacggccgacggcccgtcgggcgtccgg

SEQ ID NO: 40679 - DNA, 542 bp, Homo sapiens
  misc_feature: GYAE6OF02H2LAK.29.14.B03.1.454.CMB.1.raw
  modified_base (471)..(471): a, c, t, g, unknown or other
  misc_feature (471)..(471): n is a, c, g, or t
  modified_base (540)..(542): a, c, t, g, unknown or other
  misc_feature (540)..(542): n is a, c, g, or t
tcagatagagtactcacgaccggtgctcgatttagtgtgagtagtttgggggcgcctgggtacggccgggggggtcgctgagactctcctgtgcggcctctggattaagtttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaatggagagcctgagactcgacgacacggccgtctattattgtgttaaaggcgagctggaatacggggaccgggccacttgaccacgtggggcccaggggacgctggtcaccgtctcctcagccctccaccgaacgggcccagtccggtccttccccctggccaccctcctaccaacgacgcacctcgtcggggcacngcacgcctgggctgcctggtcaagctactccagtactctatctgagcgggctcggcgacggcgcatagnnn

SEQ ID NO: 40680 - DNA, 592 bp, Homo sapiens
  misc_feature: GYAE6OF02I2O5T.29.14.B03.1.454.CMB.1.raw
tcagatagagtactcacgaccggtgctcgatttagtgtgagtagtttgggctgagctggcttttcttgtggctattttaaaaggtgtccagtgtgacgtgcagttggtggagtctgggggcgcctggggtacggccgggggggtcgctgagactctcctgtgcggcctctggattaagttttaggagtcatgccatgaactgggtccgccaggctccaggggaaggggctgggagtgggtctcggctattagtggcagtggtggcgctatatattatgcagacgccctgaagggccgttcaccatttccagagacattcgaagaacacgctgtatctgacaaatggagagcctgagactcgacgacacggccgtctattattgtagttaaaggcgagctaggaagtacggggaccgggcccgatcggaccgacgtcggggcgaggggacgcgtggtcaccggtctcctcacgccctaccaccgaacgggccctacgtccgtccttccccgtcggccctaccctcccacctaacgacgaccacccgttcggtccggggaccacgacgaccgacgtacccgtccgggctaccgg

SEQ ID NO: 40681 - DNA, 587 bp, Homo sapiens
  misc_feature: GYAE6OF02IEMK9.29.14.B03.1.454.CMB.1.raw
  modified_base (379)..(379): a, c, t, g, unknown or other
  misc_feature (379)..(379): n is a, c, g, or t
tcagatagagtactcacgaccggtgctcgatttagtgtgagtagtttggtggagtctggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaaggccggttcaccatttccagagacaattcgaagaacacgctgtatctgcaaatggagagcctgagactcgacgacacggccgtctattattgtgttaaaggcgagctggaatacgggccgggcccgattgaaccactggggccaggggacnctggtcaccgtctcctcagcctccaccaaggcccatcggtcttcccctggccaccctcctccaacgacgccacctcgtcggggccacgacgccgacgcccgtgggccgtcgtccgtcggtaccaacggaccttaccgttaccctaacggtaccttccttaacttccgtacggacgtccggggctcgggaccgaacgggtccgctaacg

SEQ ID NO: 40682 - DNA, 553 bp, Homo sapiens
  misc_feature: GYAE6OF02HO4PL.29.14.B03.1.454.CMB.1.raw
  modified_base (551)..(553): a, c, t, g, unknown or other
  misc_feature (551)..(553): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaaggcgagctggaatacggggaccggggcccgacttgaccacgtggggccagggggacgcgtggtcaccgtctcctcacgcctccaccaagggcccatcggtccttccccctcggccaccctcctccaacgacgccacctcgtcggggcacgacgcacgccgtcgggctcgcctcggtcaacggctacttccagtacctctactcgtgacgcggctggcacggcgcagtagnnn

SEQ ID NO: 40683 - DNA, 582 bp, Homo sapiens
  misc_feature: GYAE6OF02HSCDO.29.14.B03.1.454.CMB.1.raw
  modified_base (147)..(147): a, c, t, g, unknown or other
  misc_feature (147)..(147): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctggggtacggccgggggggtcnctgagactctcctgtgcggcctctggattaagttttaggagtcatgccatgaactgggtccgccaggcctccaggggaagggctggagtgggtctcggctattagtggcaggtggtggcgctatatattatgcagacgcctgaagggccgttcacatttccagagacattcgaanaacacgctgtatctgacaaagtgganacgcctagagactcgacgacacggccgtctattatgtagttaaaggcgagtcgtaggaagtacgggaccggggcccgacgttcgaccgacgtcggggccgaggggacgcgtcggtcgaccgtctcctcacgcctccgaccgaacgggcccagtccgtccttaccccgtcgtcccacccgtcctaccaacgcgcctaccgtcgtcggggccacgcgccacggcccgtggactcgg

SEQ ID NO: 40684 - DNA, 605 bp, Homo sapiens
  misc_feature: GYAE6OF02HIVTQ.29.14.B03.1.454.CMB.1.raw
  modified_base (208)..(208): a, c, t, g, unknown or other
  misc_feature (208)..(208): n is a, c, g, or t
  modified_base (378)..(378): a, c, t, g, unknown or other
  misc_feature (378)..(378): n is a, c, g, or t
  modified_base (485)..(485): a, c, t, g, unknown or other
  misc_feature (485)..(485): n is a, c, g, or t
tcagatagagtactcacgaccggtgctcgatttagtgtgagtagtttgggctgagcgtggcttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccnccaggctccgagggaaggggctggagtgggtctcggctattagtggcagtggtggcgctatatattatgcagacgcctggaagggccggttcacctatttccagagacaattcgaagaacacgctagtatctgacaaagtggagacgctgagactcgaacgacacggctntattaattgtaggttaaacggcgtagcgtaggaacgtaccggggaccggggccctacgttcgaccgacggtcggggaccgaggggacgcgtcgggtcaccgtctccncgacgccaccaccgacggcccagtccggtcccttccccgtggccctaccctccctaccgaacgacgcccaccgtccggtacggggccaccgacgtccgaccggtcccgtcgggcctccgg

SEQ ID NO: 40685 - DNA, 565 bp, Homo sapiens
  misc_feature: GYAE6OF02HROIG.29.14.B03.1.454.CMB.1.raw
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
tcagatagagtactcacgaccggtgctcgatttagtgtgagtagtttagggtttggtagggtctctctcccagcctgtgctggactcaatcgccctctgcctctgcctccctgggagctcggtcaaggtcacctgtactctggagcagtggacacagcagctacgccatcgcttggcatcagcagaggccagacacgggccctcgttacttgatgacagtcaaacaatgatggcagtcanagcgaagggggacggatccgtgactcgctttcncagtcctaccacgactctgggacctggacgcgtcctacctcaacaagtcctccggcctcagttctgagtntggagtctagactattacngtcacgacgtggggacacgtcggntacttcgacggttctacgggaccgggactaacggtcaccggtcgttccggtacacgcccaacggcccaaacccgtagtacgtaccaacgtcgttacgttccccgccctcctacgtacgtactccgtatccgtaggtacggaccggtcgttacggaccgaggccgaccgagtacgcatcg

SEQ ID NO: 40686 - DNA, 557 bp, Homo sapiens
  misc_feature: GYAE6OF02F617Q.29.14.B03.1.454.CMB.1.raw
  modified_base (553)..(553): a, c, t, g, unknown or other
  misc_feature (553)..(553): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaaatggagagcctgagactcgacgacacggccgtctattatgtgttaaaggcgagctggaatacggggaccggggcccgacgttcgaccacgtgggggccaggggacgcgtggtcaccgtctcctcagcctccaccaacgggcccagtccggtccttcccccgtggccaccctcctccaagacgcacctcgtcggggcacgagcacgccctggctcgcctggtcaagacctactccagtactctactctgacgcggcgtcggacgacggcgntacg

SEQ ID NO: 40687 - DNA, 562 bp, Homo sapiens
  misc_feature: GYAE6OF02IPB3E.29.14.B03.1.454.CMB.1.raw
  modified_base (383)..(383): a, c, t, g, unknown or other
  misc_feature (383)..(383): n is a, c, g, or t
  modified_base (559)..(559): a, c, t, g, unknown or other
  misc_feature (559)..(559): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtgttaaaggcgagctgaatacggggaccgggcccacttgaccacgtggggccaggggacnctgggtcaccgtctcctcagcctccaccaagggcccagtccggtccttcccctcggccacccttccctccaagacgccacctcgtcggggcaacgagccagcccgtcgggactcgccgtgtccgaagtccttactccgtagtaccttctatctgagtcgggctcgggcaacggcgntag

SEQ ID NO: 40688 - DNA, 572 bp, Homo sapiens
  misc_feature: GYAE6OF02IP2KU.29.14.B03.1.454.CMB.1.raw
tcagatagagtactcacgaccggtgctcgatttagtgtgagtagtttggtggagtctgggggcgcctgggtacggccgggggggtcgctgagactctcctgtgggcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgctggtcaccgtctcctcagcctccaccaacggcccactcggtccttccccgtcggccaccctccctccgaacgacgcacctcgtcggggcacgacgcacgcccgtcggctcgccgtcggtcgaacggacctacttaccacggtactctactcgtacgaggtcgggcgtcggacgaacggtcgctacg

SEQ ID NO: 40689 - DNA, 549 bp, Homo sapiens
  misc_feature: GYAE6OF02GJ52O.29.14.B03.1.454.CMB.1.raw
  modified_base (544)..(544): a, c, t, g, unknown or other
  misc_feature (544)..(544): n is a, c, g, or t
  modified_base (547)..(549): a, c, t, g, unknown or other
  misc_feature (547)..(549): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccactggggccagggggacgctggtcaccgtctcctcagcctccaccaagggcccatcggtccttccccctggccaccctccctccaacgacgccacctcgtgggggcaccagccacgcccgtgggctcgccctggtcaacggacctacttccagtactctatcgtgacgcgggctggcaaggcgcanagnnn

SEQ ID NO: 40690 - DNA, 568 bp, Homo sapiens
  misc_feature: GYAE6OF02FMY8R.29.14.B03.1.454.CMB.1.raw
  modified_base (565)..(565): a, c, t, g, unknown or other
  misc_feature (565)..(565): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtgggggccaggggacgcgtggtcaccgtctcctcacgccctccaccaacggacccatccggtccttccccctcgcccaccctccctccaacgcgccaccctcgtcgggggccaacgacgcacgcccgtcgggctcgcctggtaccaaggacctacttccacgtacctctactcgtgaggcgggctggcacggcgnacg

SEQ ID NO: 40691 - DNA, 633 bp, Homo sapiens
  misc_feature: GYAE6OF02GUV4W.29.14.B03.1.454.CMB.1.raw
  modified_base (287)..(287): a, c, t, g, unknown or other
  misc_feature (287)..(287): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaaggccggttcaccatttccagagacaattcgaagaacacgctgtatctgcaaaatgganagcctgagactcgacacacggccgtctatattgtgttaaaagcgaagctggaatacgggacgggccgacttgaccactggggccaggggacgctggtcacccgtctacctcaagcctccaccaaagggcccatcggtcttcccctggccaccctcctccgaagacgcaacctcgtgggggtaccactacgcaacggtcccctaggggccctggccccgttggtacccgtaaaggggtaccttaccgtttacccgtaaacggtttacctaccgttaaacgtttccgttacggtaacggccgggggtaccgttacgggtaccgtaaacggggtcccgaccggtaaacg

SEQ ID NO: 40692 - DNA, 572 bp, Homo sapiens
  misc_feature: GYAE6OF02GY7W7.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaataccggggaccggggcccgacttcgaccacgtcggggccaggggacgcgtggtccaccgtctcctcagcctccaccgaacgggcccacgtccggtccttccccgtcggccacccctccctccaacgacgccacctcgtcggggccacgacgcacgcccgtcgggctcgcctcggtcgaacgactactcctagtactctactctacgcgcggcgtcggcacggcgactacg

SEQ ID NO: 40693 - DNA, 564 bp, Homo sapiens
  misc_feature: GYAE6OF02F4SHY.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccggggcccgacttgaccactggggccaggggacgctggtcaccgtctcctcacgcctccaccaagggccccagtcggtccttccccgtggccacccctcctccaagacgccaccctcgtcggggaccacgacgcacgcccgtgggcctcgcctggtcaacggtactacttccgacgtctacttactctgagccgggcgtcggtacaggcgacacg

SEQ ID NO: 40694 - DNA, 581 bp, Homo sapiens
  misc_feature: GYAE6OF02IQP08.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctgggaataccggggaccggggcccgacttcgaccacgtcggggccaggggacgctggtcaccgtctcctcacgcctccacccgaacgggcccactccggtccttccccgtcggccaccccctccctccaacgacgcctaccctcgtcggggcacgagccacgcccgtgggcctgccttggtccgaaggaccttacttcccgacggtacttcctatcctggacggcgggtctggcaagggcgcag

SEQ ID NO: 40695 - DNA, 579 bp, Homo sapiens
  misc_feature: GYAE6OF02I44TK.29.14.B03.1.454.CMB.1.raw
  modified_base (347)..(347): a, c, t, g, unknown or other
  misc_feature (347)..(347): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgacaaatgganagcctagacgactcgacgacacggccgtctattattgtagttaaaggcagcgtaggaagtacgggacgggcccgactgaccacgtgggccgaggggacgcgtggtccgaccgtctccgtcacgcctacccaccgaacgggcccacgtccgttcccgttccccgtcggtccaccctcctaccacgacgcctacctccgtcggggaccacgacggccacgcccgtcgggctcgg

SEQ ID NO: 40696 - DNA, 556 bp, Homo sapiens
  misc_feature: GYAE6OF02IB0KG.29.14.B03.1.454.CMB.1.raw
  modified_base (102)..(102): a, c, t, g, unknown or other
  misc_feature (102)..(102): n is a, c, g, or t
  modified_base (112)..(112): a, c, t, g, unknown or other
  misc_feature (112)..(112): n is a, c, g, or t
  modified_base (125)..(125): a, c, t, g, unknown or other
  misc_feature (125)..(125): n is a, c, g, or t
  modified_base (127)..(127): a, c, t, g, unknown or other
  misc_feature (127)..(127): n is a, c, g, or t
  modified_base (130)..(130): a, c, t, g, unknown or other
  misc_feature (130)..(130): n is a, c, g, or t
  modified_base (139)..(139): a, c, t, g, unknown or other
  misc_feature (139)..(139): n is a, c, g, or t
  modified_base (141)..(141): a, c, t, g, unknown or other
  misc_feature (141)..(141): n is a, c, g, or t
  modified_base (144)..(144): a, c, t, g, unknown or other
  misc_feature (144)..(144): n is a, c, g, or t
  modified_base (157)..(157): a, c, t, g, unknown or other
  misc_feature (157)..(157): n is a, c, g, or t
  modified_base (162)..(162): a, c, t, g, unknown or other
  misc_feature (162)..(162): n is a, c, g, or t
  modified_base (165)..(165): a, c, t, g, unknown or other
  misc_feature (165)..(165): n is a, c, g, or t
  modified_base (183)..(183): a, c, t, g, unknown or other
  misc_feature (183)..(183): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagatagagtactcacgaccggtgctcgatttagtgtgagtagtttggtggagtctgggggcgcctgggtacggccgggggggtcgctgagactctcctgngcggcctcgngaagtagttgatnangcntgactggcncngcncaggaggctgagnggtcncgntattgtgcagtggtggcnctatatattatgcagacgcctgaagggccggttnaccatttcanagacaattcgaagaacactgtntattcngacaaagtgagagctgagactcgaacgacacggtccgtntaattntttgagtttaaacggcgagctaggaatacggggaccgggccaacttggaacccncggcggacgagggacgtgtcgtacaccgtctcncgcgccacgacgacggcctagtccgtcctcccgngaccnccctcacgacgtcnctaccgnggacggacacgcgactccgccgtggcctcgacgtacgacgtaacgtccttaccgtacgtacgtactctacgtcgtacggcggtcggtacgtaggacgacgacgagtacg

SEQ ID NO: 40697 - DNA, 592 bp, Homo sapiens
  misc_feature: GYAE6OF02F452H.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtagttaaaggcgagctggaatacgggaccgggccacttcgaccacgtggggccagggggacgcgtacggtcaccgtctccgtcagcctccaccacgggcccagtcggtccttccccgtgccaccctcctccaacgacgccaacctcgtcggggaccacgacgccacgcccgtcgggcctcgccgtcggtaccgaaggacctacgttccgacgttactccttaactccgtaggacggtcgggtccgtcggtaccgaagggccgacgtaacg

SEQ ID NO: 40698 - DNA, 614 bp, Homo sapiens
  misc_feature: GYAE6OF02JHNKM.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtaggaagtacggggaccggggcccgacttgaccacgtggggccgaggggacgcgtggtccaccgtcctcctcacgccctccgaaccgaacgggcccacgtccggtcccttccccgtcggtccacccctcctaccaacgacgacctaccgtcgtcggggccacacgcaccgcccgcgggcctcgccgtcggtaccgaacggtaccttaccttccgacgttaaccttccttacttccgtcggacggcgggcgtacggaccgacggtacgacgtacg

SEQ ID NO: 40699 - DNA, 583 bp, Homo sapiens
  misc_feature: GYAE6OF02GIWHH.29.14.B03.1.454.CMB.1.raw
  modified_base (493)..(493): a, c, t, g, unknown or other
  misc_feature (493)..(493): n is a, c, g, or t
  modified_base (527)..(527): a, c, t, g, unknown or other
  misc_feature (527)..(527): n is a, c, g, or t
  modified_base (546)..(546): a, c, t, g, unknown or other
  misc_feature (546)..(546): n is a, c, g, or t
tcagatagagtactcacgaccggtgctcgatttagtgtgagtagtttgggctgagcgtggcttttcttagtggctattttaaaaggtgtccagtgtgacgtgcagttggtggagtctgggggcgcctggggtacggccgggggggtcgctgagactctcctgtgcggcctctggatttaagttttaggagtcatgccatgaactgggtccgccaggctccgagggaaggggctgggagtgggtctcggctattagtggcagtggtggcgctatatattatgcagacgccctggaacgggccggttcaccatttccagagacaattcgaagaacacgctgtatctgacaaagtggagagcctagagactcgacgacgacggccgtctattattgtagttaaaggcgagcgtaggaagtacggggaccgggcccggacgttcgaccgacgtcggggaccgacggggacgcgtggtcgaccgtctcctcacgtccnccaccgacggcccagtccgtcctccccgtcgccnccctcctaccgacgcgccnccgtcgtcgggccacgcgccgacgcccgtcggctcgg

SEQ ID NO: 40700 - DNA, 573 bp, Homo sapiens
  misc_feature: GYAE6OF02FUQMN.29.14.B03.1.454.CMB.1.raw
  modified_base (569)..(569): a, c, t, g, unknown or other
  misc_feature (569)..(569): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgcgtggtcaccgtctcctcagcctccaccgaacggcccactcggtccttccccgtcggccaccctcctaccaacgacgccaccgtcgtcggggccacgacgacacgcccgtgggctcgcctcggtccgacggtaccttacgttccacgttactccttactcgtcgaggcgggctcgggcacggccgntacg

SEQ ID NO: 40701 - DNA, 717 bp, Homo sapiens
  misc_feature: GYAE6OF02G3N99.29.14.B03.1.454.CMB.1.raw
  modified_base (147)..(147): a, c, t, g, unknown or other
  misc_feature (147)..(147): n is a, c, g, or t
  modified_base (210)..(210): a, c, t, g, unknown or other
  misc_feature (210)..(210): n is a, c, g, or t
tcagatagagtactcacgaccggtgctcgatttagtgtgagtagtttgggctgagctggcttttcttgtggctattttaaaaggtgtccagtgtgacgtgcagttggtggagtctgggggcgcctggggtacggccggggggggtcnctgagactctcctgtgcggcctctggatttaagttttaggagtcatgccatgaactgggtccnccaggctccgagggagggctggagtgggtctcggctattagtggcaggtggtggcgctatatattatgcagacgcctggaacgggccggttcacctattccagagacaattacgaagaacacgctgtactctgacaaagtggaagacgcctagacgactcggacgacgaccggccgttatactttagttggtaagttaaacggcgaggtcgtaggaacggtaccgggggacccgggcccgtacgttacgaaccgtacggtcggggaccggacggggaccgtcggtcggtaccgtacccggttcctccgtacgtaccgtccccgtacccgaacccggaaccggggcccctaaccgttcccgggtttccccgttcccccgtccgggtacccctaccccgttccccgtaacccgaaccggtaccgacccgtacccggttccgggtacccgggggaccaacccggtaccggacccgtacccgggtacccccggtcgggtcccgttcccggg

SEQ ID NO: 40702 - DNA, 686 bp, Homo sapiens
  misc_feature: GYAE6OF02JG77V.29.14.B03.1.454.CMB.1.raw
  modified_base (147)..(147): a, c, t, g, unknown or other
  misc_feature (147)..(147): n is a, c, g, or t
  modified_base (253)..(253): a, c, t, g, unknown or other
  misc_feature (253)..(253): n is a, c, g, or t
tcagatagagtactcacgaccggtgctcgatttagtgtgagtagtttgggctgagcgtggcttttcttgtggctattttaaaaggtgtccagtgtgacgtgcagttggtggagtctgggggcgcctggggtacggccgggggggtcnctgagactctcctgtgcggcctctggattaagtttaggagtcatgccatgaactgggtccgccaggctccgaggggaggggctggagtgggtctcggcttattagnggcagtggtggcgctatatattatgcagacgcccctggaacgggccgttcaccatttccagagactattacgaagacacgctgtatctgacaaatggagacgcctgagacgtcgacgacgacggccgtatatttacgttggtagttaaacggcgaagtcgtagggaacgttaacccgggggacccggggtaccccgtacgtttcggaccgtacggtacgggggccggacggggaccggtcgtcgggttacccgaccgttcccgttccgtccgaccgtaccctcccgtaacccgaaccgggacccctacgttcccggttcccgttacccccgttccggccctacccctccctaccgaacggacgtacccgacccgtccgggtaccggggtcccaaccgcggtaccgtacccggccccggtcgggtcccgtccgg

SEQ ID NO: 40703 - DNA, 566 bp, Homo sapiens
  misc_feature: GYAE6OF02GW1VB.29.14.B03.1.454.CMB.1.raw
  modified_base (146)..(146): a, c, t, g, unknown or other
  misc_feature (146)..(146): n is a, c, g, or t
  modified_base (477)..(477): a, c, t, g, unknown or other
  misc_feature (477)..(477): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcnctgagactctcctgtgcggcctctggattaagttttaggagtcatgccatgaactgggtccgccaggctccagggaaggggctggagtgggtctcggctattagtggcagtggtggcgctatatattatgcagacgcctgaagggccgttcaccatttccagagacaattcgaagaacacgctgtatctgacaaatggagagcctgagactcgacgacacggccgtctattattgtagttaaaggcgtagctaggaacgtacggggaccggggcccgtacgttcgaccgacgtcggggccgacggggacgtcgtcggtcaccgtctcctcncgcctccaccgacggccacgtccgtcctccccgtcgccaccctcctccacgcgccacccgtcgtcgggcacgcgcacgccgtggctcgg

SEQ ID NO: 40704 - DNA, 671 bp, Homo sapiens
  misc_feature: GYAE6OF02GHBJ0.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgctggtcaccgtctcctcagccctccaccaacgggcccacgtccggtccttcccccgtcggccacccctccctccaaacggtacgacctacccgtccgttcggggggcctaaccgacggccgaaccggccccgtacggggtcccttcggccccggttacgggtaccgaaacgggtaccgtttacccgttacccgttaaccggttaacctttacccgttaacttcccgttaggtaaccgggtccggggtcccggttacggggacccgaacggggtcccggactaacgg

SEQ ID NO: 40705 - DNA, 623 bp, Homo sapiens
  misc_feature: GYAE6OF02I8N34.29.14.B03.1.454.CMB.1.raw
tcagatagagtactcacgaccggtgctcgatttagtgtgagtagttccgcgggggcgaggagtcagacccactcaggacacagcatggacatgagggtccacgctcagctcctgggctcctgctgctctggctcccaggtgccagatgtgccatccagatgacccagtctccatattccctgtctgcatctgtaggagacagagtcagcaatcacgttgccgggcaagtcaggacatccaaatcgagataagctggtatactaacagaaaaccacgggtaaacctaccgtaacctacctagactactatgctgccgtacctagttaacgaaagtcgggtaccctattacgacggttacacggtcggactacggtaggtacgtacgtaggccaacgagtactttactactacgttaccacgtactcgagaccgaacgccctgtaccgagaccgttaggaacgtttagttacgtacctaatttaacttactacgttactaaccgtaaaggtacttaaccgttaacttaccgaggttacgggaccgtttacggacccggtaaacgggaccgtaagggtaacgaacgtaacgaaccggttacgttaggtacggtacgtccgtaaccg

SEQ ID NO: 40706 - DNA, 571 bp, Homo sapiens
  misc_feature: GYAE6OF02IIS35.29.14.B03.1.454.CMB.1.raw
  modified_base (393)..(393): a, c, t, g, unknown or other
  misc_feature (393)..(393): n is a, c, g, or t
tcagatagagtactcacgaccggtgctcgatttagtgtgagtagttccgcgggggcaggagtcagacccactcaggacacagcatggacatgagggtccacgctcagctcctggggctcctgctgctctggctcccaggtgccagatgtgccatccagatgacccagtctccatattccctgtctgcatctgtaggagacagagtcagcatcacttgccgggcaagtcaggacatccgaaatgagataagctggtatcaacaagaaaccaagggaaacctcctaacctcctagactctatgctgcgtcctagtttaacaaggtcgggtcccatccgtacggttcaggcggacaggtgatcgtggcacagtactttcactctcaccatacgacncagcctgacacgcctagaacgttattttcgacttaaactttatttactacgttactaaactaagtaactttaacctaactttaaccgaagttcgggtaaccgttaccgggaccgaaacggggaccgtaaagggtagaaacgttaacgaaacgaaccgttcggtacgaccgttagaccc

SEQ ID NO: 40707 - DNA, 588 bp, Homo sapiens
  misc_feature: GYAE6OF02F3BPD.29.14.B03.1.454.CMB.1.raw
  modified_base (586)..(587): a, c, t, g, unknown or other
  misc_feature (586)..(587): n is a, c, g, or t
tcagatagagtactcacgaccggtgctcgatttagtgtgagtagtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacgttcgaccacgtggggccgagggggacgctggtcaccgtctccctcacgccctaccaccaacgggcccacgtcggtccttcccccgtcggccacccctccctacccaacgacgccacctcgtcggggcaccgacgcacggcccgtcgggcctcgccgtcggtaccgaacggtacctaccgttccacgtaccttctactcgtggacgcgggtcgtcggacgacggcgacagtagnnc

SEQ ID NO: 40708 - DNA, 678 bp, Homo sapiens
  misc_feature: GYAE6OF02IRL58.29.14.B03.1.454.CMB.1.raw
  modified_base (146)..(146): a, c, t, g, unknown or other
  misc_feature (146)..(146): n is a, c, g, or t
  modified_base (209)..(209): a, c, t, g, unknown or other
  misc_feature (209)..(209): n is a, c, g, or t
  modified_base (269)..(269): a, c, t, g, unknown or other
  misc_feature (269)..(269): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcnctgagactctcctgtgcggcctctggatttaagttttaggagtcatgccatgaactgggtccnccaggctccgaggggaggggctgggagtgggtctcggcttattagtggcaggtggtggcnctatatattatgcagaccgccctaggaacgggtccgttcacctactttccgaagagacaagttcgaaagaaccacgcttagtatcctagactaaagtcgggaagtacgccgtggaacgaccgtccggaaccgaccgacccggtccgttacttaagttttattggttaaggttaaacgggcgtaaggtcgtagggaacggtacccggggacccggggacccggtacgttacgaccgtacggtacggggaccggacggggaccgtcgtcggtaccgtccgtcctccctcgaccgtcctacccgaccgacggccctacgtccgttcccgttccccgtcgccctacccctcctaccgacgaccgtacctacccggtccgtcgggaccacgacgcgccggccgtcggcgtccgg

SEQ ID NO: 40709 - DNA, 565 bp, Homo sapiens
  misc_feature: GYAE6OF02GKYKI.29.14.B03.1.454.CMB.1.raw
  modified_base (561)..(561): a, c, t, g, unknown or other
  misc_feature (561)..(561): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagcgtggaactaccgggaccggggcccgacttgaccgacgtggggccaggggacgcgtggtccaccgtctcctcacgcctccaccacggcccatccggtccttcccccgtcggccacccctcctccaacgacgccaccctctcggggcaccagcacgccctgggcctcgcctcggtacaaggtacctacttccacgttactctactctgagcggcgtggcaggccgntacg

SEQ ID NO: 40710 - DNA, 551 bp, Homo sapiens
  misc_feature: GYAE6OF02HA0ZW.29.14.B03.1.454.CMB.1.raw
  modified_base (442)..(442): a, c, t, g, unknown or other
  misc_feature (442)..(442): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (546)..(546): a, c, t, g, unknown or other
  misc_feature (546)..(546): n is a, c, g, or t
  modified_base (549)..(551): a, c, t, g, unknown or other
  misc_feature (549)..(551): n is a, c, g, or t
tcagatagagtactcacgaccggtgctcgatttagtgtgagtagtttgggggcgcctgggtacggccgggggggtcgctgagactctcctgtgcggcctcgtggattaagtttaggagtcatgccatgaactgggtccgccaggctccagggaaggggctggagtgggtctcggctattagtggcagtggtggcgctatatattatgcagacgccctgaagggccggttcaccatttccagagacaattccgaagaacacgctgtatctgcaaaatggagagcctgagactcgacgacacgccgtctattattgtgttaaaggcagctggaataccggggaccggggcccagttggaccacgtggggcccgagggggacgcgtggtcaccgtctcctcacgccctccaccaagggcccactcggtccttccccgtcggcccnccctcctccaagcgccacctcgcggggcacncgcncgcctcggctcgcctgcgacgactactccagtactactatcgtggacgcgggctggacgacggcgacanagnnn

SEQ ID NO: 40711 - DNA, 631 bp, Homo sapiens
  misc_feature: GYAE6OF02HZX5O.29.14.B03.1.454.CMB.1.raw
  modified_base (353)..(353): a, c, t, g, unknown or other
  misc_feature (353)..(353): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccgagggaaggggctgggaggtgggtctcggctattagtggcagtggtggcgctatatattatgcagaccgcctgaagggcccggttcaccatttccagagacaattcgaaagaacacgctgtatctgacaaatgganagcctgagactcgacgacacggtctctatttattgtagttaaaggcgagactaggaacgtacggggaccgggacccaacgttcgaaccgacgtggggacccgaggggacgcgtgggtcacccgtctcctccacgccctaccgaacccgaacgggcccacgttccggtcccttcccccgtcgggaccctaccccgttaccctccgtaacggacgtcccgtaaccgtccggtcgggggacctaccgaccggaccgaccggtccccgtcggggccgtccgg

SEQ ID NO: 40712 - DNA, 752 bp, Homo sapiens
  misc_feature: GYAE6OF02GVY6G.29.14.B03.1.454.CMB.1.raw
tcagatagagtactcacgaccggtgctcgatttagtgtgagtagtttagggttggggtccgagggccataggtgcagactcccagaggctctcctcctcctccgactggcacagggtctctctcccagcctgtcgctgactcgaatcgcccgtctggccctctcgcctccctgggacgtctcggtcaaggtccaccgtgtactcgtgacgcgagtggacacacgcacgctacgccatcgaccttggcatcagtcgaagtacggccaggaccgtaccgggtcccttacgttaacttcgactaggaacctaacgtacccaaaactacgtagtacgttggacgtacggtaccaacggaacggaccgggtaacgggggtaccgtacgttcccgtaggtactccgttcttccgtcgtacgtcctaccgagtccgtacgtacgggaccttcgaacgtccgaccttacctccgtaacgtacgtcccgtcccggtaccttaccgacggttaccgtagggacggtactacggtacgttacttacggttaaccttacgtttaccgtcgttaaccgtaaccggtaccgggtacggggaccttaacggttcggtactttaacgtttcggttacggggttccggttacccggggaaccgggtaacgtacggtcccgtacgggttccggtcggtaccgaccggacccggtaaccggccctaacccggtcgtccggtaccctaccgttcccgttcccttaccccccg

SEQ ID NO: 40713 - DNA, 561 bp, Homo sapiens
  misc_feature: GYAE6OF02IPN7J.29.14.B03.1.454.CMB.1.raw
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
tcagatagagtactcacgaccggtgctcgatttagtgtgagtagtttgagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggagggccggttcaccatttccagagacaattcgaagaacacgctgtatctgcaaatggagagcctgagactcgacgacacgggccgtctattattgtgttaaaaggcgagctggaatacggggaccgggcccgacttgaccactggggccaggggacgcgtggtcaccgtctcctcagccctccaccaacgggcccatcggtccttcccccgtcggccaccctcctcccaacgacgccacctccgtcgggggccacgacgcacgccctgggcctcgcctggtcaacggtactacttccacgtactctatcngtacgcgggntcggcaggcgcagtgc

SEQ ID NO: 40714 - DNA, 586 bp, Homo sapiens
  misc_feature: GYAE6OF02F2BFQ.29.14.B03.1.454.CMB.1.raw
  modified_base (314)..(314): a, c, t, g, unknown or other
  misc_feature (314)..(314): n is a, c, g, or t
  modified_base (464)..(464): a, c, t, g, unknown or other
  misc_feature (464)..(464): n is a, c, g, or t
  modified_base (582)..(582): a, c, t, g, unknown or other
  misc_feature (582)..(582): n is a, c, g, or t
tcagatagagtactcacgaccggtgctcgatttagtgtgagtagtttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaaggccggttcaccatttccagagacaattcgaagaacacgctgtatctgcaaaatggagagcctgagactcgacgacacggccgtntattattggtgttaaaggcgagctggaagtacgggaccgggccgacttgacccacgtcgggggaccaggggacgcgtggtccaccgtctcctcacgcctccacacggcccactcggtccttccccgtaggcccaccctcctaccaacgcnccacctcgtggggccacgacgccgacgcccgtgggcctcgccgtcggtacaacgtaccttaccgttccacgtacttacctatccgttagaccggcgggtcgtaggacgacggccgtanaacg

SEQ ID NO: 40715 - DNA, 812 bp, Homo sapiens
  misc_feature: GYAE6OF02HZE5R.29.14.B03.1.454.CMB.1.raw
  modified_base (146)..(146): a, c, t, g, unknown or other
  misc_feature (146)..(146): n is a, c, g, or t
  modified_base (208)..(208): a, c, t, g, unknown or other
  misc_feature (208)..(208): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcnctgagactctcctgtgcggcctctggatttaagttttggagtcatgccatgaactgggtccnccaggctcgagggaaggggctggagtgggtctcggctagttagtggcaggtggtggcgactatatattatgacagaccgccctgaacgggtccggtcacctatttccaagagaacaattcgaagaacacgctgtactctacgacaaagtggagacgcgtagacgtacgtcgaaccgacgaccgggtaccgttactaacgttttatttaggttaggtttaaacggacgtagtacgtacgggtaaacggtaaccgggggaacccccggggacccgtaaccgttacggaacccgtacgggtaccggggacccggacggggaccggtcgtacgggtacccgtaacccgttcctacccgtaccgtaccgaccccgttacccgtaaccccggaaacccggggtacccccgtaacgttaccccgggtttcccccgtttacccccccggtccggggtaaccccttacccccccgtttacccgttaacccccgtaaacggggaacccggtacccccgttaacccgggtcccggggtttaaccggggacccgaacccggtacggtacccggtaaccccggtacccccggggttccgggtccccgttacccgggg

SEQ ID NO: 40716 - DNA, 585 bp, Homo sapiens
  misc_feature: GYAE6OF02FGZL7.29.14.B03.1.454.CMB.1.raw
  modified_base (145)..(145): a, c, t, g, unknown or other
  misc_feature (145)..(145): n is a, c, g, or t
  modified_base (274)..(274): a, c, t, g, unknown or other
  misc_feature (274)..(274): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
tcagatagagtactcacgaccggtgctcgatttagtgtgagtagtttgggctgagctggctttttcttgtggctattttaaaaggtgtccagtgtgacgtgcagttggtggagtctggggcgcctgggtacggccgggggggtcnctgagactctcctgtgcggcctctggattaagttttaggagtcatgccatgaactgggtccgccaggctccagggagggctggagtgggtctcggctattagtggcaggtggtggcgtctatatattangcagacgccctggaacgggccgttcacctatttccagagacaattcgaagacacgctgtatctgacaagtgganagcctganactcgacgacacggcctctattattgtagttaaaggcagcgtaggaagtaccgggaccgggcccgtacgttcgaccgacgtcggggccgacggggacgcgtcggtccaccgtctcctcgacgccctaccacccgaacggcccacgttccgtcccttccccgtgacccaccctcctaccagtccgcctacccgtcgtcgggccacgacgccgacgcccgtggtcgtccgg

SEQ ID NO: 40717 - DNA, 587 bp, Homo sapiens
  misc_feature: GYAE6OF02IKBA5.29.14.B03.1.454.CMB.1.raw
  modified_base (145)..(145): a, c, t, g, unknown or other
  misc_feature (145)..(145): n is a, c, g, or t
  modified_base (373)..(373): a, c, t, g, unknown or other
  misc_feature (373)..(373): n is a, c, g, or t
tcagatagagtactcacgaccggtgctcgatttagtgtgagtagtttgggctgagctggcttttcttgtggctattttaaaaggtgtccagtgtgacgtgcagttggtggagtctgggggcgcctgggtacggccgggggggtcnctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtntattattgtagttaaaggcgagctggaagtacggggaccggggcccgacgttcgaccacgtcgggccgaggggacgcgtggtccaccgtctcctcacgcctaccaccgaacgggcccacgtccggttccttcccccgtcggccctaccctccctacccgaacgcgaccaccctccggtcggggaccacgacgaccgacgcccgtcgggctccgg

SEQ ID NO: 40718 - DNA, 654 bp, Homo sapiens
  misc_feature: GYAE6OF02GR4ON.29.14.B03.1.454.CMB.1.raw
  modified_base (297)..(297): a, c, t, g, unknown or other
  misc_feature (297)..(297): n is a, c, g, or t
tcagatagagtactcacgaccggtgctcgatttagtgtgagtagtttggtgggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcacattccagagacaattcgaagaacacgctgtatctgacaaatggagagcctganactcgacgacaccggccgtctaattatgtagttaaaggcgagcgtaggaagtaccggggaccggggcccgacgttcgaacccaggtcggggccagggggaccgcgtcgggtcacccggtcctccacgacgccctcccaaccgaaccgggcccacgtcccggttcccttcccccgttcggacccctacccccgttcctacccgaaacgacgtacccgtaccgtccggtcggggaccacgtacggccgtacgcccgtgggccgttcgtcccgtcggtaccgaacggtacctaccttccgtaacgtccttaccgttatccgtaggacggcgggtacgtggaccgaagggccgacgtaacg

SEQ ID NO: 40719 - DNA, 607 bp, Homo sapiens
  misc_feature: GYAE6OF02G32QJ.29.14.B03.1.454.CMB.1.raw
  modified_base (385)..(385): a, c, t, g, unknown or other
  misc_feature (385)..(385): n is a, c, g, or t
  modified_base (496)..(496): a, c, t, g, unknown or other
  misc_feature (496)..(496): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcctctattattgtgtaaaggcgagctggaatacggggaccgggccacgttcgaccgacgtcggggccaggggacncgtaggtccaccgtctcctcacgcctccaccgaacgggccccacgtccggtcccttccccgtcggccctacccctccctccgaacgacgccaacctcgtcggggaccacgngccgagcccgtgggcctcgccgtcggtacaacgggtaccttaccgttccgtacgtaccttccttaatccgttcggacggtccgggtcgtcgggacgaacggtccgacgtag

SEQ ID NO: 40720 - DNA, 583 bp, Homo sapiens
  misc_feature: GYAE6OF02HEW3C.29.14.B03.1.454.CMB.1.raw
  modified_base (581)..(583): a, c, t, g, unknown or other
  misc_feature (581)..(583): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccggggcccgacttgaccacgtcggggccagggggacgcgtggtcaccgtctcctcacgccctccacccgaacgggcccacgtccggtcctcccccgtcggccctaccctcctaccaacgacgccacctcgtcggggccacgacgcacgcccgtcgggcctcggccgtcggtcaacggtacctaccttccacgttaccgtctactctcgacgcgggcgtcggacgacggccgcgagtcgnnn

SEQ ID NO: 40721 - DNA, 604 bp, Homo sapiens
  misc_feature: GYAE6OF02HHHM2.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaagtacggggaccgggccgacttgaccagtcggggccagggacgcgtggtccaccggtctcctcacgcctccaccaacgggcccagtccggtccttcccctcggccaccctcctccaacgacgccaccgtcgtcggggcacgacgaccgacgcccgtgggcctcgtcccgtcggtaccgaacgggtacctacccgttccgaacgttaccttccttaactccgtacggacggccgggtcgtcggaccgaacgggtccgactacg

SEQ ID NO: 40722 - DNA, 563 bp, Homo sapiens
  misc_feature: GYAE6OF02HUHVV.29.14.B03.1.454.CMB.1.raw
  modified_base (145)..(145): a, c, t, g, unknown or other
  misc_feature (145)..(145): n is a, c, g, or t
  modified_base (207)..(207): a, c, t, g, unknown or other
  misc_feature (207)..(207): n is a, c, g, or t
  modified_base (259)..(259): a, c, t, g, unknown or other
  misc_feature (259)..(259): n is a, c, g, or t
  modified_base (350)..(350): a, c, t, g, unknown or other
  misc_feature (350)..(350): n is a, c, g, or t
  modified_base (463)..(463): a, c, t, g, unknown or other
  misc_feature (463)..(463): n is a, c, g, or t
  modified_base (502)..(502): a, c, t, g, unknown or other
  misc_feature (502)..(502): n is a, c, g, or t
tcagatagagtactcacgaccggtgctcgatttagtgtgagtagtttgggctgagctggcttttcttgtggctattttaaaaggtgtccagtgtgacgtgcagttggtggagtctgggggcgcctgggtacggccgggggggtcnctgagactctcctgtgcggcctctggattaagttttaggagtcatgccatgaactgggtccnccaggctccagggaaggggctggagtgggctcggctattagtggcagttggnggcgctatatattatgcagacgcccctagaagggccggttcaccattttccagagacaatttcgaagaacacgctgtatctgcaaatgganagcctgagactcgacgacacgcgtctattattgtagttaaggcgagcgtaggagtacgggaccgggccgacgttgaccacgtgggccgagggacgacgtggctaccgtctccncgagcctaccaccacggccagtccgtcctcccgtcgccnccctcctacctaacgacgccaaccgtccgtaggggaccacgacgcgacgcccgtggctcgg

SEQ ID NO: 40723 - DNA, 633 bp, Homo sapiens
  misc_feature: GYAE6OF02IWFN3.29.14.B03.1.454.CMB.1.raw
tcagatagagtactcacgaccggtgctcgatttagtgtgagtagtttgggctgagctggcttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctgggagtgggtctcggctattagtggcagtggtggcgctatatattatgcagaccgcccctgaacggggcccggttcaccatttcccagagacaattcgaagaacacggctgtatctgcaaatggagagcctgagactcgacgacacggccgtctaattagttgtaggttaaaaggccgaagccgtaggaacgtaaccggggacccgggggccccgtaccgttcgaccgacgtcggggacccgacggggacggcgtgggtccgaccgtcctccctcacgccctcccaccgaacgggcccgacgtccggttaccttcccccgtcgcccgtacccctccctacccgtaacgacgaccgtacccgtcggtacggggtaccacgacgccgacgtcccgtcgggcctccgg

SEQ ID NO: 40724 - DNA, 888 bp, Homo sapiens
  misc_feature: GYAE6OF02JWCK1.29.14.B03.1.454.CMB.1.raw
  modified_base (209)..(209): a, c, t, g, unknown or other
  misc_feature (209)..(209): n is a, c, g, or t
  modified_base (885)..(885): a, c, t, g, unknown or other
  misc_feature (885)..(885): n is a, c, g, or t
tcagatagagtactcacgaccggtgctcgatttagtgtgagtagtttgggggtcgccgtgggtacggccggggggtcggcgtgagactctcctgtgcggcctctggattaagtttaggagtcatgccatgaactgggtccgccaggctccagggagggctggaggtgggtctcgggctagttagtggcaggtcggtggacgcgtatatnttatggcagaccgcccttaggaagggccggttcaccatttccagagacaattcgaagacacgctgtatctagacaaatggaagagcccgtagacgacctcggaaccgacgaaccggtccgtctaagttactttcggtagttaaaaacgggcgtaggtacgttagggaaggtttaaacccgggggaccccgggggtacccctacgggtttaaccgggaacccctaacgggggttaccggggggaccccgtaaaggggggggaaccccgtcggttttaccggggggtacccaaaacccccgggttttcggtacccccgttaacccgggtaaaccggtcccccccggttaccccaaaacccgggtaaacccgggggttcccccgaaccggtttacccccgggttaccccgttttaccccccccggttcccgggtacccccgtaaccccccgttacccccgtaaccccgttaaacccggaccgtacccaacccgtttcccgggccggggtacccgaccgtaccgccgtaccgggcccgtacgggtccgaccgtcccgttacggtaccgtaaccgggtaaccgtaccgttacccgtacgttaccggtaccttacgtttacgtccggtacggtaccgggtaccggtggacccggtaccggtcgacggtacgtacggacgtancgg

SEQ ID NO: 40725 - DNA, 789 bp, Homo sapiens
  misc_feature: GYAE6OF02GPAQR.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaacgggccggttcacctatttccagacgacaattacgaagaacacgctgtatctgacgaaagtcggaagacgccgtaggaacgtaccgtacggaaccgaccgacccggtcccgttcttaactttagtttgttaaggtttaaagggcgtaagcgtagggtaaacggtacccgggggaccggggacccgtaccgttcggaacccgtacggtcggggccggacggggacgcggtcggtaccacccgtcctccctccgacgccctacccgaacccgaaccgggcccctacggttcccggtccccttccccggacggtcccctaccccctcccctaacccgaaacggaccctacccgtaccccgttccgggtaccggggtaccaacccgacggacccgtacccgggtcccggtccggggtacctccgggtaccggttcggtaaccgaaccgggttacccctttaccgtaccccgttaacggttaacccttaccgttaccgtccgttaacgggacccggtccgggttaccggtacccgggacggtaacgggtccccggaagtaacg

SEQ ID NO: 40726 - DNA, 661 bp, Homo sapiens
  misc_feature: GYAE6OF02JG4L3.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccgttcaccatttccagagacaattcgaagaacacgctgtatctgacaaatggagagcctgagactcgacgaacgacggccgtctattatgtagttaaaggcgagctggaactacggggaccgggccacgttcgaccaacggtcggggaccgacggggacgcgtggtccaccggtcctccgtcacgcctccaccgaacgggcccacgtccggtccttcccccgtgccctacccctcctaccaacggcgacccacccgtcgtcgggggcctacgacgaccgaccggcccgtcgggtccgtccggcccgttcggtaccgtaaacgggtaacccgttaccgttacccgtaacggtacccttaccgttaccttcgttaccggaacggcccggggtccggtacgggtaccggtaacgggccggacgtaacgg

SEQ ID NO: 40727 - DNA, 618 bp, Homo sapiens
  misc_feature: GYAE6OF02IV884.29.14.B03.1.454.CMB.1.raw
  modified_base (602)..(602): a, c, t, g, unknown or other
  misc_feature (602)..(602): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctggggtacggccggggggggtcgctgagactctcctgtgcggcctctggattaagtttttaggagtcatgccatgaactgggtccgccaggctccgaggggaaggggctggagtgggtctcggctattagtggcaggtggtggcgctatatattatgcagaccgcccctaggaacggggcccggttcaccatttccagacgacaattcgaaagaacacgctgtatctgacaaagtggagacgcctaggacgactcggacaccgaccggtccgttacttattattgtaggtaaaggcgagtcgtaggaacgtacgggacccggggccgtacgttcgaccacggtcggggaccgaggggacgcgtcggtccaccgtcgtcctcgacgccctacccaccgaacggcccgtacgtccggttcctccccgtcggccctaccctccctaccgaacgcgccaccgtcggtcgggcacgcgaccncgtcccgtcggcgtcg

SEQ ID NO: 40728 - DNA, 668 bp, Homo sapiens
  misc_feature: GYAE6OF02F84VU.29.14.B03.1.454.CMB.1.raw
  modified_base (123)..(123): a, c, t, g, unknown or other
  misc_feature (123)..(123): n is a, c, g, or t
  modified_base (208)..(208): a, c, t, g, unknown or other
  misc_feature (208)..(208): n is a, c, g, or t
  modified_base (379)..(379): a, c, t, g, unknown or other
  misc_feature (379)..(379): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcncctgggtacggccgggggggtcctgagactctcctgtgcggcctcgtggattaagttttaggagtcatgccatgaactgggtccnccaggctccgagggaacgggctgggagtgggtctcggctattaggtggctaggtggtggcgctagtattattatgcagaccgcctaggaacgggtccgttacacgtactttccgagaacgactaagttacggaaagtaaccacgtctagtactctaggactaaagtggaanacgacctgaacgtctacgacgaacgccggtaccgttctaagttagttcggttaaggttaaacggcgaagtcgtaggtaacggtaccggggacccgggtcccgtacgttcgaccgtacggtacggggaccgaggggacgtcgtcggtaccaccgtcctccgtcgacgccctaccgaaccgaccggcccacgttcccggtcccttaccccgcggtcccaccctcctaccgacgcccgacctacccgtcggtcgggaccacgtacgccgaccggtcccgtcgggtcctccgg

SEQ ID NO: 40729 - DNA, 610 bp, Homo sapiens
  misc_feature: GYAE6OF02FU95N.29.14.B03.1.454.CMB.1.raw
  modified_base (145)..(145): a, c, t, g, unknown or other
  misc_feature (145)..(145): n is a, c, g, or t
  modified_base (278)..(278): a, c, t, g, unknown or other
  misc_feature (278)..(278): n is a, c, g, or t
  modified_base (371)..(371): a, c, t, g, unknown or other
  misc_feature (371)..(371): n is a, c, g, or t
tcagatagagtactcacgaccggtgctcgatttagtgtgagtagtttgggctgagctggcttttcttgtggctattttaaaaggtgtccagtgtgacgtgcagttggtggagtctgggggcgcctgggtacggccgggggggtcnctgagactctcctgtgcggcctctggattaagttttaggagtcatgccatgaactgggtccgccaggctccgaggggaaggggctgggagtgggtctcggctattagtggcaggtggtggcgctatatattangcagacgccctgaagggccggttcaccatttccagagacaattcgaagaacacgctgtatctgacaaagtggagagcctgagactcgacgacncggctctatttattgtagttaaaggcgtagcgtaggaacgtacggggacccggggcccgacgttacgaccgacgtcggggccgaggggcgcgtcggtcaccgtctcctcgacgtccctaccacccgacggcccacgtccgttccttccccgtcgcccgtacccctccctacccgaacggacgacccgtacccgtccggtcggggccacgtaccgccgacggtccccgtcggtcgtccgg

SEQ ID NO: 40730 - DNA, 530 bp, Homo sapiens
  misc_feature: GYAE6OF02FTFEQ.29.14.B03.1.454.CMB.1.raw
tcagatagagtactcacgaccggtgctcgatttagtgtgagtagttccgcgggggcaggagtcagacccactcaggacacagcatggacatgagggtccccgctcagctcctggggctcctgctgctctggctcccaggtgccagatgtgccatccagatgacccagtctccatattccctgtctgcatctgtaggagacagagtcagcatcacttgccgggcaagtcaggacatccgaaatgagataagctggtatacaacagaaaccagggaaacctaccaacctcctgatctatgctgcgtccagtttacaagtggggtccatcacggttcagcggctagtggatcgtggccacgtagtactttcactctccaccatcagcacgcctcgcacgccgtagaacgttatttgaccttaatttactacttgtactactaagtacttaactacttacagttaggtacgttacggaccgtaagggaccgaacggtaagaactacgaacgtacgtgtacggcttagctaaccg

SEQ ID NO: 40731 - DNA, 635 bp, Homo sapiens
  misc_feature: GYAE6OF02I9SSF.29.14.B03.1.454.CMB.1.raw
  modified_base (147)..(147): a, c, t, g, unknown or other
  misc_feature (147)..(147): n is a, c, g, or t
  modified_base (209)..(209): a, c, t, g, unknown or other
  misc_feature (209)..(209): n is a, c, g, or t
  modified_base (366)..(366): a, c, t, g, unknown or other
  misc_feature (366)..(366): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctggggtacggccgggggggtcnctgagactctcctgtgcggcctctggattaagttttaggagtcatgccatgaactgggtccnccaggctccgagggaaggggctggagtgggtctcgggctattaggtggcaggtggtggcgactatatattatgcagacgccctggaagggccggttacacctattttccgaagagaacaattcgaaagaaacacgctagtatcgtgacaaagtgganacgtcctgagactacgacgacacggcgtactattattcgtaagttaaggcgagtcgtaggaaacgtaccggggaccgggacccggtactgaccgtacgtcggggccgaggggacgcgtagtccgaccgtcctcctacgctccctaccgaccgaacgggaccctacgtcccgttccccttccccgtaccggccctaccccttacccgtaccaacggtccgccctaaccgtccggtacgggcacgacgaccgcgcccggtggtccgtacgg

SEQ ID NO: 40732 - DNA, 966 bp, Homo sapiens
  misc_feature: GYAE6OF02IAJT9.29.14.B03.1.454.CMB.1.raw
  modified_base (277)..(277): a, c, t, g, unknown or other
  misc_feature (277)..(277): n is a, c, g, or t
  modified_base (547)..(547): a, c, t, g, unknown or other
  misc_feature (547)..(547): n is a, c, g, or t
tcagatagagtactcacgaccggtgctcgattttagtgtgagtagtttaggggtggagtcgtgggggccgcctcgggtacgggccgggggggttcgcgtgttacgacttcgtcctgtgcgggccttcgtaggattaagttttaggaacgttccaatgccgattggaactgggtaccgcctagggctttccgtagggaaggggtctaggtaaggttgggtctcgggcttagttaggtggactaggtgggttaggcgtcgtaaggtagtacgtttaagngaccaggtacccgtcccgggtaggaacgggcccggtttaccaccgtaagtttcccgaaggaacggactaaccgtttacggaaacgtaaccaccgttcctaaggtaacttccgtagaccaaaattcggaacgacgtccgtacgacgtacgtcgaccggaacggaccgggtcgttacgagtttagttacgtaggttaaacggcggtaggtcgtaaggtaacgtacggggaccgggccctaagttcgaaccgtacggcggggaccagggtacncggttcggtaccgaccgttcaccctagacccgtcgacgaccgtaaccggtccctaacgtacccggtacctaccccgtcgtaacccgtacccgttaccgtacccgaaacggtaccgtaccgacccgttaccggtacggggacccaacgggtaacccggaccgggtaacccgtaccccgggtacggttacccgttaacgggttacccggtttaaccggttaacccgggtaaacggtttaacccggttaacccggttttacccggtaaaccgggttttaacccggttaacccggtttaaaccggtaaccccgggttttaacggggaacccggggggtaccccgggggttaaacccgggttaccccggggaaaaccggggtttaacccccggggtacccggttaacccccgggttaaacccgg

SEQ ID NO: 40733 - DNA, 700 bp, Homo sapiens
  misc_feature: GYAE6OF02FGRLQ.29.14.B03.1.454.CMB.1.raw
tcagatagagtactcacgaccggtgctcgatttagtgtgagtagtttcggtgggagtctggggacgccgtgggtacggccggggggtcggctgagactctccgtgtgcggcctcctggattaagtttaggtagtctattgccatggaactgggtccgcgaggcctaccgagggaaggggtctgggagtgggtcctcggctattagtcggccagtcggtggcgcttatagtattagtggccagacgccctagaagggccgttacaccattccagagtacttaatcgaagacacgactagtattctgctaaagttcggagacgctagacgactcgacgacacggccgtctattatgtagttaaaggcgagtcgtaggaacgttaccggggaccgggccacgttcgacccagtcggggcccaaggggccgtcgtgggtacacccgttctccctacgacgtccctaccgaccgaacgggcccaacgtccggtcccttccccgtcggaccctaccccgtcctaccgagacgtccctaaccgtcggtttaggggacctacggacgtccgaacgtacccgttagggtccttccggtccctacggttaccaaacggggtcccttaccgtaaccgtaacggttacctaccgtaacgtttaaccgacggtaacggtcgggtacctcggggacgacggtccgtagtaacgg

SEQ ID NO: 40734 - DNA, 717 bp, Homo sapiens
  misc_feature: GYAE6OF02HT61C.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgcaggctccagggagggctggagtgggtctcggctattagtgggcaggtggtggcgctatatattatgcagacgcctgaacgggccggttcacatttccagagacaattcgaagaacacgctgtatctagacaaagtggagacgcctgacgactcggaacgacaccggtccgtactagtttaacttaggtaggtttaaaaggcgaagtccgtaagggaacgtaacgggggaaccccggggacccggtacgttcggaaccgacggtcggggaccggacggggaaccggccgttcgggacgtacccgtcctcccgtaccgtacgccccgtacccgaacccgaaaccggggaccccgtaaccgttaccggtttccccgttcccccgtccgggtcccgtaccccccgttaccccgtacccgaaacggtaaccgtacccgtaacccgttccgggtaccgggggaccaaccggacggtacccgacccgggtccccggttacggggtccctaccggg

SEQ ID NO: 40735 - DNA, 655 bp, Homo sapiens
  misc_feature: GYAE6OF02G4NK2.29.14.B03.1.454.CMB.1.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
tcagatagagtactcacgaccggtgctcgatttagtgtgagtagtttgggctgagctggcttttcttgtggctattttaaaaggtgtccagtgtgacgtgcagttggtggagtctgggggcgcctggggtacgggccggggggggtcgctgagactctcctgtgcggcctctggattaagttttaggagtcatgccatgaactgggtccgccaggctccgagggaaggggctggagtgggtctcggctattagtggcagtggtggcgctatatattatgcagaccgccctaggaacgggtccggttcactacttccagagacaattcgaaagaaccacgntgtatctgacaagtggagngcctggagactacgaccgacgacggccgttctaatttagttgttaggttaaaacggcgtaagtcgtagggtaaagtaccgggggaccggggaccccggtacgttacgaccgacggtcggggccggtaggggcgtacgtcggtcgaccgtcctcctcgacgcccgtacccaccgacggcccacgttccggtcccttcccccgcggtccctacccccgttccctacccgacggtaccgacctaccggtcggtaccggggacaccgtacgccgtaccgtcccgggtacgggcctaccgg

SEQ ID NO: 40736 - DNA, 687 bp, Homo sapiens
  misc_feature: GYAE6OF02J07K6.29.14.B03.1.454.CMB.1.raw
  modified_base (324)..(324): a, c, t, g, unknown or other
  misc_feature (324)..(324): n is a, c, g, or t
  modified_base (676)..(676): a, c, t, g, unknown or other
  misc_feature (676)..(676): n is a, c, g, or t
tcagatagagtactcacgaccggtgctcgatttagtgtgagtagtttgggtttagggggcgcctgggtacggccggggggtcgctgagactctcctgtgcggcctctggattaagttttaggagtcatgccatgaactgggtccgccaggctccgaggggaaggggctggaggtgggtctcggctattagtggcaggtggtggcgctatatattatgcagacgccctggaacgggccggttcacctatttccagagaacattcgaaagaacacgctagtatactgacaaagtggagacgcctgagactcgacgacacggccgtntattatgtagttaaaggcgagctaggaagtaccggggaccggggcccgtaacgttcggaccgacggtcgggggaccgaacgggggaccgtcggtcggtaccgaccgttcccgtcccgtccgacgcccgtaccgacccggaaccggggtccccaggtcccggttcccctttccccccggtacggcccctaaccccgtcccttaccgaaacggtcgacccgtacccgtcgggtcggggaccaacgtacgaccggaccgtcccggtcggcctcggccgttacgacgtaacggtaccttccgttaccacgttcctagtactcgacgggcgccgggtacgtgggaaccgaggtccgngtatcggatcg

SEQ ID NO: 40737 - DNA, 810 bp, Homo sapiens
  misc_feature: GYAE6OF02GN0DV.29.14.B03.1.454.CMB.1.raw
  modified_base (804)..(804): a, c, t, g, unknown or other
  misc_feature (804)..(804): n is a, c, g, or t
tcagatagagtactcacgaccggtgctcgatttagtgtgagtagtttgggggcgcctgggtacgggccgggggggtcgctgagactctcctgtgcggcctctggattaagtttagagtcatgccatgaactgggtccgccaggctccagggaaggggctggagtgggtctcggctattagtggcagtggtggcgctatatattatgcagacgccctgaaggccggttcaccgatttccagagacaattcgaagaacacgctgtatctagcaaatggagagcctgacgacgtcgacgacacggtcccgtatagtttaacttgtaggtttaaaaggccgaggccttagggaactaaccggggtacccgggggaccccgtaagtttccggaacccgacgttacgggggcccctaaggggggacggtcctaggggttaccaaacccggttcttaccccgttcgaaaccgtccccttaccccgaaaccccgtaaaggggggcccccctaacgttacccggggttaccccgttttaccccccccggttaggggtacccccgtaaaccccccgtttccccgttaaccccgtaaaacgggtaccgtacccgaaccccggtttaccggtacgggggggtacctaacccgtaacgggacccgaacggaccccgttggggtacccgtcggtacccgttagggtaccgtaaacgggtaacccgttaaccgttaccgtaacgttaccttacctagttcgttaacggacgggaccggggtcgtacgggtaccgtaacggccggtaaccgaagtacggntatacg

SEQ ID NO: 40738 - DNA, 580 bp, Homo sapiens
  misc_feature: GYAE6OF02G1CJH.29.14.B03.1.454.CMB.1.raw
  modified_base (388)..(388): a, c, t, g, unknown or other
  misc_feature (388)..(388): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaagcgagctggaacgtacgggaccgggcccgacgttgaccacgtcggggccaggggacncgtcggtcaccgtctcctcgacgccctaccaccgaacggcccactcggtccttcccctcggccacccctcctaccaacgcgcctaccgtcgtcggggcacgcgcacgcccgtggctcgccgtggtcgaaggactaccgtcgacgtacttactacgtcgtcgtacggcggtcgtcggacgtacggccgatacg

SEQ ID NO: 40739 - DNA, 675 bp, Homo sapiens
  misc_feature: GYAE6OF02JUYUP.29.14.B03.1.454.CMB.1.raw
  modified_base (296)..(296): a, c, t, g, unknown or other
  misc_feature (296)..(296): n is a, c, g, or t
  modified_base (413)..(413): a, c, t, g, unknown or other
  misc_feature (413)..(413): n is a, c, g, or t
  modified_base (567)..(567): a, c, t, g, unknown or other
  misc_feature (567)..(567): n is a, c, g, or t
  modified_base (642)..(642): a, c, t, g, unknown or other
  misc_feature (642)..(642): n is a, c, g, or t
tcagatagagtactcacgaccggtgctcgatttagtgtgagtagtttgggctgagctggcttttcttgtggctattttaaaggtgtccagtgtgacgtgcagttggtggagtctgggggcgccgtggggtacggccgggggggtcgctgagactctcctgtgcggcctctggatttaagttttaggagtcatgccatgaacgtggtccgccaggctccgaggggaacggggctagggaggtgggtcgttcggcttaagtttaggtcgggctaggttcgggtggccgtcttaagttntattatcgcagaccgcccgtggaacgggtccgttacacctactttccgagacggactaattccggaaagaaccgacgctgtacttccgtagaccaaagtggacgagcgtagacgacncggtacgaccgacggtcctacgttatttacgttgtaacggttaacggcgtagtcggtaggacgggtacgggacccggggtcccgtacgttcggaccgacgggtcgggccggaacgggcggtacgtcggtccgtcccgtctccctacgcgtcccnccaccggacgcccgtacgtccgtccctccgccgcctaccctcaccgacgaccggtcctccgtaccggtcggaccncggtacgaccgccggaccgttcggccgtaccgg

SEQ ID NO: 40740 - DNA, 608 bp, Homo sapiens
  misc_feature: GYAE6OF02HSVJX.29.14.B03.1.454.CMB.1.raw
  modified_base (607)..(607): a, c, t, g, unknown or other
  misc_feature (607)..(607): n is a, c, g, or t
tcagatagagtactcacgaccggtgctcgatttagtgtgagtagtttgggggcgcctgggtacgggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaagtggagagcctgagactcgacgacacggccgtctattatttggtagttaaaggcgagcgtaggaagtacggggaccggggcccgacgttggaccacgtggggcccgaagggggacgcgtcggtcacccgtctcctcacgcctccacgaacgggcccagtccgtccttcccccgtcggcctaccctcctaccaacgtacgcctaccttcggtcggggacacgacgcgaccgccgtcggctcgccgtggtaccaacggtacctacgttaccacgttacctcgtactccgtggtacggcggtccgtacggaccgtagggccgacacggtagcgtnc

SEQ ID NO: 40741 - DNA, 604 bp, Homo sapiens
  misc_feature: GYAE6OF02FZVCS.29.14.B03.1.454.CMB.1.raw
  modified_base (602)..(603): a, c, t, g, unknown or other
  misc_feature (602)..(603): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtgttaaaggcgagctggaagtacggggaccggggcccgacttcgaccacgtcggggccgaggggactcgtggtccaccgtctcctcacgccctccaacccgaagggcccacgtccggtcccttcccccgtcggccctacccctccctaccgaacgacgccaccgtccgtcgggggcaccgacgcacgcccgtcgggcctcgcctggtaccgacggacctacgtcctagtactcgttactcgtacggacggtccgggtacgtcggacgtaacgggccgacgtagtaganng

SEQ ID NO: 40742 - DNA, 797 bp, Homo sapiens
  misc_feature: GYAE6OF02IN1PG.29.14.B03.1.454.CMB.1.raw
  modified_base (794)..(794): a, c, t, g, unknown or other
  misc_feature (794)..(794): n is a, c, g, or t
tcagatagagtactcacgaccggtgctcgatttagtgtgagtagtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaatggagagcctgagactcgacgacacggccgtctattattgtagttaaaggcgagcgtaggaacgtacgggggacccggggacccgtaacgtttcggaaccctacggtcgggggacccgaaggggggaccgtccggttcgggttccgaacccggttccgttcccgttccgaacggtccccttaccccgaaacccggtaaccggggacccctaacgttcccgggtttaccccgttttcccccccgttcgggtacccctacccccgttaccccgttacccgaaacggtaccgtacccgtaaccccgttacccggttaccgggggggaccctaaccgaaccggaccgaaccgggtccccggttcggggtcccgttccgggtacccgttacgggttaaccgtaaaccggggtaacccgtttaaccgttacccgtaacgtttaacccttaccgttaacgttccgttacggaccgggtaccggggtaccgttacgggaccggaacgggccggaccgtaacgttaggcngac

SEQ ID NO: 40743 - DNA, 865 bp, Homo sapiens
  misc_feature: GYAE6OF02HUAWU.29.14.B03.1.454.CMB.1.raw
  modified_base (320)..(320): a, c, t, g, unknown or other
  misc_feature (320)..(320): n is a, c, g, or t
tcagatagagtactcacgaccggtgctcgatttagtgtgagtagtttggtggagtctggggggcgcctgggtacgggccggggggggtcgctgagactctcctgtgcggcctcgtggaagttaaggttttaggagtcatgccatgaactgggtccgccaggctccgaggggaaggggctggagtgggtctcggcttagttagttgcaggtggtggcgctatatattatgacaggaccgcctaggaacggggtcccggttaccacctatttccaagaacgacaattcgaaagaacacgctagtatctgacaaatggagacnccgtggaacgactcgggaaccaccgaccgggtccgtacttaagttttattgggtttaacggttaaaacgggccgtaaggtccggtttaggggaaaacggttacccgggggggacccggggtaccccgtaagttccggaaaccgaccggttacgggggggaccgaacggggggaccgtcggttacgggttaccgtaccccggttccctttacccggtaccgaaccgtcccctacccggtaaacccggaaaccgggggtaccccctaagggttccccggttttaccccgttccccccggttacgggaccccttacccccttaccccgtacccggaaaaggacccgttaacccacccggttccgggtaccgggggaccgtaaccacgggtacccgaccggtcccggttggggtccttaccggtcccggttagggtaacccgaacggttaccctttaccgtaccgttaaccggtaccttacccggttatacccgggttgggaccggtaccgggcggtaagggtaacccgtacgggtacgtacctaaggg

SEQ ID NO: 40744 - DNA, 742 bp, Homo sapiens
  misc_feature: GYAE6OF02HN3DT.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaagggcgagcgtaggaacgtaccggggacccggggccccgtacgttcgaacccgacgtgggggcccgaagggggaccgcgttcggtacctacccgtcctccctaccacgccctacccgaacccgaacggggcccccaacgttcccggttccctttcccccccgtacgggtcccctaaccccccgttccctacccgtaaacggaccgaccccgtaccgtccgggtacgggggtcccaacggaccgccgtaacccggtccccgtacggggtccgttccggcccgttacgggtacccgaaacgggtacccttacccgttacccgtaaccgggtttaaccttccgtttaacttccggttacggtaccgggtacccggggtccgtaccgggaccggaaccgggacggaccgtaacgg

SEQ ID NO: 40745 - DNA, 780 bp, Homo sapiens
  misc_feature: GYAE6OF02JV3TP.29.14.B03.1.454.CMB.1.raw
  modified_base (122)..(122): a, c, t, g, unknown or other
  misc_feature (122)..(122): n is a, c, g, or t
  modified_base (147)..(147): a, c, t, g, unknown or other
  misc_feature (147)..(147): n is a, c, g, or t
  modified_base (255)..(255): a, c, t, g, unknown or other
  misc_feature (255)..(255): n is a, c, g, or t
tcagatagagtactcacgaccggtgctcgatttagtgtgagtagtttgggctgagctggcttttcttgtggctattttaaaggtgtccagtgtgacgtgcagttggtggagtctggggggcncctggggtacggccggggggggtcnctgagactctcctgtgcggcctctggatttaagttttaggagtcatgccatgaactgggtccgccaggctccgaggggaagggctggagtgggtctcggctattaggnggcaggtggtggcgtctatatattatgacagaccgccgtggaacgggtccggttacacctatttaccgagaacgtacgaattaccggaaagaaccgacgcttaggtactcgtagacaaagtcgggaatacggtccgtagacggacctccggaaccggaccgaaccggtaccgtttcgttaagtttagttacggttaagttaaacggcgaggtccgtaaggacggttaccggggacccggggacccgtaacgttaccgaccgacggtacggggacccggaagggggccgtcggtcggtacccgtaccgttccgtccgtccgacgtacccgtaccgtaaacccggacccgggcccgttaccggttacccgtcccgtttacccccgtcgggtaccccctaccccgtacccttaccggaaaccgtaccggtacccgttaacccgggttcccggggacccggggtacccgtaaccggtacccggtaccggtacccgggtccccgggttaccgggttcccgggtacccggg

SEQ ID NO: 40746 - DNA, 641 bp, Homo sapiens
  misc_feature: GYAE6OF02H8UN7.29.14.B03.1.454.CMB.1.raw
  modified_base (385)..(385): a, c, t, g, unknown or other
  misc_feature (385)..(385): n is a, c, g, or t
  modified_base (637)..(637): a, c, t, g, unknown or other
  misc_feature (637)..(637): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggtccgtctattattcgtagttaaaggcgagcgtaggaagtacggggaccggggcccgacttggacctacgtcgggccagggggacncgtggtcaccgtctcctcacgccctccaacgaacgggcccaacgtccggtcctttcccccgtggccctaccctccgtaccaacgacgccaaccgtcggtacggggctacacgcaccgtccgtcgggcctcgcccgtggtacgtaacggtaccttacgttccgacgttacccttcgttaactccggttaacggacggtccgggtaccgttacgggaccgtaaacgggcccgtaacggaacgtttaggtaccgngtcg

SEQ ID NO: 40747 - DNA, 541 bp, Homo sapiens
  misc_feature: GYAE6OF02GMHDQ.29.14.B03.1.454.CMB.1.raw
  modified_base (452)..(452): a, c, t, g, unknown or other
  misc_feature (452)..(452): n is a, c, g, or t
  modified_base (538)..(538): a, c, t, g, unknown or other
  misc_feature (538)..(538): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggacgggccgacttgacactggggccaggggacgctggtcaccgtctccctcagcctccaccaacgggcccacgtcggtcttccccctggccaccctcctcccaanacgcacctcgtggggccacgagcagccctgggctgcctggtcacgactacttccacgtctacttatctgagcgggctggcaaggcncag

SEQ ID NO: 40748 - DNA, 680 bp, Homo sapiens
  misc_feature: GYAE6OF02FTRVK.29.14.B03.1.454.CMB.1.raw
  modified_base (275)..(275): a, c, t, g, unknown or other
  misc_feature (275)..(275): n is a, c, g, or t
  modified_base (501)..(501): a, c, t, g, unknown or other
  misc_feature (501)..(501): n is a, c, g, or t
  modified_base (677)..(677): a, c, t, g, unknown or other
  misc_feature (677)..(677): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccgagggaaggggctggaggtgggtctcggctattagtggcagtggtggcgctatatattatgcagacgccctggaaggccgttcacctactttccagagacaacttacgaagaacacgctgtactctnacaaatggagagacctagacgtactacacggacgccggaccgttactattagttagttagttaaaggcggaggtcgtaggaaggtaccggggacccgggcccgtacgtcgaccgtacgcgggccgacggggacgcgtcggtaccgtaccgtcctcctcgacgccctaccgaccgaccgggccacgtcccgtcccttccccgcgtacccgccctcccacacggaccncctaccgtcggtccggggcaccgtacgccgaccgtcccgtcggtcgtccggtccgtcgggtaacaaccgggttacccttaccgtttacccgtacgttacccttacgttacgttccggtcggaccggtccggggtccggttaccgggaaccgacgggtcctaacggagtacgggtcntcg

SEQ ID NO: 40749 - DNA, 743 bp, Homo sapiens
  misc_feature: GYAE6OF02HP26I.29.14.B03.1.454.CMB.1.raw
  modified_base (207)..(207): a, c, t, g, unknown or other
  misc_feature (207)..(207): n is a, c, g, or t
  modified_base (711)..(711): a, c, t, g, unknown or other
  misc_feature (711)..(711): n is a, c, g, or t
tcagatagagtactcacgaccggtgctcgatttagtgtgagtagtttgggcgtgagcgtggcgttttcttgtggctattttaaaaggtgtccagtgtgacgtgcagttggtggagtctgggggcgcctgggtacggccgggggggtcgctgagactctcctgtgcggcctctggattaagtttaggagtcatgccatgactggtccncaggctcgagggaagggctgggagtcgggtctcgggctattaggtgactaggtggtgcgacgtatagttacttatggacaaggtacccgacccgtagggaaaccgggtcccgggtttacaaccctatttccccaaggacaaccgtaaatttccgggaaacgaaacctccggcttaggaacttctacgaactaagtcggagccgtacgtgtacgtacctacggaccggtacaccgggtccgttacttaattaacgtttaggtaggttaaaggctaggtcgtagggtaaaccgtaaccgggggacccggggtacccgtaactttcggaaccttacgggcgggggacccggaggggaccgttcggtcgggccttaccggtcacctcgaactccccgtaccgaacccggacggggccccttaaggtccggttccccttaccccgcggtccccttacccccgtaccgttaccgaaccgtacgtcccaacccggtcgggtacccgggtancccacgaccgtccggaccgtcggaccgtccgg

SEQ ID NO: 40750 - DNA, 755 bp, Homo sapiens
  misc_feature: GYAE6OF02HO6DN.29.14.B03.1.454.CMB.1.raw
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagatagagtactcacgaccggtgctcgatttagtgtgagtagtttggtggagtcgtgggggcgcctgggtacgggccgggggggtcggcgtgagactctcctgtgcggcctctggattaagttttaggagtcatgccatgaactgggtccgccaggctccgaggggaagggggcgtgggaggtggggtcgtcgggtctagttaggtggcaggtggtggcgctatatattatgcagacgccctgaaggggccggttcacctatttccagagacaattcgaagaacacgctggtatcctgacaaagtggaagacgctggagacgtcgaccganaccggcgtctattgttntggttaaagngagngtaggaagtaccggggaccgggccgacgttacgaccctacggtcggggaccgtagggggaccggtcgtacgggtcctaacccggtccgttcccaccggacgacccgttcccgaacccgaaccgggacccgaaccggttccggttcccgtttacccccgtccgggacccgtaccccgttccctacccgtaaaccgaaccgaccgttaccccgtcggtccggggggtaccaaaccgccggaaccggtaccggccccgggtacgggtcccgtacgggtcccgtacgggttccgaaacggtaccgttacccgttccgtaaccgttacccgttaccgtaacgttccgtacggtacgggaccggtacggtcgggtaacggacgggtccgacgtaacg

SEQ ID NO: 40751 - DNA, 695 bp, Homo sapiens
  misc_feature: GYAE6OF02FMZTH.29.14.B03.1.454.CMB.1.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (329)..(329): a, c, t, g, unknown or other
  misc_feature (329)..(329): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagaccgccctggaacgggccggttcacctatttccaganacaattacgaagaacacnctgtatctgacaaatggagacgcctagagactcgacgacgacggccgtctattnttgtagttaaggcgagcgtaggtaacggtaccggggacccggggcccgtacgttcgaaccgtacgtcgggggaccgagggggacgcgtcgggtacctacccgttcctccgtaccacgtcctacccgaccgaacgggccccacgttcccggttcccttcccccgtcggccctaccccgtcccttaccgaacgtaccgaccctaccgttccggcgggggtaccaccgaccggcaccggtcccgtcgggccgtcggtcccgttcgggaaccgaacgggtacccttacccgttaccgtaaggtttaccctacttacgttcgtacgggtaccggtccgggtcgtaccgggacgaacgggtccgagtaacgg

SEQ ID NO: 40752 - DNA, 611 bp, Homo sapiens
  misc_feature: GYAE6OF02F98KN.29.14.B03.1.454.CMB.1.raw
  modified_base (609)..(610): a, c, t, g, unknown or other
  misc_feature (609)..(610): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacgacggccgtctattattgtagttaaaggcgagctggaagtacgggaccggggcccacgttcgaccgacgtcgggaccgagggggacgcgtggtccaccggtctccgtcacgccctaccgaacccgaagggcccctagtccggtcccttccccccgtcggcccacccctcctacccgaacgaccgccgaccttcggtcggggcacgcgacacgcccgtcgggccgtcgccgttcggtacgaacgtacctaccttcctacgtaccttctaactcgtggacggtcgggacgtcggaccgacggcgtaccagacgcnnc

SEQ ID NO: 40753 - DNA, 635 bp, Homo sapiens
  misc_feature: GYAE6OF02GB9PK.29.14.B03.1.454.CMB.1.raw
  modified_base (207)..(207): a, c, t, g, unknown or other
  misc_feature (207)..(207): n is a, c, g, or t
  modified_base (306)..(306): a, c, t, g, unknown or other
  misc_feature (306)..(306): n is a, c, g, or t
  modified_base (469)..(469): a, c, t, g, unknown or other
  misc_feature (469)..(469): n is a, c, g, or t
  modified_base (633)..(635): a, c, t, g, unknown or other
  misc_feature (633)..(635): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatncagacgccctgaagggccggttcaccatttccagagacaattcgaagaacacgctgtatctgcaaatggagagcctgagactcgacgacacggcccgtntattattgtagttaaaggcgagtccgtgggaactacggggacccggggcccgtacgttcgaccgtacgtggggaccctagggggacgcgttcggtaccgaaccgtcctacctccgagccctcccgacccgaaggggccccaagttccggtcctttccccccgnggaccctacccctccgtcccaaacgacgcccaccggttcggtcgggggaccacgacgccacggcccgttcgggcctcgcccgtcggtacgaacggtaccttcgttaccagttacctctatcgtggaccggccgggtcgtacggaccaagggccgacagtacggnnn

SEQ ID NO: 40754 - DNA, 767 bp, Homo sapiens
  misc_feature: GYAE6OF02HJFVR.29.14.B03.1.454.CMB.1.raw
  modified_base (761)..(761): a, c, t, g, unknown or other
  misc_feature (761)..(761): n is a, c, g, or t
  modified_base (763)..(763): a, c, t, g, unknown or other
  misc_feature (763)..(763): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatatatgcagacgccctgaagggccggttcaccatttccagagacaattcgaagaacacgctgtaatctgacaatggagagcctgagactcgacgacgacggcctactattattgtagttaaggcgtagcgtgggaagtacggggacccgggggcccgtacgtttcggaccgtacggtacgggggtccaagggggggaccgaccggttcgggtcctaacccggtttctcccgtacgaacgtccccgttacccgaacccgaaaccggggtcccctaaccgttacccgggttccccgtttacccccccggttacgggacccccgtaccccccgttccccgttaaccccgaaacgggtaaccgtcccgtaaccccggttacccgggttccggggggggacccacccgtaaccggtacccgtaaccgggtccccgttacgggggtccctacgggtcccgtacgggttaccgaaaccgggtaccttaccggttaccgtacgttaccgtacttaacgtccgttaggacgggtccgggtcgtgggaccgtacgggtccgacgagtacgnanacgg

SEQ ID NO: 40755 - DNA, 908 bp, Homo sapiens
  misc_feature: GYAE6OF02HL38I.29.14.B03.1.454.CMB.1.raw
  modified_base (148)..(148): a, c, t, g, unknown or other
  misc_feature (148)..(148): n is a, c, g, or t
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctggggtacggccggggggggtcnctgagactctcctgtgcggcctctggattaagttttaggagtcatgccatgaactgggtccncaggctccgagggagggctggagtgggtctcggntataggtggcaggtggtggcgntatatattatgcagacgcctaggaacgggtccggttacaccgtatttacccgaaggacgtaaccaaattttaccgggaaagaaaacccgacgcgttagttaatcgtgaactaaaagtggggaacgagtaccgtggaaacgtaccgtacggaaccggaaccgtacccggggtaccgttaccttaaattttagtttacggttaacgggtttaaaaacggggccgggtaacgggacccggggtaaacgggtaacccggggggtaaccccggggggtaaccccgggtaaccggtttaccgggtaacccggtaacgggttaccgggggggtacccgggacgggggggaacccggtccgggtttacgggttaccgggttacccggttcccgttaccccggtaccggtaccggtaccccgttaccccgaaacccgggtaacccgggacccccgtaaccggtttaccgggtttccccctttcccccggttacccggtaccccgtaacccccgtttcccgtaccccggtaaaccggtaccgggaaccccttacccggttaccgggttaccggggggaacccgtaaccggtaccggtacccggaacccgggttcccccgggttcgggggtacccgttccgggttacccgggg

SEQ ID NO: 40756 - DNA, 699 bp, Homo sapiens
  misc_feature: GYAE6OF02G4WJU.29.14.B03.1.454.CMB.1.raw
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctggaacgggccggttcacctatttccagagacaattcgaaanaacacgctgtatctgacaaagtgganagcctagagactcgacgacacggcctctattatgtagtaaaggcgagcgtggaacgtacggggaccgggcccgacgttcggacctacggtcggggaccgaaggggtaccgacgtcggtccgacccgttctccctcgacgtccctccgaacccgtaacgggcccctaggttccgttccccgttccccgtacggtccccctaccccgtccctaacccggtaaacgaccgtcccacccgttccgggtcggggaccgaaccgacggtcccgaaccggtcccccgttcggggaccttccggtacccggtggtaacccgtaacgggtaccctttaccgttcccctaagttacccgttacctacgttcgtacggacgggtccgggtcgcgggaaccgaagggcccacgtacgg

SEQ ID NO: 40757 - DNA, 706 bp, Homo sapiens
  misc_feature: GYAE6OF02GR3H7.29.14.B03.1.454.CMB.1.raw
  modified_base (563)..(563): a, c, t, g, unknown or other
  misc_feature (563)..(563): n is a, c, g, or t
tcagatagagtactcacgaccggtgctcgatttagtgtgagtagtttggtggagtctgggggcgcctgggtacggccgggggggtcgctgagactctcctgtgcgcctctggattaagttttaggagtcatgccatgaactgggtccgccaggctccgagggaaggggctggagtgggtctcggctagttagtggcagtggtggcgctatatattatgcacgaccgcccgtggaacgggtccggttccaacctatttccagagaacctaagttacgaaagaacaccgacttggtacttcgtgacaaagttaggagacgccgtagacgaccgtacggacgaccgaccggtccgttactatttagttaggttaggttaaacggcgagtacgtagggtaacggtaccggggacccggggtcccgaacgttcgaacctacgggtcggggaccggaggggacgtcgtcggtaccgtaccgtccgtccctacgacgtccctaccgaaccgacgggcccacgtccggttccccttccccgtcggaccctaccctcccgtaccaacggacnccctaccgtcggtacgggacacgtacgccgtacggcccgtggtccgtcggtacccgtacggtaccgaagttacccgttaccacgtaccgtacttactactaccgtaggccggtccggcgtacggccggtaacggcgtagtacg

SEQ ID NO: 40758 - DNA, 859 bp, Homo sapiens
  misc_feature: GYAE6OF02JI0RW.29.14.B03.1.454.CMB.1.raw
  modified_base (857)..(857): a, c, t, g, unknown or other
  misc_feature (857)..(857): n is a, c, g, or t
tcagatagagtactcacgaccggtgctcgatttagtgtgagtagtttgggggcgcctgggtacgggccgggggggtcgctgagactctcctgtgcggcctctggattaagttttaggagtcatgccatgaactgggtccgccaggctcgaggggagggctggagtgggtctcggctattaggtggcaggttgggtcggcgacttatatattatgcagaccgccctggaacgggtccggttacacctactttccaagagactaaagttccgaaagaaccacgtacgtgtaacttcgtggtacaaagtgggaagacgaccgtaggaacggtaccacggaaccgaaccgaccgggtccgttacttagttttagttacgggtaggtttaaaacgggcggtaaggtacggtaagggtaaaccgggtacccgggggaacccgggggtccccgtaacgttaccggaaccgtaccggtacggggcccggaacggggggactccggttacgggtaccgacccgttccggttccctacgtacccggccccttacccgaacggtaacccggggtcccgtaaccgttcccgggtttccccttaccccccggttcccgggaccccttaccccgttacccgtaacccgaaacgggtacccggtaccccgtaccggttcccggggtaccgggggacccaccggaacggtcccggtacccggtccccgggtcggggtacctccgggtcccggtacgggttaccggaaacggttccttacccgttacccgtacgttacccttacgttaacgttcggtacggacggtaccggggtcctacgggaccggtaccggacggtacaacggttacgcgancg

SEQ ID NO: 40759 - DNA, 716 bp, Homo sapiens
  misc_feature: GYAE6OF02F5UMJ.29.14.B03.1.454.CMB.1.raw
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
tcagatagagtactcacgaccggtgctcgatttagtgtgagtagtttggtggagtctgggggctcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaacgggccggttcaccatttccagagacaattcgaagaacncgctgtatctgacaaagtggagagcctagagtactacgacgacncggccgtactattattgtagttaagcgagcgtaggaacgtacggggacccgggaccgacttacgaccacgtcggggacgaacggggacgcgtcggtccaccggttcctaccgtacaccgtcctacccgaccgaacgggccctagtccggttcccctccccgtgcccgtacccctaccgtaccaaacggacgaccctacccgtccggtacggggccaacgaccggtacgtacccggtacccgttcggggtccgttaccgggtacccgtacggggttaccgtaaaccgggtacccctttaaccgttaaccccgttagtaacccgttaccttaacgtacccggtttacgggaacccggttccggggtacccgttagggacccgtaaggggcccgttacgtaacgg

SEQ ID NO: 40760 - DNA, 648 bp, Homo sapiens
  misc_feature: GYAE6OF02GFDSH.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccattccagagactaattcgaagaacacgctgtatctgcaaatggagagcctggagacctcgacgacgaccggccgtctattacttgtagttaaaggcgagcgtggaaagtaccggggacccggggcccgtacttacggaccgagtcggggccgaggggacgcgtggtaccgtacccgttctccctcgaacgccctcccgacccgaacgggtaccccacgttcccggttccttcccccgttcgggtaccctacccctccctacccgaacgaccgtaccacccgttccggtcgggggtacccacgtacggaccgacgccccgtacgggccgtccgtccgtacggtacgaacgtactaccttcgacgtactacctagtctagcggtcggcgtggacgacggcgagtacg

SEQ ID NO: 40761 - DNA, 1002 bp, Homo sapiens
  misc_feature: GYAE6OF02IB6P0.29.14.B03.1.454.CMB.1.raw
  modified_base (184)..(184): a, c, t, g, unknown or other
  misc_feature (184)..(184): n is a, c, g, or t
tcagatagagtactcacgaccggtgctcgatttagtgtgagtagttgggtttagggggacgccgtggggtacggccgggggggtcgctgacgactctacctgtgcggcctctggattaagtttaggacgtcatgccacttcgaacgtcgggtccgccgaggcgtccgaggggaaggggctcggnggttgggttcgtcggctagttggtggcaggtgggtcggccgtctagtatagttatgcaggacgtcccgtgggacgggtccgttacaccgtaacgtttaccgaggtacgtacgtaacttacggaaagaaccgtacgtcgttagttaacgtcgttacggtaactaaaaggtggaacggtaatcccgttaaggaagtacccgtaaccggacgtaaccgtaccgggcccgtactttaagtttaggtttcggtaaggttaaaccgggcgtaacggtcggtaagggtaaaccggttaaccggggccccggggtaccttacggttacggaccgtaacgggttccggggggaccaaaccgggggtccgtaccgggtagggtacccgtacccggtccgtaaccgttaccggaaccgtccccgttaaacccggaccgggtaaacccgggtacccggttaacggtaccccgggtttacccccggttttacccccggtaccggtaccccgttaacccccgttacccgtaccccgggtaaaggtacccggtaacccgtaacccgggtttccgggttacgggggacccgttaacccgaccgggacccgtaacccgggtcccgggttaacgggtaccccgtttcggggtaacccccggttaacgggttaccggaaaccgggttaaccgtttaacccggtacccgtttaaacggtaccgttacccgtttacggttaacccggtaccggttaccgggggttaccggtttccgggttaccgggaaccgggttaccgggtaacgaaccccggttagggtaccccggattaaccccgg

SEQ ID NO: 40762 - DNA, 677 bp, Homo sapiens
  misc_feature: GYAE6OF02HU2DU.29.14.B03.1.454.CMB.1.raw
  modified_base (128)..(128): a, c, t, g, unknown or other
  misc_feature (128)..(128): n is a, c, g, or t
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
tcagatagagtactcacgaccggtgctcgatttagtgtgagtagttccgcgggggcaggagtcagacccactcaggacacagcatggacatgacgggtcccgctcagctccgtgggctcctgctgctntggctcccgaggtcgccagatgtgccaatccagatacgacccagtcctaccataccttccctgtcctagctatccgtagtaggacanagtacgtacagcatctacgtggccgggtatacgtcgaaggacacgtaccgaagngtaagatacgngtagtatacacgaacgtaaccgacgtaacctcctaaccgtctagtactctagtcgtctacgtccgtacgttaacgttacgtaaacgggtccggtacctacgtcgtacgtcggacgtcggtcgtaaggtcgtacgtcgacgacgtacgtattaccttacgtcctacactaacnctcgacgtacnccgtacctcgaccgacgtccgtaaaggtacgtttacgttctaacctttaattaccgttaactcggttaaactacgtaacgtttaacgtaccttaaacgttaacgttcgggtaaccggttaccggttacgtaacccgggtaaacgtaccggtaaggtaaaccggtaaccgtaaacgtaacggtacgtcggtaccggtactccggtaactaacccg

SEQ ID NO: 40763 - DNA, 534 bp, Homo sapiens
  misc_feature: GYAE6OF02HICRU.29.14.B03.1.454.CMB.1.raw
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagatagagtactcacgaccggtgctcgatttagtgtgagtagttccgcgggggcaggagtcagacccactcaggacacagcatggacatgagggtcccgctcagctcctggggctcctgctgctctggctcccaggtgccagatgtgccatccagatgacccagtctccatattccctgtctgcatctgtagganacagagtcagcatcactgcggnaagtcaggcancgaaatgagataagntggtatcaacagaaaccacgggaaacctacctaacctcctgatctatgtctgcgtactagttaacaagtggggtaccagtcacgttcagcgcgagtggatcgtggacacgagtaatttcacttctccacatacagcaggcctgctacgcctaggactagtttcgacttaacttagttactgtacttaacaacgttattaactaccttaacagttcggtacgttcggaccgaacgggtaccaaggtacggtaactacgaacgtaacggtcgtacggtactcgactaaccg

SEQ ID NO: 40764 - DNA, 709 bp, Homo sapiens
  misc_feature: GYAE6OF02FWWTY.29.14.B03.1.454.CMB.1.raw
  modified_base (299)..(299): a, c, t, g, unknown or other
  misc_feature (299)..(299): n is a, c, g, or t
  modified_base (447)..(447): a, c, t, g, unknown or other
  misc_feature (447)..(447): n is a, c, g, or t
tcagatagagtactcacgaccggtgctcgatttagtgtgagtagtttggtggagtctgggggcgcctgggtacgggccgggggggtcggctgagactctcctgtgccggcctctggattaagtttttaggagtcatgccatgaacgtgggtccgccaggctccgagggaaggggctggagtgggtctcggctattagtggcagtggtggcgctatatattatgcagacgccctggaagggccgttcaccatttccagagacaattcgaaagacacgctgtactctcgacaaacgtgganacggtcctagagacgttacgaacggacaccgggccgttacgtatttatttgtagtttaaaaggccgtaagccgtaaggaacgtaaccggggacccgggggtacccgacgttacgacccgtaccggtcgggggacgaacgggggtaccncgttacggtccgtaccgttccgtcccgtccaacgccctaccaaccgacggcccagtacccggtccttccccgtcggaccctacccgtcctaccgtaacgacgtacacccgtcgttcgggaccacggacgtaccgaccgtccgttacgggaccgtccggttaccgtaccgggttaccgaacgggacctttacccttaccggtaccgttaaccgtcctaacgtcggtacggtacggcggtacgaaccgacggtacacgatacgg

SEQ ID NO: 40765 - DNA, 567 bp, Homo sapiens
  misc_feature: GYAE6OF02HBZC7.29.14.B03.1.454.CMB.1.raw
tcagatagagtactcacgaccggtgctcgatttagtgtgagtagtttggtggagtctgggggcgcctgggtacggccgggggggtcgcgtgagactcgtcctgtgcggcctctggattaagttttaggagtcatgccatgaactgggtccgccaggctccagggaagggctggagtgggtctcggctagttagtggcagtggtggcgctatatattatgcagacgccctgaagggccggttcaccactttccagagacaattcgaagaacacgctgtatctgcaaatggagtgcctgacgactcgacgacacggccgtctatattgtagtaagcgagctggaatacgggccggccgacttgacacgtgggccagggcgcgtgtcaccgtctcctcagtcctcaccgacggcccagtccgtcctccctcggccaccctccaccgaacgcgaccaccgtcgtcggggaccacgacgccgacgccgtcggcgtcgccgtcggacgtaacgtaccctacgttacctacgtccttaccgtagtctagacggcggcgtggacgtacgcgatag

SEQ ID NO: 40766 - DNA, 757 bp, Homo sapiens
  misc_feature: GYAE6OF02HY5IX.29.14.B03.1.454.CMB.1.raw
tcagatagagtactcacgaccggtgctcgatttagtgtgagtagtttgggctgagcgtggcttttcttgtggctattttaaaaggtgtccagtgtgacgtgcagttggtggagtctgggggcgcctggggtacggccgggggggtcgctgagactctcctgtgcggcctctggattaagttttaggagtcatgccatgaactgggtccgccaggctccgaggggaacggggctggagtgggtctcggctattagtggcaggtggtggcgctatatattatgcagacgtcccctggaacgggccggttcacctagtttcccaggtagactaagttacggaacgtaacacgctagttactctcggaacaaagtcggagacgtcctaggacgtaacgtacgaccggtacaccgggtacctcgtaattacgtttggtaagttaaacggcgtacgcgtagggaaagtaccgggggacccggggaccccggtacgttacggacctacgggtcgggggacccgtacgggggacccgtacggtggtacccgtacccggttaccctcccgtccgaccgtacccgtccccgaacccggtaaccggggtaccccgtacggttccggggtacccctttccccccggtaccgggtcccttaacccccgttacccttacccgtaacggccgtacccggtacccgttaccgggtcgggggtaacccaaccgtaccgggccgaacccggtccccggttcggggcccttccggg

SEQ ID NO: 40767 - DNA, 687 bp, Homo sapiens
  misc_feature: GYAE6OF02IRHDF.29.14.B03.1.454.CMB.1.raw
  modified_base (654)..(654): a, c, t, g, unknown or other
  misc_feature (654)..(654): n is a, c, g, or t
tcagatagagtactcacgaccggtgctcgatttagtgtgagtagtttgggctgagcgtggtcttttcttagtggctattttaaaaaggtgtccagtgtgacgtgcagttggtggagtctgggggcgcctgggtacggccgggggggtcgctgagactctcctgtgcggcctctggattaagtttaggagtcatgccatgaactgggtccgcaggctccgaggggagggctggagtggtctcggcttattagtggcaggtggtggcgctaatatattagtgcagaccgccctaggaagggtcccgttacaacctatttaccaagacgaactaagttaccggaaaagaaaccacgtcgttagtaacgttcctagaactaaaaggtggaagacgctgaagtactcggaaccacggccgtacgttacttattattggtaaggttaaaggcgtaagcgtaggaaggtaccggggaccgggcccgtagttcgaccgtaggtacggggaccgaggggcgtcgtcgtccgaccgttcctacctcacgtccctaccgaaccgaacggccctacgttcccggttcccttcccccgcggtacccctaccccgttaccgtaaccgaacggtaccacccggtacccgtccgggtacgggaccaccgnggcccgtaaccggtcccggtcggtactcccggg

SEQ ID NO: 40768 - DNA, 978 bp, Homo sapiens
  misc_feature: GYAE6OF02FS7SI.29.14.B03.1.454.CMB.1.raw
  modified_base (967)..(967): a, c, t, g, unknown or other
  misc_feature (967)..(967): n is a, c, g, or t
  modified_base (974)..(974): a, c, t, g, unknown or other
  misc_feature (974)..(974): n is a, c, g, or t
  modified_base (978)..(978): a, c, t, g, unknown or other
  misc_feature (978)..(978): n is a, c, g, or t
tcagatagagtactcacgaccggtgctcgatttagtgtgagtagtttgggggcgcctgggtacgggccgggggggtcgctgagactctcctgtgcggcctctggattaagttttaggagtcatgccatgaacgtgggtccgccaggctacgagggaagggctggagtgggtctcggctattagtggcagtggtggcgctatatattatgcagaccgccctaggaacgggtccggttcaaccctacttttccaggtaacgaactaaacgttccggtaaagaaaccgaccgtaccttaggtttaactcttaggaacctaaaaagttggggaaggtacgaccggttggaacggtaacccgttaacccgggaaaccgtaccggaaaaccccggggtcccccggttttaacgttaaagttttaagtttttaacgggttttaaggttttaaaaagggacccgggaaaggtacgtacgggggtaaaaccgggttaacccgggggggaaccccccggggggtacccccgtaacggttttacccggaaacccgttacggggttaccggggggaacccggtaacgggggggaaccgtcggttccggggttaccgtaaccccggttcttaccccctaccgaacccggtccccttacccgaaaacccgggaacccggggccccgtaacggtttaccccgggttacccccgtttccccccccgttacgggaccccctaaaccccccgttacccctaaacccggtaaaccggaacccggacccgttaaacccccgttcgggtacccgggggggtacccctaacggaaccgggtacccgaaccgggtccccggtacgggggtacctaccggtcccggttaacgggttaccgaaaccggttaaccttaccgttaccgtaacgttaccctacggtaacttccggaggtaccggcggtccgtacggacgtaacgggcaccggtanaccggtnagtn

SEQ ID NO: 40769 - DNA, 748 bp, Homo sapiens
  misc_feature: GYAE6OF02GPKCQ.29.14.B03.1.454.CMB.1.raw
  modified_base (600)..(600): a, c, t, g, unknown or other
  misc_feature (600)..(600): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtaccgccaggctccagggaaggggctggagtgggtctcggctattagtggcagtggtggcgctatatattatgcagaccgcccgtggaaagggtccggtttacacctatttccgagagacaattcgaaagaaccacgctgtactcgtgacaaagtggagacgcctagagactcgacgaccgacggtcgtcttattacgtgttacgttaaaggcgtagcgtagggaaactacggggaccgggcccgtagttcggaccgtacgtcgggggaccgtacggggacgcgttacggggtcctaacccggttcctcccgtcgacgtcccgttacccgaacccggtaacgggtcccctaagtacccgggtttcccctttcccccggtcgggaccctaccccccgtttacgaacccgaacgttacccggacccttaaccgtcgggtaccgggggacaacccggngacccgtacgggtaccggtcgggtccgttccgtaccggtacggtaacgaacccgggtctttacccttaccggtacgttaacccgtttcacggtttaaccgcgggtaacgtcccggggtgttacccggacgggttacgccgagttacgg

SEQ ID NO: 40770 - DNA, 762 bp, Homo sapiens
  misc_feature: GYAE6OF02IXW8X.29.14.B03.1.454.CMB.1.raw
  modified_base (186)..(186): a, c, t, g, unknown or other
  misc_feature (186)..(186): n is a, c, g, or t
  modified_base (754)..(754): a, c, t, g, unknown or other
  misc_feature (754)..(754): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatcgccatgaactggtccgccaggcctccagggaagggctggagtggtctcggctnttagtggcagtgtggcgctatatattatgcagacgccctggaacgggccggttcaccactttccagagactaattcgaaagacacgctgtatcgtgcaaatcggagacgccgtacgagtacctcgacgacgcggtccgtacttagttcttaggtagtttaaacggcgtagcgttaacggaaacggtaccggggacccggggtcccgtaccgtttacgacctaaccggtcgggggacccggaagggggacccgtacggttacgggtccgaaccccgttccttcccgtaccgaacgtccccgtacccgaaaccccggtaaacgggcccccgtaacgttcccggttaccccgtttcccccggtacgggtacccctaccccctaccccgttacccgtaacggaccgtcccgtacccgtacccgggtcggggacccgtacgacgaaccgtccgtcccggtggtacccgttccgccggttacggttacccgaagggtacccttacttacccggtagttacccttacctacgttacgcggtaccggcgggtacccgttgaaccctacggggtacnccggtaac

SEQ ID NO: 40771 - DNA, 693 bp, Homo sapiens
  misc_feature: GYAE6OF02FIW1P.29.14.B03.1.454.CMB.1.raw
tcagatagagtactcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagcgccctggaacgggccggttcaccgtatttccaggagacaattcgaaggaacacgctgtatctgacaaatggagagccctagagactcgacgaccacggcccgtactattattggtagttaaaggcgagcgtagggaacgttacggggaccccgggggtccacgtttgaacctacgtggggacccgaggggaccgcgtgggccgaccggttctacctcgacgccctcccgaccgaacggacccgtacgtccggtccgttccccctcggaccctcccgtaccctcccgacgtacgacctaccgttcgtcgggacgacgtcgaccgacgcccgttcgggacggtccgtaccggtccggtcgtaaaccggtaacgttaccgttacctaccggtaaccgtttactaacgttccgtacggtaccgggtacccggggtccggttacggaacccggtacgggtaaccgaccggttaacacggtagacgtc

SEQ ID NO: 40772 - DNA, 664 bp, Homo sapiens
  misc_feature: GYAE6OF02FNP3U.29.14.B03.1.454.CMB.1.raw
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcacctatttccagagacaattcgaagaacacgctgtatctgacaaatggagagcctgacgactcgaacgacgacggccgtctattattgtagttaaaggcgagcgtaggaagtacggggaccggggccgacgttacggacctacgtcgggggaccagggggacgcgtcggtccaccgtctcccgtcacgccctaccaccgaacgggcccagttccggtccctcccccgtcggccctacccctccctaccgaacgcgcccaaccgtcggtcggggccacgacgccgaccgtcccgtgggtcctcggcccgttgggtaccgaacgggtacccttacccgttcccgtaacgtttaacccgtaccttaacgttccgtacggtacgggtccgggtacgtaccgggaccgtaacgggccgtacgtaacgg

SEQ ID NO: 40773 - DNA, 741 bp, Homo sapiens
  misc_feature: GYAE6OF02GCPAF.29.14.B03.1.454.CMB.1.raw
  modified_base (91)..(91): a, c, t, g, unknown or other
  misc_feature (91)..(91): n is a, c, g, or t
  modified_base (152)..(152): a, c, t, g, unknown or other
  misc_feature (152)..(152): n is a, c, g, or t
tcagatagagtactcacgaccggtgctcgatttagtgtgagtagtttgggctgagcgtggctttttcttagtggctaatttttaaaaggtntccagtgtgacgtgcagttggtggagtctgggggcgcctggggtacggccggggggggtcnctgagactctcctgtgcggcctctggatttaaggttttaggagtcatgccatgaactgggtccgccaggctcgagggaacgggctggagtcgggtctcggctagttagtggcaggtggtcggcgtctattatattatgcacgaccgtcccgtaggaacgggtccgttaccacctactttccagagactaattacgaaagaccacgctgtactacgtacgaactaagtggagacgaccgtagacgtacgtacgaacgaacccgacgggtcccgtttataactttagtttacggtagggttaaacggcggtaacgtcgttagggtaaaccggtaacccggggggacccggggtacccggtaccgtttacgacccgaacgggtccggggacccgggaggggtaccgtacgttcggtacccgtacccggttcctcccgtccgtaccgtccctacccgaacccggaacgggcccgtacgttcccgttaccccgttccccgtacccggaccccgtacccctccctaccgaacgtaccgccctacccggtcgtccgggactacgaccggccgaccggtcccggtccggccgtccgg

SEQ ID NO: 40774 - DNA, 752 bp, Homo sapiens
  misc_feature: GYAE6OF02GOU6I.29.14.B03.1.454.CMB.1.raw
tcagatagagtactcacgaccggtgctcgatttagtgtgagtagtttggtggagtctgggggcgcctgggtacgggccgggggggtcgctgagactctcctgtgcggcctctggatttaagttttaggagtcatgccatgaactgggtccgccaggctccgagggaaggggctggagtgggtctcggctattaggtggcaggtgggtgggcgctatattattagtgacaagaccgcccgtggaacgggtcccggtttacacctatttccagacgactaattcgaaagaacacgctgtatctgacaagtggagacgctaggagacctacgacgtacacggaccgtctagttagtttgtagttaaggcgtagcgtggaaagtacccggggaccggggcccctacgttacggacccgtaacggtcgggggaccggaagggggaccgtcgttcgggtaccgtacccgttcccttcccgtaccgacgcccccttaacccgaacccggtaacccgggacccgtaacggttccccgggtttacccctttcccccgttaccggggaccccctaaccccccgttccccgtacccgaaacggtaccggcccttacccgttcggggaaccggggtccaacgccggaccgacccggtcccgtaggggtcctccggtacccgtagggtaccaaggaccctttactaccgacgttacctcttacgtccgtagggccggtacggcgtcggaccgacgggcgtacgag

SEQ ID NO: 40775 - DNA, 798 bp, Homo sapiens
  misc_feature: GYAE6OF02H6BGH.29.14.B03.1.454.CMB.1.raw
  modified_base (148)..(148): a, c, t, g, unknown or other
  misc_feature (148)..(148): n is a, c, g, or t
  modified_base (214)..(214): a, c, t, g, unknown or other
  misc_feature (214)..(214): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggcgcctggggtacgggccgggggggtcnctgagacggtctcctgtgcggcctcgtggtattaagttttaggagtcatgccatgaactgggtccncaggctccgagggagggctggagtgggtctcggctattaggtggcaggttgggtggcgctagtattattatgacaaggaccgtccccgtaggaacggggtcccggttaccacccgttactttaccgaaggtaacgtaaaccgtaaacgttacggaaaacggaaacctacggtacttaggttacttacgtacggaacgtaaaaggtgggaacgacgtaccgtagaacggtaccgtacggaaaccgtaccgaccgggtcccgtttaagttaacgttttaagtttaggttaacgggttaaacgggcgtaacggtacgtaacgggtaacgggtacccggggaccccggggtaccccggtaacgttaccggaaccgtaccgggtaccggggaccggaacggggaccgtccggtacggtccgtacccgtcctcccgtaccgaccgaccctacccgacccgtaccgggcccgtaccgttcccgttcccgttccccggtaccgtccctaccctacccgtaccgaacggccgtaccgtaccggtccggtacgggaccaccgtacgcccgtaccggccggtaccggtcgtccgg

SEQ ID NO: 40776 - DNA, 783 bp, Homo sapiens
  misc_feature: GYAE6OF02I6EAN.29.14.B03.1.454.CMB.1.raw
  modified_base (147)..(147): a, c, t, g, unknown or other
  misc_feature (147)..(147): n is a, c, g, or t
tcagatagagtactcacgaccggtgctcgatttagtgtgagtagtttgggctgagctggctttttcttgtggctattttaaaaggtgtccagtgtgacgtgcagttggtggagtcgtgggggcgcctgggtacggccgggggggtcnctgagactctcctgtgcggcctcgtggatttaaggttttaggagtcatgccatgaactgggtccgcaggctccgagggagggctggagtgggtctcggctagttagtggcaggtggtggcgcttaattattatttacgtgacgtaggaaccgtccccgtagggaaaccggggttcccggttaccaacccgttacttttacccgaaggtaacggaacctaaagttaccggaaaacgaaccgaccggtcttaggttactcgtacgacgtaaaagtgggtaacgacgtccgtaggtaacgtaccgtacggaccgacggaccggtccgttacttaagtttacgttacggtaggttaaaacggccgtagtacgtagggtaacggtaccggggacccggggtacccgtacgttccgaccgtacggcggggaccggacggggaccgtcgttacgggacctacccggttacctccctacgaccggtcccacccgaccgaaccggcccgtaacgttcccgggttccccttaccccggtacggacccctaccccgttaccgtacccgaacggccgtacccgtacccgttcggggaccggtacccgtaccgccgacccgtaccggtcccggtacgggtcctaccggg

SEQ ID NO: 40777 - DNA, 776 bp, Homo sapiens
  misc_feature: GYAE6OF02GXY2Y.29.14.B03.1.454.CMB.1.raw
  modified_base (122)..(122): a, c, t, g, unknown or other
  misc_feature (122)..(122): n is a, c, g, or t
  modified_base (145)..(145): a, c, t, g, unknown or other
  misc_feature (145)..(145): n is a, c, g, or t
  modified_base (264)..(264): a, c, t, g, unknown or other
  misc_feature (264)..(264): n is a, c, g, or t
tcagatagagtactcacgaccggtgctcgatttagtgtgagtagtttgggctgagctggctttttcttgtggctattttaaaaggtgtccagtgtgacgtgcagttggtggagtctggggcncctgggtacggccgggggggtcnctgagactctcctgtgcggcctctggattaagttttaggagtcatgccatgaactgggtccgccaggcctccgagggaagggctggagtgggtctcggctattagtggcagtggtgcgntatatattatgcagacgccctggaacgggtccgttacaccatttccgaagtacgaacaatttacggaaagtaaccacgctgtattcgtgaccaaaattgggaagtacgccgttagaacgtacctaccgacgaaccgtaccggcccgttcttaagtttagtttaggttaacgttaaaacggcggtaagcgttacgggtaaacgtaaccgggggaccccggggtaccccgtacgtttaccggaacccgtaacggttccggggacccggtaacgggggtaccgcggtttaccgggttaccgtaacccggttcccgttacccgtaccgtacccgtccccgttacccggaaacccgtaacccgggcccccgtaacggttcccggttaaccccgttcccccgtaccgggtcccctacccgttccccgtaccgtaaccggacctaccggtacccgtccgggttaccggggacctaacccggcggtacccgaccgggtaccccgtcggtaccgttccggg

SEQ ID NO: 40778 - DNA, 820 bp, Homo sapiens
  misc_feature: GYAE6OF02G1D0Y.29.14.B03.1.454.CMB.1.raw
  modified_base (147)..(147): a, c, t, g, unknown or other
  misc_feature (147)..(147): n is a, c, g, or t
tcagatagagtactcacgaccggtgctcgatttagtgtgagtagtttgggctgagcgtggctttttcttgtggctattttaaaaggtgtccagtgtgacgtgcagttggtggagtctgggggcgcctgggtacggccgggggggtcnctgagactctcctgtgcggcctctggatttaagttttaggagtcatgccatgaactgggtccgccaggcctccgagggaagggctggagtgggtctcggctattagtggcaggtggtggcgactagtattattatgcagaccgccctaggacgggtccgttcactatttcccgaggacaactaattcggaaagaacgtaccgcgtattacgtcgttacgaccaaaaggttgggagacgtccgtggaaacgtacccgtacggaaccgaccgtaccggggtaccctttacgtttaacttttacgtttggttaaacgggtttaaagggcccggtaagtcccggtaagggaaccggttaaccgggggaaccccgggggtaccccggtaaccgttaccggaacccgtacggggttaccgggggacccgggacggggtaaccgggtaccgttacgggtacccggttaacccgttccgttcccgttaccgacccgtcccgttaccccgaacccgaaccggggtaccccgtaacgttacccggtttccccgtttccccggttaccgccccgtaccccgttccctacccgaaccggtaacgtcccctaccggtacccgggttacggggacccgttaccggaccggtccggtacccggtcccggtccgggcccgttaacccgg

SEQ ID NO: 40779 - DNA, 717 bp, Homo sapiens
  misc_feature: GYAE6OF02ILGW4.29.14.B03.1.454.CMB.1.raw
  modified_base (432)..(432): a, c, t, g, unknown or other
  misc_feature (432)..(432): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggcctccgagggaaggggctggagtgggtctcggctattagtggcaggtggtggcgctatatattatgcagacgccctggaacgggtccgttcacctatttcccgagaacgacaagttacgaaaagaacacgctaggtactcgtcgactaaagtggagagacctagagactcggacgacgaccggccgtactaattagttagtaggttaacggcgagcgtaggaacgtaccggggaccgggccgtacttcgaaccgtacggcggggaccgaggggtaccncgtcggtactacccgtctacccttacgacgtccctacccgaaccgaaccgggacccaagttcccggttcccttaccccgtggacccctaaccccgttcccgtaacgaaacggtacgacccgtaccttcgggtcgggaccaccgagcccgacggtcccgttcgggtccgtacgtcccgtacggtaaccgaaacggtacccttaccgttaccgtaacggtaccttaccgttaagtcccgtagggaaccggccgggttacgtaccggcgtaaccggcggaacctacgg

SEQ ID NO: 40780 - DNA, 817 bp, Homo sapiens
  misc_feature: GYAE6OF02G57VU.29.14.B03.1.454.CMB.1.raw
  modified_base (649)..(649): a, c, t, g, unknown or other
  misc_feature (649)..(649): n is a, c, g, or t
  modified_base (678)..(678): a, c, t, g, unknown or other
  misc_feature (678)..(678): n is a, c, g, or t
  modified_base (759)..(759): a, c, t, g, unknown or other
  misc_feature (759)..(759): n is a, c, g, or t
tcagatagagtactcacgaccggtgctcgatttagtgtgagtagtttggtggagtcgtgggggcgcctgggtacgggccgggggggtcgctgagactctctgtgcggcctctggatttaagttttaggagtacagtgcctagtagaacggtcgggtccgaccgaggcctaccgaaggggaagggggcttagggaggttggggtcctcgggacttagttaaggtggacgaggttgggtcggacgcttattaattacgttatggacaggaccgcctagggacgggtccggttacaccgtatttaccgaggaacgactaacgttacgaaaagaaccgacgtacttaggtaactcgtacgtaaacgtaaagttacgggaacgaacgtacctaggaacgttaccgacgaaccgacgacccgggttcctatttagtttagtacggtttaaggttaacgggctacggtacgtacgggtaaacggacccggggggtaccggccctaacggttacggaaacccgtacgggtccgggggacggtaagggggacctcgggtacggtacccgtacccggtccctcgtaccgacgtacccaccgaaccgggaccgtaccgtccgtaccgtcccgtccgtcgaccctcccacgttaccgaacncgtacctacgtccgggtagggaccaacgngaccgacgtccggtcgacgtccgtaccgtacggaaccgtaacgggttacccttaccggtacctaccggttcttaaccggtntaacccggttcggaccggggtttaccgcggtacccggacggtaacgtcggacctaagg

SEQ ID NO: 40781 - DNA, 748 bp, Homo sapiens
  misc_feature: GYAE6OF02GATS0.29.14.B03.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (493)..(493): a, c, t, g, unknown or other
  misc_feature (493)..(493): n is a, c, g, or t
tcagatagagtactcacgaccggtgctcgatttagtgtgagtagtttggtggagtctggggcgcctgggtacggccggggggtcgctgagactctcctagtgcggcctctggattaagttttaggagtcatgccatcgaactggtccgcctaggctccgaggggaagggctggaggtgggtctcggctagttagnggcagtggtggacncgtatatacttatggaccagaccgcccttggaacgggccggttaccaacctactttaccgagagtacaattacggaaagacctcgacttgtactcgtgactaagtggacagtccgagtagacgtaccgacggaccgacgggtcccgtacttacgtttaacgtggttaacgttaaaggccggtaacgtcggtaacggtaacgttaacccgggggccccgggaccggtacttacggaacccgtgtaccggggacgaggggccagttcgggactacccggtctaccnccgctaccctcccgtaccgaacggtcccacggttcccgttacccgttccccgtacgggtacccctccccgtcccaaccggtaacggaccgtccctaccggttccgggtaccgggacaaccgacggaccgcggtacccgtcgggtcgtcccgcgtccggtaacgtacgtacccttacgttacctaggtaaccctactttacggtaccgtacggtacggtcccgggtacgtccgggtaagacccgggtctacgtagg

SEQ ID NO: 40782 - DNA, 975 bp, Homo sapiens
  misc_feature: GYAE6OF02GRI2T.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctcgagggagggctggagtgggtctcggctattagtggcaggtggtggcgctatatattatgcagccgcccgtaggaacggggtcccggttacacctacgttttacccaggtaacgactaaagttccggaaacgaaccaacggtccttagtattccgtagaccgtaaaagtgggggaacgtacggacccgtttaggaacggtaccgtacccggaaacgggtaacccgacccggggttaccccggttactttaagttttaacgtttacggttaaacgggggtttaaaaccgggcgggtaacgggtccgggttaacggggtaaaaccggggtttaacccggggggggtacccccccgggggggtaccccttaacccggttttaccgggaaacccccggtaaccggggttccgggggggaccccgggtacgggggggtaacccgtcccgggtttaccgggttaccccgtaaccccggggtttccccttacccgtcccgaaccgggttcccccgttacccccggaaacccgggaaaccccgggggttcccccttaaccgggtttcccccgggttttacccccgttccccccccggtttagggcccccccgtttaaccccccgtttccccggtaaacccccgtacgggtaaaccccggttaccccgttaacccccgggttcgggggtaaccccggggggtaccctaacccgggacggtaccccgggtacccccgggtccccggttaccggggcccgtttaccccggg

SEQ ID NO: 40783 - DNA, 677 bp, Homo sapiens
  misc_feature: GYAE6OF02FP9ML.29.14.B03.1.454.CMB.1.raw
  modified_base (396)..(396): a, c, t, g, unknown or other
  misc_feature (396)..(396): n is a, c, g, or t
tcagatagagtactcacgaccggtgctcgatttagtgtgagtagtttggtggagtctgggggcgcctgggtacggccgggggggtcgctgagactctcctgtgcggcctctggattaagttttaggagtcatgccatgaactgggtccgccaggctccaggggaaggggctggagtggggtctcggctattagtggcagtggtggcgctatatattatgcagaccgccctggaagggccggttcaccatttccagagacaattcgaaagaacacgctgtatctgcaaaatggagagcctgagactcgacgacacggccgtctattatgtagttaagcgagtcgtaggaagtcggggaccggggcccacgttgaaccacgtggggaccgaggggacncgtggtcagtccgtctcctcgacgtcctcccaccggtaacgggcccctacgttcccggtcctttcccccgtcggtcccaccccgttccttacccgaacgacggcctaacccgtcggttcgggggccaacgacggccgaacgtccccgtacgggtcctcggtccgtcgggtaacccgtaaggtaccctttaaccgtcccggtaacgttaaccctttaccgtaactttccggttagggaccgggtccggggtaccgttacgggccggaacgggtcccgtaacg

SEQ ID NO: 40784 - DNA, 679 bp, Homo sapiens
  misc_feature: GYAE6OF02F0AB4.29.14.B03.1.454.CMB.1.raw
  modified_base (644)..(644): a, c, t, g, unknown or other
  misc_feature (644)..(644): n is a, c, g, or t
  modified_base (668)..(668): a, c, t, g, unknown or other
  misc_feature (668)..(668): n is a, c, g, or t
tcagatagagtactcacgaccggtgctcgatttagtgtgagtagttccgcgggggcaggagtcagacccactcaggacacagcatggacatgagggtccccgctcagctcctggggctcctgctgctctggcctcccgaggtcgccagatgtcgaccactccagactcgaccctagttcctacctattacgttcctgtctgctatcgtaggtagagacgaggtatacgagcactctacgttcgggaccggtactaacgcgaggtactacgtaaccgaaagtgaagtaagtaacggtcgtaaggtacaaccgtaacgaaacggtaaacccggaaacggtaaccccttaccgtaccgttacctagtactcgtacgtcgccttacggaccttacttaacggtttacggaacgggttccggtaccctacgtaccgtaacggttcgaaccggtcggtacgtaggtggtacttcgtacggtactacgtagttaccttcctactccgtacctaacgtacacgtacgacctcgcctacgcgtactacgtagtactttcgtataccttaagttacttactacgtaactacgtaacttacgtaacctacgtacgtagtccggtacgtccggaacgtaaggtaactacgggtaanaacggtacgaagttcgtacggtancgtcgactacg

SEQ ID NO: 40785 - DNA, 696 bp, Homo sapiens
  misc_feature: GYAE6OF02FMXFD.29.14.B03.1.454.CMB.1.raw
  modified_base (691)..(691): a, c, t, g, unknown or other
  misc_feature (691)..(691): n is a, c, g, or t
  modified_base (696)..(696): a, c, t, g, unknown or other
  misc_feature (696)..(696): n is a, c, g, or t
tcagatagagtactcacgaccggtgctcgatttagtgtgagtagtttggggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaagtggagagcctgagactcgacgacacggccgtctattattgtgttaaagcgagctggaagtacggggacccggggcccgtacgttcgaccacgtcggggccgagggggaccgcgttggccgtaccgtcctcctcgacgccctaccaccgaacgggcccagtccggtcccttcccccgtcggccctacccctcccgtaccccaaggaccgtacccgacccgttccggtacggggggacccaaccgacgaccgaccggtccccggtcgggccgttcggtcccgttacgggtaccgtaaaccgggtaccctttaacccgtttaccgtaaccgtttaccttaccttaacgttccggttacggtacggtcccgggggtaccgttaccgggaaccggaacggggtccgaccgtacgttacggnacggn

SEQ ID NO: 40786 - DNA, 799 bp, Homo sapiens
  misc_feature: GYAE6OF02JD8VY.29.14.B03.1.454.CMB.1.raw
tcagatagagtactcacgaccggtgctcgatttagtgtgagtagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaacgtgggtccgccaggctccgaggggaagggctgggagtgggtctcggctattaggtgcaggtggtggcgctagtatagttatgacagaccgcccgtaggaacggggtcccgttacgacctactttccagacgactaattacggaagtaaccgacgtctgtaactctagactaaagtggacgacgcgtaggaagtaccgtaccgacgaccacgggtacccttagttaacgtttagtttacggttaagggtaaaacggtcggacgtacgtaagggtaaacggtacccgggggtacccggggtaccccggttaacggttacgtaacccgtaccgggtccggggtacccggacgggggtaccgtacggtccggttaccggttaccccgttccgttcccgtaccgtaccgcccgttaccccggaacccggtaacccggtaccccgtacggttccccggtttcccgttacccccgtcgggtacccccaccccgttcccgttaacccgaccggtaccgtaccccgtaaccgggttaccggtaccggggtaccgtaccggaaccggtacccgacccggtaccccgggttccgggtaccggttcccggg

SEQ ID NO: 40787 - DNA, 742 bp, Homo sapiens
  misc_feature: GYAE6OF02IWFPE.29.14.B03.1.454.CMB.1.raw
  modified_base (740)..(740): a, c, t, g, unknown or other
  misc_feature (740)..(740): n is a, c, g, or t
tcagatagagtactcacgaccggtgctcgatttagtgtgagtagtttgggggcgcctgggtacggccgggggggtcgctgagactctcctgtgcggcctctggattaagttttaggagtcatgccatgactgggtcccgccaggctccagggaaggggctggagtgggtctcggctattagtggcagtggtggcgctatatattatgcagaccgccctaggaacggggtccggttacacctatttccagagaacaattccgaaagaacacgcctgtactcgtgacgaaaagtggagacgtccgtaggaacgtacctcggacgaccgaccggtcccgttactaattagtttcgtaggttaaacggacggagtacgtaggtaacgtacccggggaccggggcccgtacgttacgacctacggtcgggacgacggggacgcgttacggtacgtaccgtcctcccgtcgacgtccctacccgaacccgaacggacccgtcgtacccggtcccgtttaccccccgcggtcccctaacccctccccgtaccgtaaaccgaccgtacccctacccgttaccgggtccggggacctaacccgaacgcccgtacccggtcgtccggtccctcgggttacctccgggtacgtaaaccgtaccgttaccctttaaccgacgttaccgcttaccgttacgtcggaaccggttccgggtaactcgggaaccgtcggccgtacgaataggtcgncg

SEQ ID NO: 40788 - DNA, 838 bp, Homo sapiens
  misc_feature: GYAE6OF02HPYCZ.29.14.B03.1.454.CMB.1.raw
  modified_base (148)..(148): a, c, t, g, unknown or other
  misc_feature (148)..(148): n is a, c, g, or t
  modified_base (171)..(171): a, c, t, g, unknown or other
  misc_feature (171)..(171): n is a, c, g, or t
  modified_base (212)..(212): a, c, t, g, unknown or other
  misc_feature (212)..(212): n is a, c, g, or t
  modified_base (273)..(273): a, c, t, g, unknown or other
  misc_feature (273)..(273): n is a, c, g, or t
tcagatagagtactcacgaccggtgctcgatttagtgtgagtagtttgggctgagctggctttttcttgtggctattttaaaaggtgtccagtgtgacgtgcagttggtggagtctgggggccgcctggggtaccggcgggggggtcnctgagactctcctgtgcggcctntggatttaagtttaggatcatgcctagtgaacgtgggtccncaggcctccgaaggggagggctgggagtgggtctcggctagttaggtgcaggtggtgcgtntattatattatgacagaccgccgtaggaacgggtccggttaccaccgtatttccaagtaacgactaacgttaaccgaagtaaccaccgtcgttacgtacgttaccacgtaacgtaaagttacgggaacgcgttaccgtgaaccgtactaccggacggaacctaacccgggttcgtaactttaagtttacgtttaaggtacggtttaaaagggtccggtaaggttacggtaacggggtaaccgggtaaccgggggtaccccgggggacccgttaaccggttcggaacccggtacgggttaccggggaccggggtaccggggtaccggtaccgggttcggttaaccccggttaccgttcccgttacccgtaccgtacgtcccctaacccggtaaaccccgaaccggggtaccccttaccgggttacccggttcccgtttccccgtccggtaccccgtaccccgttacccgtacccggtaaccggtacgtccccggtaaccggtccgggtacccggggactacccgggaccgtaccggcccggtaccccgggttggtcccgttaccgg

SEQ ID NO: 40789 - DNA, 951 bp, Homo sapiens
  misc_feature: GYAE6OF02ISCVQ.29.14.B03.1.454.CMB.1.raw
  modified_base (255)..(255): a, c, t, g, unknown or other
  misc_feature (255)..(255): n is a, c, g, or t
tcagatagagtactcacgaccggtgctcgatttagtgtgagtagtttggtggagtcgtgggggcgcctggggtacgggccgggggggtcgctgagactctcctgtgcggcctctggattaagttttaggagtcatgccatcggaacgtcgggtaccgaccgaggcctacccggaagggggaacggggctgggaggtcgggtctcgggacttattaggtggactagggtgggtcggcgtactaattattaattagngacaaggtcccgaccgtagggaacggggttcccggttacaaccgtacgtttacgaaggtaacgaactaaagttccggaaaagtaaaccgacggtaacttaggtaactacgtacgtaacgaaaacggtcgggtaacggtacgtaaccgtaaggtaacggaccgttaaccggaaaccggtaaccggaacccgggttacccgtttaacttaagttttaaacggtttgggttaaacggtttaaaaacgggcccgggtaagaaccgggttaaggggtaaaaccggggtaccgggggggttaaccccggaaccgggttaccttaaccgggaaacccgtcgggtaccgggggaccgtacggggtaaccgtcggtaccgttccgtaaacccccggttcgttacccaccggaacccgttcccgtaacccgaacccggtaaccgggccctaaaccggtccccggttacccgttaccccggtacgggtacccctaccccggttacctaaaccgtaaccggtaccggaaccgtacccgtacggggtacgggaaccgtacgaaccggtacaccgtaccggccgggtacgtaccgttacgggacgtaacccggaacggtccttaacccgttacgtaccgttacctaacttacggtaccgttacgaccgggtcggtaacggacggtaccggaacgggaccgtaacgtaacg

SEQ ID NO: 40790 - DNA, 858 bp, Homo sapiens
  misc_feature: GYAE6OF02GKP0Y.29.14.B03.1.454.CMB.1.raw
  modified_base (146)..(146): a, c, t, g, unknown or other
  misc_feature (146)..(146): n is a, c, g, or t
  modified_base (326)..(326): a, c, t, g, unknown or other
  misc_feature (326)..(326): n is a, c, g, or t
tcagatagagtactcacgaccggtgctcgatttagtgtgagtagtttgggctgagctggcttttcttgtggctattttaaaaggtgtccagtgtgacgtgcagttggtggagtcgtggggcgccgtgggtacggccgggggggtcncgtgacgactctcctgtgcggcctcgtggtattaaggttttaggagtcagtcgccagtacgaacgtcgggtcccgccgaggtccgtaccgaaggggaacgggcgtagggaggttcgggtcgtcggtacttagttaggtggcgtaggtgggtcggcgtacgttaagttattaagtttacgngtacgaacggtaccggtaccccgttaagggaaccggggtccccggttacaacccgttaacgttttaccgaaggtaacggtaaacgtaacgttaacggaaaacggtaacccgtacgaccgttaaggtacttaccgtagaaccgtaaaggtcggaagcgtccgtagacgtacgtaccgaacgaaccgtccggtaccgttaacttaagtttacgttggtaaacgggttaacggacggtacgtaccggtaaggtaacgggtaacccggggtacccgggacccttacggtaccgaccgtaccgggtacggggaccggacgggaccgtacggtcgttacccgtacccgttccgtaacccgtcgtacccgtacccgtacccgaaacccggtaccggtaccctacggttccccgttccccgtaccccggtacgtacccccgtacccgttacccgtaccggtaaccggcccgttacctaacccggtcgggaccggaacctacgtccggacccgaccggtcccggtcggtacccgttaccgg

SEQ ID NO: 40791 - DNA, 719 bp, Homo sapiens
  misc_feature: GYAE6OF02JR6X8.29.14.B03.1.454.CMB.1.raw
  modified_base (137)..(137): a, c, t, g, unknown or other
  misc_feature (137)..(137): n is a, c, g, or t
  modified_base (450)..(450): a, c, t, g, unknown or other
  misc_feature (450)..(450): n is a, c, g, or t
  modified_base (712)..(712): a, c, t, g, unknown or other
  misc_feature (712)..(712): n is a, c, g, or t
tcagatagagtactcacgaccggtgctcgatttagtgtgagtagttgggggcgtccgtgggtacggccggggggtcgctgagactctcctgtgcggcctctggattaagtttaggagtcatgccatgaactggtccncaggctccagggaagggctggagtggtctacggtctattacgtggctaggtggtggcgctagtatacttagtcgcacgtacgcccttggaacggggtcccggttcaacctagtttcccaagacgtactaacttcggaaagtaacccacgtcgttaggtactccgtagaaccgtaaatggggaacaagtcctggaacgtctacgacgaccgacggtaccgtactacgttattcggtagttaacggccgtacgctagggtaacgtacggggaccgggccgtaacgttcacccgtaggccgggacgacggggtacncgtaggcctaccgtctaccgtcgcgtccctacccgaacgacggttacccacgttcccgtacccttccccgtacggtcccgaccccgttccaccgtacgaccgtccaccggttcgacgggtcaccgtacgctacgtccgtcgccgtcgtccgtacgtaccgtaccgtaccgttacggtacctacgttccctacgttacgtaccgtacgggacggtaccggtccggtaccgaacgggtaccggacggtacctacggtacgtacncgtaacg

SEQ ID NO: 40792 - DNA, 881 bp, Homo sapiens
  misc_feature: GYAE6OF02G3XVB.29.14.B03.1.454.CMB.1.raw
  modified_base (338)..(338): a, c, t, g, unknown or other
  misc_feature (338)..(338): n is a, c, g, or t
tcagatagagtactcacgaccggtgctcgatttagtgtgagtagtttggtggagtctgggggcgcctgggtacggccgggggggtcgctgagactctcctgtgcggcctctggattaagtttaggagtcatgcatgaacgtggtccgccaggctccgaggggaagggctggaggtgggtctcggctagttagtggcaggtggtggcgctagtatattatgacagaccgcctaggaacgggtcccggttacaaccgtaactttccgaaggacgaactaaacgttacgaaaagaaccaaccggtcttagttaacgtcgtacgtaacgaaaagttgggaanaacggtccttaggacgtaaccgtccggaaccgaccggaaccggtccgttaccttaattttaaggtttggttaaaggttaaaagggacccgtaaggtaccggttaaggggtaaacgggttaaacccggggggacccgggggtaccccgttaaacgttacggaaaaccccggtcggggtaaccgggggaaccgaaacgggggcggtaccgttcgggtaccctacccggttaaccgtcccggtacgtaacgtacccccgtacccgaaacccgtaaaccgggacccccgttacggtacccggttccccgttcccccgtacgggtccctaacccgttacccctaacccgaacgaccgacctacccggtacggtacgggggcctacgacgaccgacccggtccggtcggtccgttaccggtaccgttaccgggtaccgaacgggtaaccctttacgttacccgaaccggtttaaccttaaccttaccggtaccttacgggtaacggaccggtccggtacgggaccggtaacggaccgtaaggtaaccgg

SEQ ID NO: 40793 - DNA, 776 bp, Homo sapiens
  misc_feature: GYAE6OF02IY4JK.29.14.B03.1.454.CMB.1.raw
  modified_base (124)..(124): a, c, t, g, unknown or other
  misc_feature (124)..(124): n is a, c, g, or t
  modified_base (173)..(173): a, c, t, g, unknown or other
  misc_feature (173)..(173): n is a, c, g, or t
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
tcagatagagtactcacgaccggtgctcgatttagtgtgagtagtttgggctgagctggctttttcttgtggctattttaaaaggtgtccagtgtgacgtgcagttggtggagtcgtgggggcnccgtggggtacggccgggggggtcctagagacctctcctgtgcggcctntggattaagttttaggatcatgccatcgaacgtgggtccnccaggctccgaggggagggcnggagtgggtctcgggcttagtttggnggcagttgggtcggcgtctatattattagtgcagaccgccctggaacgggtccggtacaccgtactttccgagacgtaactaacgttacgaaacgtaacctacggtctacgtattccgtggaactaaaagttgggaagtcgtaccgtagaacgtaccgtaccgaccgtaccgacggtccgttattacgttattggtacggttaaaggccggtagccgtagggtaacgtacccggggaccgggacccgtacgttacgaccgtacggtacggggccggtacgggtccggtcggtcggtaccgtccggttacctacccgtacgaccgtacccgtacccgaaccggaccggtacccgtaccgtttacccggttacccgtttcccccggtacggtacccccgttaacccctcccgttaacccggtaaggtacccggtacccgtaacccgggtcccgggtaacgggggtaccctacccggcggtacccgaacccggtccccggtaccgggtcccttcccggg

SEQ ID NO: 40794 - DNA, 549 bp, Homo sapiens
  misc_feature: GYAE6OF01EA66E.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagctggctttttcttgtggctattttaaaaggtgtccagtgtgaagtgcaactggtggagtctgggggaggcttggtacagcctggggggtccctgagactctcctgtgcagcctctggattcacctttagcaactatgccatgacctgggtccgccaggctccagggaaggggctgggagtgggtctcagttattagtgggagtggtgggggaacagtactacgcagactccgtgaagggccggttcaccatttccagagacaattccaagaacaccctgtatctgcacatgaacagcctgagagccgaggacacggccgtatactttctgtgacgaaagatctcgggtatgggcacgtagctggacaagcccccgtaaccctttgaaccttagttggggcctaacgggg

SEQ ID NO: 40795 - DNA, 573 bp, Homo sapiens
  misc_feature: GYAE6OF01AH2W3.19.6.A06.1.454.CMB.1.raw
  modified_base (456)..(456): a, c, t, g, unknown or other
  misc_feature (456)..(456): n is a, c, g, or t
  modified_base (507)..(507): a, c, t, g, unknown or other
  misc_feature (507)..(507): n is a, c, g, or t
tcagtactctcgtgcacgaccggtgctcgatttagatctactgacagggggagagaggagcccagccctgggatttttcaggtgttttcatttggtgatcaggactgaacagagagaactcaccatggagtttggctgagcgtggtcttttctagtggctattttaaaaggtgtccagtgtgaagtgcaactggtggagtctgggggaggcttggtacagccctggggggtccctgaggactctcctgtgcagcctctggattcacctttagcaactatgccattgacctgggtccgccaggctccgagggaacgggctggagtgggtctctagtttagttagtggggtagttgggtaggggaacagtactacgcagacgtccgtagaacgggccggttcaaccgtatttcccagacgactaattccaagaaccacctgtatctgcacatcgaacncgcgagagacgacgacgacgcggtactattacgttcgtgtacgacgaagtntcgtacgtatcgcgtacgtagcgtcgaccacgtacccgtaccttgacgttcggtcgggccgtacgg

SEQ ID NO: 40796 - DNA, 549 bp, Homo sapiens
  misc_feature: GYAE6OF01BQZ5E.19.6.A06.1.454.CMB.1.raw
  modified_base (410)..(410): a, c, t, g, unknown or other
  misc_feature (410)..(410): n is a, c, g, or t
  modified_base (441)..(441): a, c, t, g, unknown or other
  misc_feature (441)..(441): n is a, c, g, or t
tcagtactctcgtgcacgaccggtgctcgatttagatctactgacagggggagagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagactggcggaggcttggtccagcctgggcggtctctgagactgtcctgtcgaaccctctggggtctccgtcagcagcgactgtattgcctgggtccgccaggctccgagggaagaggccggagtgggtcgcgtaggtattttagtaggtgggacgacattctacggagactccagtggagggccgattcacatctccagacgtacttttcncagaacacactgtcttcttacaaatcgaacngcctaggacgggccgaggacaccgggccgtcttattattgtgtgagtagtttagtggcgtagtcggtcgtgggtggacgtagactcgacgtcggggccgtaaccgggg

SEQ ID NO: 40797 - DNA, 701 bp, Homo sapiens
  misc_feature: GYAE6OF01ANCAU.19.6.A06.1.454.CMB.1.raw
  modified_base (258)..(258): a, c, t, g, unknown or other
  misc_feature (258)..(258): n is a, c, g, or t
  modified_base (384)..(384): a, c, t, g, unknown or other
  misc_feature (384)..(384): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagcgtgtcgttttctaggtggctattttaaaaggtgtcagtgtgaagtgcaactggtggagtcgtgggggaggcttggtacagccgtggggggtccctgagactctcctgtgcagccctntggattcacctttagcaactatgaccatcgaccgtcgggcccgccaggcctccgaggggaacgggcgtggaggtgggtctacgtagttagttaggtgggaggtggggtaggggaacagtactacgngagaccgtcgtaggaacgggtccgttactaccgtactttaccgagaacgtaactaacttcccgaaagaaacccgtacccgtacgttaacttcgttaccggactaacctaataccgggaaacacgtacccgttaggaacggacggacccggaagggtacccgaaccgggtaccccgttaagtttaacgtttccgttaggttaggaaccgtaaaggtcttccggttagggttagtacgggacctacgtagtccggtacggactaacccggtaccccgtaccgttttacgaccttgggtaccgggcggtaaaccccgggg

SEQ ID NO: 40798 - DNA, 682 bp, Homo sapiens
  misc_feature: GYAE6OF01ATPGD.19.6.A06.1.454.CMB.1.raw
  modified_base (171)..(171): a, c, t, g, unknown or other
  misc_feature (171)..(171): n is a, c, g, or t
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (482)..(482): a, c, t, g, unknown or other
  misc_feature (482)..(482): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagcggtgtgttctaggtcggctaatttaaaggntcagtgtgagtgcaatggtggagtcgtggggagcttggacngccgtgggggtcctgagctctctgtgcgagcctgnggtattcacctttaagctaaaccttncactatcgtcgtcggccncgagcgtacggagggacggtgtggtggtcggtactaggtaggttagtagggtcgggtaggttacggggtacgggaactacgtaaccggtcgtacggacgtaccgtacgggacggtaacgggtccgtactaccgttcgtacgaggaactaacgtaacctaccgaacgtaaccctaccgtagtacttccggancgactactacgacgacgtaccgacgacgacgacggacgacgacgtacgtacgttacgttacgtagtacgtaacgtaacgtacgtacgtacggtacgtacggtacgtacgtacggtacggtaccggtaaccggtaacccgttaacccggttaacccgttacggttaccggttaccgggttaccgggtaccggtaacccggg

SEQ ID NO: 40799 - DNA, 595 bp, Homo sapiens
  misc_feature: GYAE6OF01ECFO9.19.6.A06.1.454.CMB.1.raw
  modified_base (297)..(297): a, c, t, g, unknown or other
  misc_feature (297)..(297): n is a, c, g, or t
  modified_base (379)..(379): a, c, t, g, unknown or other
  misc_feature (379)..(379): n is a, c, g, or t
  modified_base (492)..(492): a, c, t, g, unknown or other
  misc_feature (492)..(492): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagcgtgtcgttttctaggtcggctattttaaaaggtgtcagtgtgaagtgcaactggtggagtcgtgggggaggcttggtacagccgtggggggtccctgagactctcctgtgcagcctctggattcacctttagacaactatgccatgacctggtccnccaggctccgaggggacgggctggagtgggtctcgtagttataggtgggagtgggtggggaacagtactacgcagacgtcgngacgggccgttcacctattccaagacgtaactaacttccgaaagtaacccacctgtaactctcgcaacatagacagcctgacgacgcgaggacacggtccgttaatctttcgngtgacgaaagtctcgtacggtatcggtcgtaactagcgtacggacctaaccggtaccccgttaaccttaggaaccttacggttccggggaccgtaaacccggg

SEQ ID NO: 40800 - DNA, 836 bp, Homo sapiens
  misc_feature: GYAE6OF01E0KR9.19.6.A06.1.454.CMB.1.raw
tcagtactctcgtgcacgaccggtgctcgatttagatctactgacagggggagagaggagcccagcccctgggattttcaggtgttttcatttggtgatcaggactgaacagagagaactcaccatggagtttgggctgagctggcttttcttgtggcttattttaaaaggtgtccagtgtgaagtgcaacgtggtggagtcgtgggggagcttggtacagccgtgggggtccctgagactctcctgtgcagcctctggattccacctttagcaactatgccatcgaccgtgggtcccgccaggcctccgagggggaaggggcgtgggaggtggggtctcgtagtttattaggtgggaggtggggtaggggaacagtaacgtacgacacggacctccggtaggaacggggcccggttacacccgtattttcccgaaggacgaactaactttacccgaaacggtaaaccctaccccgtaggttaacttccttacggacctaacaacgttacggaaaccgtaacggtccccgttagggaacggaacggaccccgggaagggaacccgtaacccggggtacccggttaaacgttttaacgttttacccgttagggttaccggaaccgggtaaaaacggtaccgttaccggttaccgggtttaaacggtaccggggttaaccgtaaacccggttaaacgggtcccggtttaaccggggaacccgtaaaacccccggggttaacccccccggtttaaaacccccggtttttacgggaaaaccccggttttacggggttttaaccccggggggggaacccccgttaaaacccccgggggggg

SEQ ID NO: 40801 - DNA, 724 bp, Homo sapiens
  misc_feature: GYAE6OF01D166V.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagctggtctttttcttgtggtctattttaaaaggtgtccagtgtgaagtgcaactggtggagtcgtgggggaggtcgttggtacaggtccgtggggggtccctggacgtactcctcctgtcgcagcctgtggtacttctacctttagacaacttatcgcctatcgacccgtgggtcccgccgaggccgtacggaggggaagggcgttgggaggtgggtctcgtaggtttagttagggtgggtaggtggggtacggggaactagtacctacggacgagtaccgtaccggtgggaaaccgggtccggtttaaccaaccgttacgtttacccaagggtaactaaccgttaaacttacccgaaaacgtaaccctaccttaggtaactcgtacgacaactagtacgaacacgtccgtaggacgtacggaccgaacggtacgaccggttaccgtattacgtttcgtaggtacaacggaaagtcttaccgttacggtacgtggaccgtacgtaggtaccgtcggaaccgaacccggtacccccgttaaaccgtttggaaccgtttcgggttaccggggacccgtaacccgggg

SEQ ID NO: 40802 - DNA, 805 bp, Homo sapiens
  misc_feature: GYAE6OF01E4Q31.19.6.A06.1.454.CMB.1.raw
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
tcagtactctcgtgcacgaccggtgctcgatttagatctactgacagggggagagaggagcccagccctgggatttttcaggttgttttcattttggtgatcaggactgaacagagagaactcaccatggagtttgggctgagcggtgtgttcaggcgctaattaaggntcngtngagtgcatggtgagtcgtgggagcgttggacagccgttggggcctgactctctcngtncgncctgngtacttcgtacttanctaagtatcgaccagtcggtacccgtggtcccgcgtaacgtcccgtaccggaagggggaacgggtccggtaagggtcggttagggtcttaccgggtaagtttttacggtaaggggttcgggttaaggtcggggttaaccggggaaattcgttaaaccgtcggtacgaacggttaacccgtgggtaacgggtaaccggggttcccgtaacgtttaacccctagttttaaccccgagtaaacggtaccttaaacggtttaccaaaccggttacctaaccggtttctaaccttggaaccgttacgaacctaaagttccgaaacgtacgtccggttaaggaccgtacgtaccgggacgttacgtaaccgggtacttacggttacgtttcgaccgttggtaaaccgaacgtcggttaacccgggtttacgtaaccggggtaacgttaccgtacccgttaggtacccgggttaacgtacccgttaaccccgggttaaccccgttaccggttaacggttaccggttaaccggggttaaccgaacccgggttaaccg

SEQ ID NO: 40803 - DNA, 714 bp, Homo sapiens
  misc_feature: GYAE6OF01BV1JI.19.6.A06.1.454.CMB.1.raw
tcagtactctcgtgcacgaccggtgctcgatttagatctactgacagggggagagaggagcccagccctgggatttttcaggtgttttcatttggtgatcaggactgaacagagagaactcaccatggagtttgggctgagctggtctttttcttgtggcttattttaaaaggtgtccagtgtgaagtgcaactggtggagtcgtgggggaggcgttggtacagccgtggggggtccctgagactctcctgtcgcacgcctctggattcctaccttttagccaactatcgcctatcgaccgtgggtcccgccgaggcctaccggaagggggaaggggcgtgggaggttcgggtctacgtagttagttaggtgggtaggtggggtaggggaactagtaacgtacgacagacctccggtaggaacgggtccggttcacccgtagtttaccgaaggacgaactaacgtttaccgaaacgaaccctaacccgttagttacgtccttacgacctaactagtacgaaacgcgacctggaacgacggccggaacgggaccaccgggtaccgttaatttaccgtttcgttacgggtacgaacggtaaacgtcgtacgttacgggtaatcgggtaccacggttagccggtacggacccgaaaccggtccccgttaaacccgtttacgtacgtttacggttcggggaacccgtaaacccggggg

SEQ ID NO: 40804 - DNA, 712 bp, Homo sapiens
  misc_feature: GYAE6OF01BJ4D2.19.6.A06.1.454.CMB.1.raw
  modified_base (175)..(175): a, c, t, g, unknown or other
  misc_feature (175)..(175): n is a, c, g, or t
tcagtactctcgtgcacgaccggtgctcgatttagatctactgacagggggagagaggagcccagccctgggattttcaggttgttttcatttggtgatcaggactgaacagagagaactcaccatggagtttgggctgagcggtgtcgtttcaggtcggacttaatttaaaggngtcagtgtgaagtgctaagtggtggcgtcggtgggggcgtcttggacaggccggtcgggggtcctggagtcttctccgtgtcgcgtagcctgtaggtattcctacttttaagccaaacgttgcgtactagtccggtaccggtcggtaccgcgacggtccgacgggtaggggacgggtgtagggtcggtcggtagtacgttaggtttaggttagggtgggtagggtaggggtaccggtaactacgtaacgcgagtacgtaccgtcggtacgggtacggtccgtaactacgtagtacggagtaacgtactaactacgaactaaccgtaccgtagtacgtagacgtactaacgtaacgtaacgaacgacgtacgtacggaacggaacggacggaaccggaacggtaaccgtacgttacgttacgttacgtacgtacgtaacgtacgtacgtacgtacgtacgtacgtacgtacgtacgacggtccgaccgtaccgtacccgtaccgttacgttacgtacggtacgggtaccggtaaccgg

SEQ ID NO: 40805 - DNA, 894 bp, Homo sapiens
  misc_feature: GYAE6OF01BWT5Y.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagcgtggtcttttctagtggctattttaaaaggtgtccagtgtgaagtgcaactggtgagtcgtggggagcttggtacagccgtcgggggtcctgagactctcctgtgcacgcctcgtggacttcctaccgtttagacctaacttatcgacctagtacgacccgtcggggtcccgccgacgggtcctccggaagggggaacgggtcgtggaggtggtctcgtaggttagttaggagggtagtggggtacggggaacagtaaccgtacggacaacggtaccgttccggtagggaaccgggtcccgtttaccgaacccgttactttaccccgaaggtaaccgtaaccttaaacgttacccgaaacgtaaccccgttaacccgtttacggtaacttccgttaaccgtaccggaaaccttacggttaaccgtaaacccgtaacccggtacccggttaaggaaaccggaacccgggggtaccccgggtaaaaccgggaaccccgggttaaccccgggtaccccgggttttaaaacgtttacgggtttttttaaccggtaaccgggttaaaccgggtaaccgttaaaaaggggttcccgttaccccgggttacggggttaaaccgtccgggttaaaccggtaaccgttaacgggttaccccgggagtaaccccggtaaccggtaaacccccccgttttaaccggtttaccgggtaaacccggttacgggtttaccgggggaacccccggttaaacccggggg

SEQ ID NO: 40806 - DNA, 704 bp, Homo sapiens
  misc_feature: GYAE6OF01CI5E6.19.6.A06.1.454.CMB.1.raw
tcagtactctcgtgcacgaccggtgctcgatttagatctactgacagggggagagaggagcccagccctgggattttcaggttgttttcatttggtgatcaggactgaacagagagaactcaccatggagttgggctgagctggtattttcctttggcttaattttaaaaggtgtccagtgtgaagttcagcgtggtggagtcggtgggggagtcttggtacaggccgtggctacgggttccctggacgtactctccgtggtcgcgacgtccttgtggtacttccgtaccgttttagattgtaattagtcgcctagtcgacctacggtcggggtacccggataacgccggtaccggaaggggaaccggtccgttaggggagttcgggtcttaggaggtttattagggtagaagttagtcgtagttaaggtatacgacctaggtcggacgtactcgtaggtaggaacggtcctaattccacctatccctaccgaagaacgtaccaaccggacctaaaaccgtcctacccgttagtactaccgtagaacctaaagttcgaaaccgtgttaccgaggaggaacgtcgtaaggacggtaccgacgttacgtttagtactacgtaggtaccgaaggtaagggtataacggttacgaccgtaggtaaccgttaccggtagggtaacccgttaaccgtgggtaacccgggg

SEQ ID NO: 40807 - DNA, 845 bp, Homo sapiens
  misc_feature: GYAE6OF01D2HR0.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagctggtctttttcgttgtggtcttattttaaaaggtgtccagtgtgaagtgcaacgtggtggagtcgtgggggaggtcgttggtacgaggccggtcggggggtccctggacgacctccgtccgtgtcgcacgtccgtcgtggtacttccgtacctttacgacctaactatcgcctagtcgacccgtcgggtcccgccgacggtccgtaccggaggggacggggcgtgggaggtcggtctacgtagtttagttaggtgggtaggtgggtagggaactacgtaacgtacgacaaggaccgtacgggtaggtaaccggggtcccggttacgaacccgttaacgtttaccccgaaggtaacgtaaccgtaaaccttaacccgaaaacgtaaaccccgtaccccgttagttaccgttcccgtacgaacctaacgaacgttaacggaaaccgtaccggtacccgtagaacgggtaccggaacccgggaacggtaacccggtaacccggggtaccgtttaacgtttacggtttttaccgttaacgggtaggtaaaccggaaacgttaccgttccggttaaccggttagtaccgggaccgtaacggttacggacccggttacggaaccccgtaaacccgggtacccccggttaaacccgtttacggtaacccggtttaacggggttcccggggtaaaccccggtaaacccgggg

SEQ ID NO: 40808 - DNA, 701 bp, Homo sapiens
  misc_feature: GYAE6OF01CQ9F1.19.6.A06.1.454.CMB.1.raw
  modified_base (305)..(305): a, c, t, g, unknown or other
  misc_feature (305)..(305): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
  modified_base (617)..(617): a, c, t, g, unknown or other
  misc_feature (617)..(617): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagctggtctttttctgtggtctattttaaaaggtgtccagtgtagaagtgacaacgtggtgggagtcggtggggggaggcgttggtacgacggccgtgggggggtcccctggacgtcctctccgtgtcgcacgtcctgtgtactcttacttacactactactcgacngtaccgtaccggtccggtcccgccgacggtccgacgggggaacgggggaggtcggtagggtaggttcggtcgttagttaggtttagttgggtagggtaggggtgggggaacgggtaatacgttacgtacgacgacgtaccgtcggacgggtacggtccgtactaccttacttaccgagacgaactactaaccgaaacaccttaccgtntaacnccgtanacaactaggaccaacgtctacgaggacgtaccgaacgacgtacggaaccgttacttaattccggttgaggactaacgatcgttaccggagtcncggactaacggtgtacgcggaccgtaaccccgttaccgttaccttagggaacgtttcgggggcccgggtacccggtaaaccggg

SEQ ID NO: 40809 - DNA, 884 bp, Homo sapiens
  misc_feature: GYAE6OF01EGNE7.19.6.A06.1.454.CMB.1.raw
  modified_base (326)..(326): a, c, t, g, unknown or other
  misc_feature (326)..(326): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagcgttggtctttttcttgtggtacttaagttttaaaaggtgtccagtgtgaagtgcaacgtgggtggaggtcggtgggggaggtcgttggtacgacggccggttcggggggtcccctaggacgtaccttcctccgtgtcgccgacgcccgttcgtcggtacttacctacctttaacgactaaacttntacgccctagtcggtacccgtcgggtccccgaccgaccgggtccgtaccggaagggggaacggggcggtggggtacggttcgggtacctacggtaaggtttagtagggtggggtagggttggggtaaggggaacgtacgtaaccgtaaccggacgtaacgtaccggtaccgggtacgggtaaccggggtcccggttacctaccgttacgtttaccggaaggaaccgtaactaaaccgttacccgaaacggtaacccctaccgtagttactacgtcgaccaataacgtaacgaaccgtacggacccgaaggaacgaccgggaaccccggtaaacggcccgtaaccggggttacccttaagttttacgttttaccggtgggtaacgttaaaccgggaagtttaccgtccgggttaacggtttagggtacccggtacgtaaacccggttacggtccggttaccgggaaacccgtaacccccgggtacccccgtttaaaccggttttacggaaccggtttacccggggttcccggggggaaaccccgttaaacccccggggg

SEQ ID NO: 40810 - DNA, 767 bp, Homo sapiens
  misc_feature: GYAE6OF01DCWX0.19.6.A06.1.454.CMB.1.raw
  modified_base (439)..(439): a, c, t, g, unknown or other
  misc_feature (439)..(439): n is a, c, g, or t
  modified_base (658)..(658): a, c, t, g, unknown or other
  misc_feature (658)..(658): n is a, c, g, or t
tcagtactctcgtgcacgaccggtgctcgatttagatctactgacgagggggagagaggacgcccagccctgggtattttcgaggttgttttcagtttggtgatcgaggactagaacagagagaactcacagtggtagtttgggctgagtcgttggttctttttcgtggtcggtactttaagtttaaaggtcgtcgagtgtagacgtgacctagtggtcggtagtggtggggagtcgttaggtacgcggtccgggtcggggtccttaggacgtacctcgttccgtggtcgacgtacgtccgttcgtaacggttccttacgttaccgttacgactaacctgttaccgacgttacgtcgtaccggtcggacccgtacgacggccgttaacgggagggtaacggtcgtgggtacgtcggtacttagtagttaggttggtggnggttagggacggtaatacgtagtaccgatacggttacggcgtagggtaacgtccgtaacacgtttacctacggagtaaacctaacttacgtaaccgaacctaacggtccctagtactaccgtagccctaagtacggtaactacgacgtcggaacgacgttaccgggaacgaccgtaccggtacgttacgtttagttacgtcggtagtacgaaccggtancccgttaggttacgactaggtaccgtcgtaaggccggtacctacccggtaacccgttacccgttaaccgtgggtttaaccgtccgggaccgggtaccgttaaccccggg

SEQ ID NO: 40811 - DNA, 744 bp, Homo sapiens
  misc_feature: GYAE6OF01E4OOZ.19.6.A06.1.454.CMB.1.raw
  modified_base (176)..(176): a, c, t, g, unknown or other
  misc_feature (176)..(176): n is a, c, g, or t
tcagtactctcgtgcacgaccggtgctcgatttagatctactgacagggggagagaggagcccagccctgggatttttcaggtagtttttcatttggtgatcaggactgaacagagagaactcaccatggagtttgggctgagctggtctttttcttgtggctatttaaaacggtntccagtgtgaagtgcaacgtggtggagtcggtgggggaggtcgttgggtaacagcccggttgggggggtcccctggacgacttccgtcctggtgcacggcccttcgtggtacttcctacctttagacctaacttatcgccagtcgaccgtcgggtcccgccgacggccgtacggaaggggaacgggcgtgggaggttgggtactgtagtttagttaggtgggtagtggggtaggggaactataaccgtacgacgtacggtaccgtaccggtaggaacgggtcccggttacaacccgttacgtttaccgaagtaacgaacctaacgttaacccgaacgtaaaccctaccctagtactcgtacgacactagtacgaacgtacgccgtaggacggacgaccgacggaaccgtccgggtaaccgttattacgtttcgtacggttacggaacggtaaagtaccgttacgttacggtacgccggtacgtaccgttaaggccgtaccggaccgtaacccggtaccccgtaaccccgtttgaaccgtttgggttacccggggaccgtaacccgggg

SEQ ID NO: 40812 - DNA, 659 bp, Homo sapiens
  misc_feature: GYAE6OF01BZCUR.19.6.A06.1.454.CMB.1.raw
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (283)..(283): a, c, t, g, unknown or other
  misc_feature (283)..(283): n is a, c, g, or t
  modified_base (331)..(331): a, c, t, g, unknown or other
  misc_feature (331)..(331): n is a, c, g, or t
tcagtactctcgtgcacgaccggtgctcgatttagatctactgacagggggagagaggagcccagccctgggattttcaggtgttttcatttggtgatcaggactgaacagagagaactcaccatggtagtttgggctgagcggtcgtgttcgtagcggctaatttaaaggngtcagtntgagtgcaatggtgagtgtgggnggtgttgacngcgtcggggtccgtgagctctccgtgtcgcgacgctcctgtacgttctacccgttagtactaaacttaccncgtactacgtacgtccgtcggtccgccgcggcgacggacgggtacggnggtcggtggtaggtcgtacgtagttagttaggtagggtaggtagggtacggtacgtacgtacgtacgacgacgtaccgtacggtacggtacggtaccgtacgtacgtacgtacgtacgtacgtacgtaacgtacaacgtaaccgtaccgtactactacgtacgacactacgacgtacgacgacgacgacgacgtcgacgacgtacgtacgttacgttacgttcgtacgtacgtacgacgtacgtacggtcgtacgtacgacgtacgtacgtacggtacgaccgtaccgtaccgttacgttacgtacgtcggtaccggtaccggtccgg

SEQ ID NO: 40813 - DNA, 539 bp, Homo sapiens
  misc_feature: GYAE6OF02HZCNB.19.6.A06.1.454.CMB.1.raw
  modified_base (429)..(429): a, c, t, g, unknown or other
  misc_feature (429)..(429): n is a, c, g, or t
  modified_base (488)..(488): a, c, t, g, unknown or other
  misc_feature (488)..(488): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagcgtggtcgtttttcttagtggctattttaaaaggtgtccagtgtgaagtgcaactggtggagtctgggggaggcttggtacagcctgggggtccctgagactctcctgtgcagcctctggattcacctttagcaactatgccatgacctgggtccgccaggctcccgagggaaggggctggagtgggtctcagttattagtgggagtggtggggaacatactacgcagactccgtgaagggccgttcaccatttccagagacaattccaaagacaccctgtatctgcanatgaacagcctgagagcgaggacacggccgtatatttctgtgacgaaagatctcggtanggcacgtagctggacaagcccgaacctttgactagttcgggcctaacgggg

SEQ ID NO: 40814 - DNA, 554 bp, Homo sapiens
  misc_feature: GYAE6OF02G5HXM.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagctggctttttcttgtggctattttaaaaggtgtccagtgtgaagtgcaactggtggagtctgggggaggcttggtacagcctggggggtccctgagactctcctgtgcagcctctggattcacctttagcaactatgccatgacctgggtccgccaggctccagggaagggctggagtgggtctcagttattagtgggagtggtgggggaacagtactacgcagactccggtgaagggccggttcaccatttccagagacaattccaagaacaccctgtatctgcacatgaacagcctgagacgccgaggacacggcctatactttctgtgacgaaagatcgtcggtatggcacgttagcgtggacaacggccccgtaacccgtttgaccttaggttcggggaccctaacgggg

SEQ ID NO: 40815 - DNA, 528 bp, Homo sapiens
  misc_feature: GYAE6OF02G2037.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagctggctttttcttgtggctattttaaaaggtgtccagtgtgaagtgcaactggtggagtctgggggaggcttggtacagcctgggggtccctgagactctcctgtgcagcctctggattcacctttagcaactatgccatgacctgggtccgccaggctccagggaaggggctggagtgggtctcagttattagtgggagtggtgggggaacatactacgcagactccgtgaagggccggttcaccatttccagagacaattccaagaacaccctgtatctgcacatgaacagcctgagagccgaggacacggccgtatatttctgtgcgaaagatctcggtatggcactagctggcaagcccgaccttgactagttgggcctacggg

SEQ ID NO: 40816 - DNA, 539 bp, Homo sapiens
  misc_feature: GYAE6OF02FX7NY.19.6.A06.1.454.CMB.1.raw
  modified_base (477)..(477): a, c, t, g, unknown or other
  misc_feature (477)..(477): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagcgtgcgttttctaggtggctattttaaaaggtgtccagtgtgaagtgcaactggtggagtctgggggaggcttggtacagcctggggggtccctgagactctcctgtgcagcctctggattcacctttagcaactatgccatgacctgggtccgccaggctccagggaagggctggagtgggtctcagttattagtgggagtggtgggggaacatactacgcagactccgtgaagggccggttcaccatttccagagacaattccaagaacaccctgtatctgcacatgaacagcctgagagccgaggacacggccgtatattactgtgacgaaagntctcggtatggctactagctggcaagcccgaaccctttgaacctagttcggggcctaacggg

SEQ ID NO: 40817 - DNA, 657 bp, Homo sapiens
  misc_feature: GYAE6OF02JR5MQ.19.6.A06.1.454.CMB.1.raw
  modified_base (257)..(257): a, c, t, g, unknown or other
  misc_feature (257)..(257): n is a, c, g, or t
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (417)..(417): a, c, t, g, unknown or other
  misc_feature (417)..(417): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagcgtgtcgttttctaggtggctatttaaaaggtgtcagtgtgaagtgcaatggtggagtcgtgggggaggcttggacagccgtgggggtcctgacgctctcctgtgcagcctcgtggnttctacctttagcaactatcgcctatcgaccttcgggtccgcaggcnccggagggagggctggagtgggtcctgagttagttggngggngttgggaggggaacagttacgacgcgagacgtccgagggaacggcggttacaccgtagtttacccaggtanaactaagttccgaaaggtaaccaccctaggttaactccgttaagcgacactacgaacgacgacgtacgacgacgaccggacggaaccgacggaccgtacgtaacgtttacgtgttacgtaacggaaagtaacgttacgtaccggttagttaggtacgtacgtacgtacggtacgtaccgaaccgtacccggttaacccgttaaccgttacgttacggttaccgggtaccggtaacccggg

SEQ ID NO: 40818 - DNA, 657 bp, Homo sapiens
  misc_feature: GYAE6OF02GEE0F.19.6.A06.1.454.CMB.1.raw
  modified_base (177)..(177): a, c, t, g, unknown or other
  misc_feature (177)..(177): n is a, c, g, or t
  modified_base (210)..(210): a, c, t, g, unknown or other
  misc_feature (210)..(210): n is a, c, g, or t
  modified_base (268)..(268): a, c, t, g, unknown or other
  misc_feature (268)..(268): n is a, c, g, or t
  modified_base (360)..(360): a, c, t, g, unknown or other
  misc_feature (360)..(360): n is a, c, g, or t
  modified_base (490)..(490): a, c, t, g, unknown or other
  misc_feature (490)..(490): n is a, c, g, or t
tcagtactctcgtgcacgaccggtgctcgatttagatctactgacagggggagaggaggagcccagccctgggattttcaggtgttttcatttggtgatcaggactgaacagagagaactcaccatggagtttgggctggagcgtggtcgttttctaggtggctaattttaaaaggngtaccagtgtgaaggtgcaatggtggagttcgngggggttagcttgggtacaggccgtggggggtccccgagactctacctgtgcagcctntggattcaccttgacaactatgccatgaccgtgggtccgacgacggctccgaggggaacgggcgtggagtgggtctacgtagttagttaggngggtagtgggtggggaacagtacgtacgacaggactcggtagaacggggccgttacaactagtttccaaggtacaactaacgtttaccaaacgaaccctacccgtagttactcgtagacaacatggaacngtacgagacgagccggaggaccacggaccgtattaacgtttcgagtcgaacgaaagtcgtacctaggtagtacggactaagtacgttcgtacggtaccaacccggtaccccgttaacccgtttggaacgtttaacggttccgggggaacccgtacgggtaaacccgg

SEQ ID NO: 40819 - DNA, 581 bp, Homo sapiens
  misc_feature: GYAE6OF02IQZBR.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagctggctttttcttgtggctattttaaaaggtgtccagtgtgaagtgcaactggtggagtcgtgggggaggcttggtacagccgtgggggtccctgagactctcctgtgcagcctctggattcacctttagcaactatgccatgacctggtccgccaggctccgaggggaaggggcgtgggaggtggggtctcgagtttagttaggtgggagttgggtagggggtaacagtactacgcagactccgtgagggtccggttcacctatttccagacgaactaataccaagaaaccacctgtactctcgcacatcgaacagcctagagacgccgaaggaccacgggtaccgttaatactttcgtgtcgaacgaaagtactcgtacggtatggactactagcgtggcaacgcccgtaaccgttgacttagtcgggacctaaccggg

SEQ ID NO: 40820 - DNA, 696 bp, Homo sapiens
  misc_feature: GYAE6OF02G9U0H.19.6.A06.1.454.CMB.1.raw
  modified_base (144)..(144): a, c, t, g, unknown or other
  misc_feature (144)..(144): n is a, c, g, or t
  modified_base (172)..(172): a, c, t, g, unknown or other
  misc_feature (172)..(172): n is a, c, g, or t
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (524)..(524): a, c, t, g, unknown or other
  misc_feature (524)..(524): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagcggngtgtttctaggtcggctaatttaaaggntcagtgtgaagtgcaatggtggagtcgtgggggagcgttggtaacngccgtgggggccctgagctctctgtgcngcctctggcttcaccttttagcaactatcgccagtcgaccttgggtacccgccgaaggtcctccggaaggggtacgggggccttggggaaggttcggggtcctacgtagggtttaattggttcggggtaagtgggggttagggggaaacctattaccgtaagccgaggtacctccgggttaggaaggggtccgttacgtaaccgttctttaccgagacggtaactaacttaccacggtaaacctcctaggtcttaccgtgacacctatcggtaaaccncgtcctagacgacgaccggaggtaccgacggttacgttagttactttcggagtacggtaacgtaaacgtcgttacgtaccggttagtccggacgtacgtacgtccgtacggaaccgtaccggttacccggttaccgttacgttaccggtacggtaccgggaaccgtaccggg

SEQ ID NO: 40821 - DNA, 728 bp, Homo sapiens
  misc_feature: GYAE6OF02G72KW.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagcgtggcttttctgtggctattttaaaaggtgtccagtgtgaagtgcaactggtggagtcgtgggggaggcttggtacagccgtgggggtccctgagactctcctgtgcagcctctggattccacctttagcaactatgccatcgaccgtcgggccgccaggctccgaggggagggctgggagtgggtctcgtagttattaggtgggagttgggtgggggaactagtactacgcagtacctcggtagaacgggtccgttacacctacgtttaccgagacacgtaacgtcccaaagtaacccacccgttagtaaccgtcgttacgacgtaacagttacgaacgtaacggcccttaggacgtaaccgaccggtaacggaacccgaccgggtaacccgttagtttaacgtttccggtacggttacgtaacccgggtaaaagttaccgttaccgttaccggggttagttacgggtacccgtaacggttaacggacccggtttacggaacccgtaacccggttacccccggtaaaccccgtttttagggaacccgtttacgggttacccgggggtaccccgtaaacccgggggg

SEQ ID NO: 40822 - DNA, 615 bp, Homo sapiens
  misc_feature: GYAE6OF02FPZQI.19.6.A06.1.454.CMB.1.raw
  modified_base (471)..(471): a, c, t, g, unknown or other
  misc_feature (471)..(471): n is a, c, g, or t
tcagtactctcgtgcacgaccggtgctcgatttagatctactgacagggggagagaggagcccagccctgggattttcaggtgttttcatttggtgatcaggactgaacagagagaactcaccatggagtttgggctgagctggctttttcttgtggctattttaaaaggtgtccagtgtgaagtgcaactggtggagtcgtgggggaggcttggtacagccgtgggggtccctgagactctcctgtgcagcctcgtggacttctacctttagcaactatcgccatcgaccgttgggtctcggccacggcctccgaaggggaacggggtcgtggaggtgggtctcgtaggtttaattaggtgggtaggtgggtagggggaacagtactacgcagactcggtaggaacggccgttcacctattccagagactaataccaagaaccaccctgtaactcgtgacacatagaacngtccctagacgacgcccggaaggaccaacgggccttaattacgtttcgtgtgaccgaaagtactcgtacggtatcgggctaacgtaggcgtacggcaaccggaccccgttaaccgtttacgaccgtttaggtcggggtaacccg

SEQ ID NO: 40823 - DNA, 779 bp, Homo sapiens
  misc_feature: GYAE6OF02FT1QJ.19.6.A06.1.454.CMB.1.raw
tcagtactctcgtgcacgaccggtgctcgatttagatctactgacagggggagagaggagcccagccctgggattttcaggttgttttcatttggtgatcaggactgaacagagagaactcaccatggagtttgggctgagcgtggtctttttcttgtggcttaattttaaaaggtgtccagtgtgaagtgacaacgtggtggagtcgtgggggaggtcgttggtacacggtcccggttcggggggttccctggagtaccttccgttccgttggtcgcgacgtcccttcgtggtactttcctaccgtttagacctaactatcgacctagtcgacccggttcgggtcccgccgtacggtcctaccggaaggggggaacggggcgtggggtacggttcgggtctacgttagtttacgttagggtggggtaggttgggggtacggggaactaacgtaccgtacggacgacggtaccgtccggtagggtaacggggtccggttacctacccgttactttaccgaacggtaacgtaacgtaacgtttaccgaaaacgtaaccctacccgttagttacctcgtacgacctactagtacgaaccgcgtaccgtagaccggacggtaccggaacggcccgtaacggtacccgttaatttcgtttacgtggtaacgacggtaaacgtcttccggttacggtacgcggtacgtacgtacggtcgtacggacctaccggtaccccgttaccgtttacggaccgtttcgggtacccggggccctaaccggg

SEQ ID NO: 40824 - DNA, 813 bp, Homo sapiens
  misc_feature: GYAE6OF02IJQKD.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagctggtctttttcttgtggtctatttaaaggtgtcctagtgtgaagtgcaactggtggagtcgtgggggaggcttggtacaggccgtgggggtccctgacgactctccttggtgctagcctcgtcggtacttccgtacctttaggacctaacttactcgccgtatcggtaccgtcggggttcccgcccagggtccgtcccggtaaggggggaacgggggtccttggggaagggttcgggttccgttacgtaggttttaagttagggtgggggtaaggttgggggtacgggggtaaactaggttaccgtaccgggcgtaacggtaccgttccgggtaggaacggggtccggtactaaccgtacgttacccgaaggtacgaactaacgttaccgaaacgtaacgtacccgtgtactctcgactactacgtacgaacgtacgtacccgtggaacgtacggaacggaccgggaaccgaacccgggtaccggttactttacgttttaccggtacgttaacgtacccgggtaaaaacgttcgtttacgtaccgggttagtacgggtaccgaacggttaaccgccggttaaccgggaaccgttaacccgggttaacccccgttaccccggtttacgtaaaccccggtttgggtaccccggggtacccgttaaacccggggg

SEQ ID NO: 40825 - DNA, 635 bp, Homo sapiens
  misc_feature: GYAE6OF02IKJXG.19.6.A06.1.454.CMB.1.raw
  modified_base (261)..(261): a, c, t, g, unknown or other
  misc_feature (261)..(261): n is a, c, g, or t
tcagtactctcgtgcacgaccggtgctcgatttagatctactgacaggggggagagaggagcccagccctgggattttcaggtgttttcatttggtgatcaggactgaacagagagaactcaccatggagtttgggctgagctggctttttctgtggctattttaaaaggtgtccagtgtgaagtgcaactggtggagtcgtgggggaggcgttggtacagtccgtgggggtccctggagacctcgtcctgtgcacgcctntggattcacctttacgctaactatcgccatgaccgtgggtccgccgacggtcctccgaaggggaacggggtcgtagggaggtgggtctcgtagtttattaggtgggtaggtgggtaggggaacagtacgtacgcacgctcggtaggacggtccggttcaaccgtactttaccgagtaacgaactaagttaccgaaagtaaccacccgtagtactctcgacaacatacgaacacgtccagacgacgccggaacggacgacggtaccgtactacttcgtgtacgacgaaagtcgtacgtggtatcgacgtaactcgcgtcgaaccaccggacccgttaccgttagaaccggttacggtccgggacccgtaaccggg

SEQ ID NO: 40826 - DNA, 846 bp, Homo sapiens
  misc_feature: GYAE6OF02GC6HW.19.6.A06.1.454.CMB.1.raw
tcagtactctcgtgcacgaccggtgctcgatttagatctactgacagggggagagaggagcccagccctgggtattttcaggttgttttcatttggtgatcaggactgaacagagagaactcaccatggagtttgggctgagcgtgtcttttcttggtggtacttaattttaaaggtgtccagtgtgaagtgacaacgtggtggagtcgtgggggagtcttggtacacggccggtggggggtccctggagtactctccgtgtcgcacgcctcgtggtacttccaccttttagcaactatgacccaatcgacccgtcggggtccgccgacggccgtccgagggggaacggggcgtagggaggttgggtctacgtagttagtttaggtggggtggttgggggtgggggtaacgattaaccgtacgcgaagtaccgtccggttacgggacggggtacccggttcccgtaccgtaaccttttaccgaacggtaacgtaacctaaacgtttacccaaaaggtaacccaaaccccgttacggttaacttcccgtagggttacccaaacccgtaagtaacgttaaaccgaaccggtcccgttacgacgggttaacggaccccgggaacgggaacccggtaacccgggtaaccccggttacgttttaaaccttttccggttacggtttacgggtaaaccgggtaaaacggtagtttacccgggttacggtttacggtacgggacccggttaacgtacgggtaccggtacgggtaacccggaaccgttaccccggttaaccccgtttaggtacccggtttacgggtttacccgggggcccggttaaccccggggg

SEQ ID NO: 40827 - DNA, 810 bp, Homo sapiens
  misc_feature: GYAE6OF02I9G3P.19.6.A06.1.454.CMB.1.raw
  modified_base (208)..(208): a, c, t, g, unknown or other
  misc_feature (208)..(208): n is a, c, g, or t
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
tcagtactctcgtgcacgaccggtgctcgatttagatctactgacaggggagagagggagcccagcccctggattttcaggtgttttcatttggtgatcaggacgtcgaacagagagaactcgaccatggagtttgggctgagcctggtcttttctgtggtctattttaaaggtcgtactagtgtacgaagttcgacaacgtggtggngttcgtggggagtcttggtacgngaccgtcggggtcctganacctctcctgtgccgagtcctgtaggacttcctaacgtttacgactactattacgcctatacgaccgtcggtacccgacgacgtccttaccgaggggtacggtcgtaggtacggttacggtctacgtagtttacgtagttgggtagttaggggtacgggtaactacgtaacgttaccggacgaacggtaccgtaccggtaaggtaccggtacccgggtttaccaaccggttaccgtttaacccgagtaaccggtaacttaaccgttaacccaaacgtaaaccctaacccgtttgtaaccgttacgtaccgtacgtaaaccgtacgttaccggtaacgtacgttacggtttaaccgaaagttaccgggtaaacccgaccgggtaaaccggtaaccgttaccggttaactttacccgtttttgaacccggtttcgtaaaccggtaaacgtcggtaccgttacggttagtccggttacaacggttacgaacgtttacggaacgttacccgggtaccgtaaacccgttcggtaaacttcccgggttagggtacccttaacccggg

SEQ ID NO: 40828 - DNA, 781 bp, Homo sapiens
  misc_feature: GYAE6OF02FW7SP.19.6.A06.1.454.CMB.1.raw
tcagtactctcgtgcacgaccggtgctcgatttagatctactgacagggggagagagggcccagccctgggattttcaggtgttttcatttggtgatcaggactgaacagagagaactcaccatggagtttgggctgagctggctttttcttgtggctattttaaaaggtgtccagtgtgaagtgcaactggtggagtcgtgggggaggcttggtacagccgtggggggtccctgagactctcctgtgcagcctctggattccaccttttagactaactatcgccagtcgacctcgggtcccgccacggcctaccgaggggaacgggcgtggagtgggtctacgtagttattaggtgggaggtgggtaggggtaactagtaccgtacggcaacgaccgttccggtagggtaaacgggtcccgttacgaacccgtaacgtttcccaaggtaacgtaacctaacgttacccaaaggtaaacccctacccttgtaacttacccgttacaaccgacgtaactacggaaaccgtcggtaccctagggacgaccggtaccgggaacggtaacccggaaccggtacccgttaaattccggttttaccgttaggttaccggtaaaggtaaacgtaccggtttaccggttacggttaacgttccgggaaccgtacgtaaccggtaccggttaccggaacccgaaacccggttcccccggtttaaacccgtttacgtaaacccggtttacgggtacccgggggtacccggtaacccggggttaaccccccg

SEQ ID NO: 40829 - DNA, 925 bp, Homo sapiens
  misc_feature: GYAE6OF02GYSGI.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagctggtctttttcttgtggcttaattttaaaaggtgtccagtgtgaagtgcaactggtggagtcgtgggggagtcgttggtacaggccgtgggggtcctgagactctcctgtgcacgcctctaggtacttctacctttagactaactatcgccaagtcgtaccgtcgggtacccgccgacggcctaccggaaggggaacggggtctacgggtaggtcgggtctacgtaggtttagttacgggtggggtaggttgggggtaacgggggaactacgtaacgttaccggacgtacgtaccgtaccggtacgggaacgggtcccgggttaaccaccgttaacctttaccgaaggtaaacgtaaccgttaacgtttaacccggaaaacgtaaacccgtaaaccccgttggtttaaaccgttaccgttacggaccctaaacgtaaacgtacccggtaaaaccgtaaccggtcccgttaaacgggaaacggaacccgggtaacccggggtaaacgggtaaaccccggaacccggggttaacccgtttaaaggtttaacccttttacgggtacgggttaaccgggtaaaccggtttaaaaaggttcccgttacgggttaaccgggttaaccggtttaccgggaaccgtaacccggtttaagggacccgggtttaaccgggaaacccggttaaaccccggttaaccccccgggtttaaaccccgtttaaccggtttaaaccggttttaacggggggttacccccggggtaaacccggtttaaaacccccgggggg

SEQ ID NO: 40830 - DNA, 874 bp, Homo sapiens
  misc_feature: GYAE6OF02H44F9.19.6.A06.1.454.CMB.1.raw
tcagtactctcgtgcacgaccggtgctcgatttagatctactgacagggggagagaggagcccagccctgggattttcaggtgttttcatttggtgatcaggactgaacagagagaactcaccatggagtttgggctgagctggtctttttcttgtggctatttaaaggtgtccagtgtgaagtgcaacgtggtggtagtcgtgggggaggtcgtttagggtacacggccggtcggggggtccctaggacgtaccttccttccgtggttcggaccgacgtcccgttcgttcgggtactttacccttaacccgttttaggtacctaaactttacgtccgacctagtccggtaacccgttccgggggtcccccgtacccggacgggtcccgtacccggtaacggggggaacgggggtccggttgggaacgggtcggggttcgttccgtaaggttttacgtttaaggggtggggtaggttggggggtagggggaacctaagtaccgtaccggtagacgtaccgtcgggtacgggaccgggtccggtttacgaccttaccgttacgaaggaacgtaccgttaaacgttaccgaaaacgtaaccccacccgttgttacgtccgttacgaccgtacacgtaacgtaaccgtaaccgtccgttaaggaaccgaacgggtaccggaacgggtacccgtaaccgggtaaccgttatttacggtttcctaaggttcgtaaaccgtaaaacgttcgttaccgggttacgttacgtccggtacgtaccgttacggtacggtccggaacccgtaaccgggtaccccgttacccggttttaacggttaccggtttacgggttacccggggacccgttaaacccggggg

SEQ ID NO: 40831 - DNA, 764 bp, Homo sapiens
  misc_feature: GYAE6OF02JAHHC.19.6.A06.1.454.CMB.1.raw
  modified_base (223)..(223): a, c, t, g, unknown or other
  misc_feature (223)..(223): n is a, c, g, or t
tcagtactctcgtgcacgaccggtgctcgatttagatctactgacagggggagaggaggagcccagccctgggattttcaggtgttttcatttggtgatcaggactgaacagagagaactcaccatggagttgggctgagctggtctttttcgtgtggtactatttaaaaggtgtccagtgtgaagtgacaactggtggagtcgtgggggaggtcttggtacnggcgttcgggggtcctgagactctccttgcgcagcctgtaggacttctaccgtttagacaacctagtcgtcctagtcgtaccgttcgggcccgccgtaacggccgtacggacgggggaacgggtgtgggtacggtgggtcgtaccgtaaggttttagtacggttggggtaaggtgggggtacggggaacgtacgtacgtacggtcaaggtcgtccgtaacgggaacgggtccggttacgaaccgttactttaccgaggtactaactaacgttaaccaaacgaaccctaccgttacggtaacttctacgaactaaccgtacgtagaacacgaccgttacggaacggacgtaccggacggtaaccgaccggtaacccgttaagttaccgtttgtcccggttagtaacgaaacgttataccgggttacgttacgggtacggtaacgttaccgtaacgggtacgtacccgaacgggtaaccgtaaccccggttaaccctaccgggtttacgtaccgggttttacgggaacccgttaaccccgggg

SEQ ID NO: 40832 - DNA, 164 bp, Homo sapiens
  misc_feature: GYAE6OF01ESWUP.44.4.A04.1.454.CMB.1.raw
  modified_base (164)..(164): a, c, t, g, unknown or other
  misc_feature (164)..(164): n is a, c, g, or t
tcagacagtatatacacgaccggtgctcgatttagagtagtgatcaggggtgttcggcggagggaccaagctgaccgtcctaggtcagcccaaggctgcccctcggtcactctgttcccaccctcctctatatactgtctgagcgggctggcaaggcgcatagn

SEQ ID NO: 40833 - DNA, 166 bp, Homo sapiens
  misc_feature: GYAE6OF01AYRMR.44.4.A04.1.454.CMB.1.raw
  modified_base (166)..(166): a, c, t, g, unknown or other
  misc_feature (166)..(166): n is a, c, g, or t
tcagacagtatatacacgaccggtgctcgatttagagtagtgatcagggggtgttcggcggagggaccaagctgaccgtcctaggtcagcccaaggctgccccctcggtcactctgttcccgccctcctctatatactgtctgagcgggctggcaaggcgcatagn

SEQ ID NO: 40834 - DNA, 171 bp, Homo sapiens
  misc_feature: GYAE6OF01A36I6.44.4.A04.1.454.CMB.1.raw
  modified_base (166)..(171): a, c, t, g, unknown or other
  misc_feature (166)..(171): n is a, c, g, or t
tcagacagtatatacacgaccggtgctcgatttagagtagtgatcagggggtgttcggcggagggaccaagctgaccgtcctaggtcagcccaaggctgccccctcggtcactctgttcccgccctcctctatatactgtctgagcgggctggcaaggcgcatagnnnnnn

SEQ ID NO: 40835 - DNA, 179 bp, Homo sapiens
  misc_feature: GYAE6OF01BKFOL.44.4.A04.1.454.CMB.1.raw
  modified_base (165)..(179): a, c, t, g, unknown or other
  misc_feature (165)..(179): n is a, c, g, or t
tcagacagtatatacacgaccggtgctcgatttagagtagtgatcaggggtgttcggcggagggaccaagctgaccgtcctaggtcagcccaaggctgccccctcggtcactctgttcccaccctcctctatatactgtctgagcgggctggcaaggcgcatagnnnnnnnnnnnnnnn

SEQ ID NO: 40836 - DNA, 165 bp, Homo sapiens
  misc_feature: GYAE6OF01A97ZB.44.4.A04.1.454.CMB.1.raw
  modified_base (159)..(159): a, c, t, g, unknown or other
  misc_feature (159)..(159): n is a, c, g, or t
  modified_base (165)..(165): a, c, t, g, unknown or other
  misc_feature (165)..(165): n is a, c, g, or t
tcagacagtatatacacgaccggtgctcgatttagagtagtgatcagggggtgttcggcggagggaccaagctgaccgtcctaggtcagcccaaggctgccccctggtcactctgttcccaccctcctctatatactgtctgagcgggctggcaaggcncatagn

SEQ ID NO: 40837 - DNA, 166 bp, Homo sapiens; identical to SEQ ID NO: 40833
  misc_feature: GYAE6OF01ES627.44.4.A04.1.454.CMB.1.raw
  modified_base (166)..(166): a, c, t, g, unknown or other
  misc_feature (166)..(166): n is a, c, g, or t

SEQ ID NO: 40838 - DNA, 199 bp, Homo sapiens
  misc_feature: GYAE6OF02FZP4Z.44.4.A04.1.454.CMB.1.raw
  modified_base (170)..(170): a, c, t, g, unknown or other
  misc_feature (170)..(170): n is a, c, g, or t
  modified_base (172)..(199): a, c, t, g, unknown or other
  misc_feature (172)..(199): n is a, c, g, or t
tcagacagtatatacacgaccggtgctcgatttagagtagtgatcgagggggtgttcggcggagggaccaagctggaccgtcctaggtcagcccaaggctgccccctcggtcactcctgttcccaccctcctctatatactgtctgagcgggctggcaaggcgcatagcncnnnnnnnnnnnnnnnnnnnnnnnnnnnn

SEQ ID NO: 40839 - DNA, 199 bp, Homo sapiens
  misc_feature: GYAE6OF02IZLB8.44.4.A04.1.454.CMB.1.raw
  modified_base (168)..(199): a, c, t, g, unknown or other
  misc_feature (168)..(199): n is a, c, g, or t
tcagacagtatatacacgaccggtgctcgatttagagtagtgatcgagggggtgttcggcggaggaccaagctgaccgtcctaggtcagcccaaggctgccccctcggtcactctgttcccaccctcctctatatactgtctgagccgggctggcaaggcgcatagcnnnnnnnnnnnnnnnnnnnnnnnnnnnnnnnn

SEQ ID NO: 40840 - DNA, 166 bp, Homo sapiens
  misc_feature: GYAE6OF02FQNWL.44.4.A04.1.454.CMB.1.raw
  modified_base (166)..(166): a, c, t, g, unknown or other
  misc_feature (166)..(166): n is a, c, g, or t
tcagacagtatatacacgaccggtgctcgatttagagtagtgatcagggggtgttcggcggaggtaccaagctgaccgtcctgggtcagcccaaggctgccccctcggtcactctgttcccgccctcctctatatactgtctgagcgggctggcaaggcgcatagn

SEQ ID NO: 40841 - DNA, 170 bp, Homo sapiens
  misc_feature: GYAE6OF02GR4UX.44.4.A04.1.454.CMB.1.raw
  modified_base (161)..(161): a, c, t, g, unknown or other
  misc_feature (161)..(161): n is a, c, g, or t
  modified_base (166)..(170): a, c, t, g, unknown or other
  misc_feature (166)..(170): n is a, c, g, or t
tcagacagtatatacacgaccggtgctcgatttagagtagtgatcagggggtgttcggcggagggaccaagctgaccgtcctgggtcagcccaaggctgccccctcggtcactctgttcccgccctcctctatatactgtctgagcgggctggcaaggcgnatagnnnnn

SEQ ID NO: 40842 - DNA, 573 bp, Homo sapiens
  misc_feature: GYAE6OF01ALT3X.2.86.H09.1.454.CMB.1.raw
  modified_base (573)..(573): a, c, t, g, unknown or other
  misc_feature (573)..(573): n is a, c, g, or t
tcagacgctcgacacacgaccggtgctcgatttagtgctatagacttgggtttgggggaggcttggtacagcctgggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattatgtgcgaaggacagtaggggccggcgcgggagcgaatgacttcgtggggccagggaaccctggtcaccgtctcctcagcctccaccaagggcccatccggtccttcccccgtggccgccctgcctccgagggacgccacccgtccgagacgccaccgagccggccctggggcctcggcccgttggtccaacgggtaccttaccgttccctggtccgagccggttctggacggccgggctgggcgaacggccgcagtgn

SEQ ID NO: 40843 - DNA, 540 bp, Homo sapiens
  misc_feature: GYAE6OF01AI40S.2.86.H09.1.454.CMB.1.raw
  modified_base (520)..(520): a, c, t, g, unknown or other
  misc_feature (520)..(520): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccggcgcgggagcgaatgacttctggggccagggaaccctggtcaccgtctccctcagccctccaccaagggcccatccggtccttcccccctggcccgccctcgcctcccagggacgccaccctccgagacgcacagccggccctgggctgcctggtcaggactactcctgtcgagcgtctgngcgggctggcaggcgcntgn

SEQ ID NO: 40844 - DNA, 568 bp, Homo sapiens
  misc_feature: GYAE6OF01DX08L.2.86.H09.1.454.CMB.1.raw
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggcagtaggggccggcgcgggagcgaatgacttcgtggggccagggaccctggtcaccgtctcctcagccctccaccaagggcccactccggtccttccccctcggccgccctgcctcccaggcgccaccctccgagacgcacgacgccggcccgtcgggcctcggcccttcggtccgaacggaccttaccttccgtcgtccgagtccgtcgtggacggccgggctcgggcaagggcgcntgn

SEQ ID NO: 40845 - DNA, 574 bp, Homo sapiens
  misc_feature: GYAE6OF01B3SNO.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgacaaatgaacaccctgagagccgaggacacggccatctattattgtgcgaaggacagtaggggccggcgcgggagcgaagtgacttcgtggggccagggaaccctggtccaccgtctcctcacgccctaccaccgacgggccctagtcccggttcccttcccccgtggccctcccgtgcctccgaggcgccacccgtcgagcgcacgcgccgcccgtggcctgcctggtacacggtcctacttccgtgtacgacgtccgtgtaggcggccgggtctcgggacgaacgggcacgagtgc

SEQ ID NO: 40846 - DNA, 584 bp, Homo sapiens
  misc_feature: GYAE6OF01BJT0I.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccgcgcgggagcgaatgacttcgtggggccagggaaccctggtcaccggtctcctcacgcctccaccaacgggcccatccggtccttcccccgtggcccgccctcgcctccacggacgcaccctccgacgacgccacgagccggccctgggcctcgcccgttgggtccaacggaccttaccttccctcggtccgacggtccgtcgtcggacggccgggcgtcgggacgaacgggccgccgtagtggc

SEQ ID NO: 40847 - DNA, 596 bp, Homo sapiens
  misc_feature: GYAE6OF01DU8JL.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtccacactacgcggcctccgtgaagggccggttcaccatgtccagagacaattacgaaaaacacgctgtatctgacaaatgaacaccctgagagccgaggacacggccatctattatgtgcgaaggacataggggccggcggcgggagcgaatgacttcgtggggccagggaaccctggtcaccgtctcctcacgccctccaaccgaacgggcccactccggtccttcccccgtggcccgccctgcctcccgaggacgccacctccgagacgcacaggccggcccgtgggcctcgccgttcggtacgaacggaccttaccttcccgtcgttccggacggtccggttcgtcgggacggcggggtcgtacgggccgaaacgggccgacgtagtaggc

SEQ ID NO: 40848 - DNA, 524 bp, Homo sapiens
  misc_feature: GYAE6OF01BST8X.2.86.H09.1.454.CMB.1.raw
  modified_base (263)..(263): a, c, t, g, unknown or other
  misc_feature (263)..(263): n is a, c, g, or t
  modified_base (386)..(386): a, c, t, g, unknown or other
  misc_feature (386)..(386): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccgttcaccatgtccagagacaattcgaaaaacncgctgtatctgcaaatgaacaccctgagagccgaggacacggccatctattatgtgcgaaggcataggggccgcgcgggagcgaatgactcgtggggccagggaaccctggtcaccgtctccnacgcctccacagggcccatcgtcttcccccgtgccnccctgctccgagngcacctcgancgcacagccgcctggctgcctggccaaggcctactcctgtccgagccgtnggngcgggctgggcaaggccgacngtagn

SEQ ID NO: 40849 - DNA, 702 bp, Homo sapiens
  misc_feature: GYAE6OF01CSWD6.2.86.H09.1.454.CMB.1.raw
  modified_base (269)..(269): a, c, t, g, unknown or other
  misc_feature (269)..(269): n is a, c, g, or t
  modified_base (482)..(482): a, c, t, g, unknown or other
  misc_feature (482)..(482): n is a, c, g, or t
  modified_base (701)..(701): a, c, t, g, unknown or other
  misc_feature (701)..(701): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttcgtcccacactacgcggcctccgtggaacgggccggttcaccatcgtccagagacaattacgaaaaacncgctgtatctgacaaatgaacacctgagacgccgaggacacgccatctattatgtgacgaaggacagtacgggccggcggcgggagacgaagtcggtacgttcggtacggggacccaacgggtaaccctggtacccgtaccggttcctcccgtcgaaccgtccctacccgaaccggaaccgggccctacgtcccggttccccgttccccccgnggccccgtcccgtcggtccgtaccgacgggcgtacccgacccgtaccgacgacgtaccaaccgaccggcccggtaccccgtcggggtccctcggtcccgttagggtaacccgtaacgggtaacccgtttaccgttcccgtcggttaccggaccggtccggttcggtacggtacggggcccgggtcgtacggggaccgtaacgggcccgtaacgagtcgng

SEQ ID NO: 40850 - DNA, 613 bp, Homo sapiens
  misc_feature: GYAE6OF01D9MZ5.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccggcgcgggagcgaatgacttcgtggggccagggaaccctggtcaccgtctcctcacgccctccaccgaacgggcccagtccggtccttcccccgtggcccgcccgtgcctcccgagggtacgccacccgtccgacgacgccaccacggccggcccgtcgggcctggcccgttgggtaccgaacgggtacctaacctttcccgttgtccggacggtccgttcgtcggacgggccggggtcgtacggggtccgaaacggggccgacgtaagtggcg

SEQ ID NO: 40851 - DNA, 632 bp, Homo sapiens
  misc_feature: GYAE6OF01DI55R.2.86.H09.1.454.CMB.1.raw
  modified_base (365)..(365): a, c, t, g, unknown or other
  misc_feature (365)..(365): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaaacacgctgtatctgacaaatgaacaccctgagagccgaggacacggccatctattattgtgcgaaggacagtaggggccggcggcgggagcgaatgactcgngggccaggaccctggtcaccgtctcctcacgccctccaaccgaacgggccctacgtccggtcccttccccccgtcgggcccgtccccgtcggccctacccgacgggacgcccgaccctcccggagacgaccaccgacggcccggcccgtcgggcctcgcccgttcggtaccgaacgggtaccttaccgttccgtcggtccgacggtccgtacgtcgggtacggccggggtcgtacgggtaccgaaacgggtccgacgtacgtaggcg

SEQ ID NO: 40852 - DNA, 552 bp, Homo sapiens
  misc_feature: GYAE6OF01DBV7P.2.86.H09.1.454.CMB.1.raw
  modified_base (522)..(522): a, c, t, g, unknown or other
  misc_feature (522)..(522): n is a, c, g, or t
  modified_base (552)..(552): a, c, t, g, unknown or other
  misc_feature (552)..(552): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccggcgcgggagcgaatgacttcgtggggccagggaaccctggcaccgtctctcacgcctccacaacgggcccatcggtccttccccctggccgccctgcctccaggcgccacctccgagacgcacgagccggcccgtgggctgccgtggtcaaggccttacttccgtgtcgacgtcgtctggngccgggctgggaccgaagggccgcgatggn

SEQ ID NO: 40853 - DNA, 629 bp, Homo sapiens
  misc_feature: GYAE6OF01AUL4O.2.86.H09.1.454.CMB.1.raw
  modified_base (629)..(629): a, c, t, g, unknown or other
  misc_feature (629)..(629): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgacaaatgaacaccctgagagccgaggacacggccatctattatgtgcgaaggacagtaggggccggcggcgggagcgaatgacttcgtggggccagggaaccctggtcaccgtctcctcacgccctccaccgaacgggcccacgtccggtccttccccctcgggcccgcccgtcgcctcccgagggacgccgacccgtccgagacgccaaccgacggccggccccgtggggcctcggcccttcgggtaccgaaacgggtacccttaccgttcccgtcggttacccggacggtcccggttaccgtcgggacgggcccggggtacgttcgggaccgaacggggccacgtagtaggn

SEQ ID NO: 40854 - DNA, 595 bp, Homo sapiens
  misc_feature: GYAE6OF01CWCQI.2.86.H09.1.454.CMB.1.raw
tcagacgctcgacacacgaccggtgctcgatttagtgctatagacttgggtttgggggaggcttggtacagcctgggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgacaaatgaaaccaccctgaagagccgagacacggccatctattattgtgcgaaggacagtaggggccggcggcgggagcgaatgacttcgcggggccacgggaaccctggtccaccgtctcctcacgcctccaaccgacgggcccagtccggtccttcccccgtggcccgtccctcgcctccgaggacgccaccgtccgagacgcacgacgccggcccgtgggcctcggccgtggtacgacgtaccttaccgttccgtcgtcggacgtccgtacgtcgggacggccggggctcgggaccgtaacgggcgacgtagtgc

SEQ ID NO: 40855 - DNA, 602 bp, Homo sapiens
  misc_feature: GYAE6OF01AFIYI.2.86.H09.1.454.CMB.1.raw
  modified_base (462)..(462): a, c, t, g, unknown or other
  misc_feature (462)..(462): n is a, c, g, or t
  modified_base (601)..(601): a, c, t, g, unknown or other
  misc_feature (601)..(601): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccggcggcgggagcgaatgacttcgtggggccagggaaccctggtcaccgtctcctcacgccctccacccgaaggggcccagtccggtccttcccccgtggcccgcccgtcgcctccgagggacnccaccctccgacgagccacgacggccggcccgtgggcctcggcccgttggtaccaacgggtaccttaccgttccgtcggtccgacggtccgtccgtaggacgggccgggcgtcgggacgtaacgggccgaccgagtcgng

SEQ ID NO: 40856 - DNA, 565 bp, Homo sapiens
  misc_feature: GYAE6OF01CSEVJ.2.86.H09.1.454.CMB.1.raw
  modified_base (533)..(533): a, c, t, g, unknown or other
  misc_feature (533)..(533): n is a, c, g, or t
  modified_base (543)..(543): a, c, t, g, unknown or other
  misc_feature (543)..(543): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccggcgcgggagcgaatgacttcgtggggccagggaaccctggtcaccgtctcctcacgcctccacgaacgggccccatcggtccttccccctgggccgccctgcctcccacgggcgccaccctccggagacgccaaccgacgccggcccgtgggcctgccctggtcacggcttaccttccgtgtcgaggtccgtnggagccgggngtcggcgaagggcgacngtagn

SEQ ID NO: 40857 - DNA, 590 bp, Homo sapiens
  misc_feature: GYAE6OF01D48KI.2.86.H09.1.454.CMB.1.raw
  modified_base (588)..(588): a, c, t, g, unknown or other
  misc_feature (588)..(588): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaaaggggctggagtgggtctcagctattgatggtggttctgttgtcccacactacgcggcctccgtgaaggccgttcaccatgtccagagacaattacgaaaaacacgctgtatctgcaaatgaacaccctgagagccgagacacgccatctattattgtgcgaaggacagtaggggccggcgcgggagcgaatgacttcgtgggccagggaccctggtccaccgtctcctcacgccctccaaccgagggcccagtccggtccttcccccgtggcccgccctgcctcccgagggacgccacccgtccggagacgccaccgacgcccggcccgtcgggcctcggccctgggtccaagggtccttaccgttcccttggtccgaccgttcgtggacggccggggctcgggaccgtaacgggccgaccagtcgncg

SEQ ID NO: 40858 - DNA, 713 bp, Homo sapiens
  misc_feature: GYAE6OF01BY762.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgagggccgttcaccatgtccagagacaattacgaaaaacacgctgtatctgacaaatgaacaccctgagagccgaggacacggccatctattatgtgacgaaggacagtacgggggccggcggacggggagacggaagtcggacttcggtcgggggaccaacggggaaccctgggtccaccggtcctaccctcacgccctaccgaaccgaacggggcccctagttcccgggttacccttccccccggtgggaccccgtccccgtgacccgtaccgagggaccgccctaacccgtccggaacgacgccaaccgacgggcccggacccccggttggggacccttcggaccccgttaggggtaacccctaacgggtaacccgtttaacccgtttcccgtacgggttacccggtaacggtcccggttaccgtacggggtacgggtcccgggggtcgtccgggaaccgggtaacggggcccgacgtacgtaggag

SEQ ID NO: 40859 - DNA, 681 bp, Homo sapiens
  misc_feature: GYAE6OF01C9LI6.2.86.H09.1.454.CMB.1.raw
  modified_base (314)..(314): a, c, t, g, unknown or other
  misc_feature (314)..(314): n is a, c, g, or t
  modified_base (450)..(450): a, c, t, g, unknown or other
  misc_feature (450)..(450): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtccacactacgcggcctccgtgaacgggccgtcaccatgtcagagacaattacgaaaaacacgctgtatctgacaaatgaacacctgagagcgagacacggcatctattatgngacgaaggacagtacggggccggcggcgggagacgaagtcgtacgttcgcggggaccgaacgggaaccctggtccaccgtcctcctcgacgtccctaccaaccgaacgggcccctacgtccggtcccttcccccgngggcccgtcccctggtccctaccgacggaaccgccctaccgtccggaacggaccgaccgaccgaccgggcccggtcccggtcgggccttccggacccggttacggtaaccggtaacggttacccgtttacccgttccggttacggtaccggacggttccggtaccggtacgggaccggggtcccggggtaccgtacgggaaacccgggtaacgggcccaacggtagtagcg

SEQ ID NO: 40860 - DNA, 607 bp, Homo sapiens
  misc_feature: GYAE6OF01C43XY.2.86.H09.1.454.CMB.1.raw
  modified_base (606)..(606): a, c, t, g, unknown or other
  misc_feature (606)..(606): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccgttcaccatgtccagagacaattacgaaaaacacgctgtatctgacaatgaaccacctgaagagcgaggacacggccatctattattgtgcgaagacaggtagggccggcggcgggagcgaatgacttcgtcggggaccacgggaaccctggaccaccgtctccctcgacgccctaccaaccgaacgggccccagttccggtccccttccccgcggcccgtccctggccctccgacgggacgaccacccgtaccgacggacacacgacgccggcccgtgggccttcggcctggtaccgaacgtaccttaccgttccgtcggtcgacggtccgtgtcgggcggacgggcgtcgggaccgtaacggccgactagtgng

SEQ ID NO: 40861 - DNA, 708 bp, Homo sapiens
  misc_feature: GYAE6OF01CR3LP.2.86.H09.1.454.CMB.1.raw
  modified_base (263)..(263): a, c, t, g, unknown or other
  misc_feature (263)..(263): n is a, c, g, or t
  modified_base (341)..(341): a, c, t, g, unknown or other
  misc_feature (341)..(341): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccgtcaccatgtccagagacaattacgaaaaacncgctgtatctgacaaatgaacacctgagagcgaggacacggccatctattactgtgacgaagacagtacggggccggnggcgggagcgaatcggtaacgttcggacgggggacccgaacggggtaacccgtcgggtaccaacccggttccctccttaccgaaccgtcccctacccgaacccggaaaccgggcccctaacgttcccgggttcccctttccccccgtcgggtccccgtccccgtcggtccctaccgaacgggacgtacccgacccgtccggaacgacgacgtaaccgacggcccgggtcccgtacggggtccctcggtacccggtacggtacccgaacggtaccccttaccgtttcccgtcggttacccggacggttccggtacgtacgggtacgggccggggtcggtcgggacggacgggtaccgacgtgtagggc

SEQ ID NO: 40862 - DNA, 615 bp, Homo sapiens
  misc_feature: GYAE6OF01CMRE7.2.86.H09.1.454.CMB.1.raw
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
  modified_base (344)..(344): a, c, t, g, unknown or other
  misc_feature (344)..(344): n is a, c, g, or t
  modified_base (400)..(400): a, c, t, g, unknown or other
  misc_feature (400)..(400): n is a, c, g, or t
  modified_base (440)..(440): a, c, t, g, unknown or other
  misc_feature (440)..(440): n is a, c, g, or t
  modified_base (481)..(481): a, c, t, g, unknown or other
  misc_feature (481)..(481): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccgaggaaaggggctggagtgggtctcagctattgatggtggttctgttgtcccacactacgcggcctccgtgaagggccgttcaccatgtccagagacaattacgaaaaacncgctgtatctgacaaatgaacaccctagagacgccgagacacggccatctattatgngacgaagacagtaggggccggnggcgggagacgaagtgacttcgtcggggacccacggaacctggtccaccgtctccncgagccctaccacgacggcccagtccggtcccttccccgnggcccgcccgtgaccctcgacggcgcccaccgtccgaagcnccacgacggcccgccgtgggcctcggcctgggtaccaacggtaccttaaccgttcccgttggacccgtagggtcccgttggtacggcgggcccggggtgtaccggtaccgggaaacgggccgtacgagttaggc

SEQ ID NO: 40863 - DNA, 600 bp, Homo sapiens
  misc_feature: GYAE6OF01CTNS6.2.86.H09.1.454.CMB.1.raw
  modified_base (599)..(599): a, c, t, g, unknown or other
  misc_feature (599)..(599): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgacaaatgaacacctgagagcgaggacacggcatctattatgtgacgaagacagtaggggccggcggcgggagcgaatgacttcgtcggggccacgggaaccctggtccaccgtcctccctcgacgccctccaaccgaacggggcccagtccggtccttcccccgtgggcccgcccgtcgcctcccgaggacgtccacccgtaccgacggacgaccgaccgacggcccggccgtcgggcctcggccgtggtaccgacgtaccttaccttccgtcggtcgacggtcgtcgaggcggcgggacgtgggaccgaacgggcgacagtgng

SEQ ID NO: 40864 - DNA, 597 bp, Homo sapiens
  misc_feature: GYAE6OF01BL9ZU.2.86.H09.1.454.CMB.1.raw
  modified_base (461)..(461): a, c, t, g, unknown or other
  misc_feature (461)..(461): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccggcgcgggagcgaatgacttcgtggggccagggaaccctggtccaccgtctcctcacgccctccaccgaacgggccccagtccggtccttccccccgtggcccgccctgcctccgagggacnccaccctccgagacgcacacggccggccctgggcctcgcccgttggtacaacggaccttaccttcccgtggtccgagtcccggttctcgggacggccggggccgtcggggaccaacggggccggactaggtacgcg

SEQ ID NO: 40865 - DNA, 579 bp, Homo sapiens
  misc_feature: GYAE6OF01CO1UG.2.86.H09.1.454.CMB.1.raw
  modified_base (359)..(359): a, c, t, g, unknown or other
  misc_feature (359)..(359): n is a, c, g, or t
  modified_base (393)..(393): a, c, t, g, unknown or other
  misc_feature (393)..(393): n is a, c, g, or t
  modified_base (478)..(478): a, c, t, g, unknown or other
  misc_feature (478)..(478): n is a, c, g, or t
  modified_base (579)..(579): a, c, t, g, unknown or other
  misc_feature (579)..(579): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccgtcaccatgtccagagacaattcgaaaaacacgctgtatctgcaaatgaacaccctgagagccgagacacggccatctattattgtgcgaaggacagtaggggccggcgcgggagcgaatgacttcgnggggaccagggaaccctggtccaccggtctcctnacgcctccaccaagggcccctagtccggtccttcccccgtggcccgtccctgcctccgaggacgccaccctccggagacgcaacnggccggcccgtgggcctcggcccttggtacaacggacttaccgttcctggtccgaggtccgtgtggacggcgggtctagggccgaaggccgacagtacggn

SEQ ID NO: 40866 - DNA, 626 bp, Homo sapiens
  misc_feature: GYAE6OF01B71H3.2.86.H09.1.454.CMB.1.raw
  modified_base (484)..(484): a, c, t, g, unknown or other
  misc_feature (484)..(484): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgacaaatgaacaccctgagagccgaggacacggcatctattatgtgacgaaggacagtacggggccggcggcgggagacgaatggacttcgtgggggaccaacgggaacccgtggtccacccgtctccctcacgccctaccaccgaacgggccctacgtccggttcccttccccccgtgggtccccgcccgtcgccctcccgacgggacnccgacccgtaccggagacgaccacgacggccggtaccccgtcgggccttcggccgttcgggtacgaacggtacctaccgtttccgtcggtcggacggtccgtcgtcggacgggcgggcgtgggaccgaacggccgactgngn

SEQ ID NO: 40867 - DNA, 760 bp, Homo sapiens
  misc_feature: GYAE6OF01D7QMQ.2.86.H09.1.454.CMB.1.raw
  modified_base (258)..(258): a, c, t, g, unknown or other
  misc_feature (258)..(258): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggttggttctgttcgtcccacactacgcgcctcgtgaggccgttcacatgtcagagacaatacgaaaacncgtctgtatctgacaaatcgaaccaccgtgagacgaccgagaccacggccatctattagtgtgacggaagacgagtacggggccgcggcgggagacgaagtgtacgttcggtcggggaccgaacgggaacccgttggtacctaccgtccgtcccacgaccgacccttacccgaaccggaaccgggtcccctaacgttccccgggtttacccctttcccccccggtacggggcccccgtacccccgtcggtccccgtaccccggaacgggtacccggtacccctaaccccggttacccggaacggacccggaacccgtaaccggaacccggggcccccgggttacccccggttcgggggtacccttcgggttacccccggttagggttaacccgaaaccgggttaccctttaacccgtttcccgtcggggtaccgtaaccggtcccggttcgtggggaaccgggcccgggtcgtacgggaccgaacgggcaccgtagacggcg

SEQ ID NO: 40868 - DNA, 681 bp, Homo sapiens
  misc_feature: GYAE6OF01DMEOY.2.86.H09.1.454.CMB.1.raw
  modified_base (362)..(362): a, c, t, g, unknown or other
  misc_feature (362)..(362): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgacaaatgaacacctgagagcgaggacacgaccatctattatgtgcgaagacagtagggccggcgcgggagcgaatcggacttcgnggggccgaagggtaaccctggtccaccgtctcctcgacgtccctaccgaaccgaacgggccccacgttcccgggttcccctttccccccgtggggaccccgtccccgttcggccctacccggaacgggaccgcccaaccccgtcccggaagaccgccgaaccgacgggcccgggcccgtcggggccctcgtcccgttcgggtaacccaaacgggtccctttaaccgttcccggtggtaccggtaacggtccgttccgttaggccggggtacccggggtcgtacgggtaacccgaacggggacccacggtaaagtagggc

SEQ ID NO: 40869 - DNA, 621 bp, Homo sapiens
  misc_feature: GYAE6OF01A3QMT.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtagggccggcgcgggagcgaatgacttcgtggggcacgggaaccctggtaccaccgtctccctcacgccctcccaccgaacgggccctaacgtccggtccttccccccgtcgggcccgccctcgcctcccgacggacgccacccgtccgacgacgaccaccgacggcccggccccgtcgggctcggcccgttcggtaccgaacgggtaccttaccgttccgtacggtccggacggtcccgtcgtacggcgggtccgggcggttacggaccgaagggccgacgaagtagcg

SEQ ID NO: 40870 - DNA, 586 bp, Homo sapiens
  misc_feature: GYAE6OF01EBMS3.2.86.H09.1.454.CMB.1.raw
  modified_base (366)..(366): a, c, t, g, unknown or other
  misc_feature (366)..(366): n is a, c, g, or t
  modified_base (585)..(585): a, c, t, g, unknown or other
  misc_feature (585)..(585): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgacaaatgaacaccctgagagccgaggacacggccatctattattgtgcgaaggacagtaggggccggcggcgggagcgaatgacttcgnggggccagggaaccctggtcaccgtctcctcacgccctaccaccgaacgggcccagtccggtccttcccccgtggcccgccctcgcctccgaggacgccacccgtccgagacgcacgacgccggcccgtgggcctcgccgtggtacaacggtacctacttccgtgtccgagtccgtcgtggcggccgggtcgtacgggacgaacgggccgactagtagng

SEQ ID NO: 40871 - DNA, 541 bp, Homo sapiens
  misc_feature: GYAE6OF01BVDRL.2.86.H09.1.454.CMB.1.raw
  modified_base (268)..(268): a, c, t, g, unknown or other
  misc_feature (268)..(268): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
  modified_base (521)..(521): a, c, t, g, unknown or other
  misc_feature (521)..(521): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
tcagacgctcgacacacgaccggtgctcgatttagtgctatagacttggggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtggaacgggccgttcaccatgtccagagaacaattacgaaaaacncgctgtatctgacaaaatcgaaccaccctgagacgccgagacacggccatcttattatgtgacgaaggcagtgggcgngcggangatgactcgngggacacggacctgcaccgtctcctncgccacacgacggccagtccgtcctcccgnggccctcctgacctcgaggcnccaccgtccgagcncacgcgccgccgtgggctcggcctgcgaacgcttaccgtccgngaccgngccgtnacggcggccggtncggacgacggncgtaagngn

SEQ ID NO: 40872 - DNA, 598 bp, Homo sapiens
  misc_feature: GYAE6OF01BRS79.2.86.H09.1.454.CMB.1.raw
  modified_base (446)..(446): a, c, t, g, unknown or other
  misc_feature (446)..(446): n is a, c, g, or t
  modified_base (464)..(464): a, c, t, g, unknown or other
  misc_feature (464)..(464): n is a, c, g, or t
  modified_base (598)..(598): a, c, t, g, unknown or other
  misc_feature (598)..(598): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgcaaatgaacaccctgagagccgaggacacggccatctattattgtgcgaaggacagtaggggccggcggcgggagcgaatgacttcgtggggccacgggaaccctggtccaccgtctcctcacgccctccaccgaacgggcccagttccggtccttccccccgtggcccncccgtgcctccgagggcnccacctccgagacgcaccgacggccggcccgtgggcctcggcccgttcgggtacaacggtactttaccgttccgtcgtcggacggtcgtcgtggacggccggggcgtcgggaccgtaacgggcgccaagtcggn

SEQ ID NO: 40873 - DNA, 656 bp, Homo sapiens
  misc_feature: GYAE6OF01AON00.2.86.H09.1.454.CMB.1.raw
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (361)..(361): a, c, t, g, unknown or other
  misc_feature (361)..(361): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtggtccgccaggctccaggaaaggggctggagtgggtctcagctattgatggtggttctgttgtcccacactacgcggcctccgtgaagggccgttcaccatgtccagagacaattcgaaaaacncgctgtanctgcaaatcgaacaccctgagacgccgaggacacggccatctattatgtgcgaaggacagtaggggccgcggcgggagcgaatgacttcgnggggccacgggaaccctggtacaccggtctcccgtacacgccctaccgaaccgaacggggaccccacgtccggttcccgttccccccgtgggccccgtacccgtcggtacccttccgaacggtaccgcctaccccgttaccggacgacgaccctaaccggacggccccgggtccccgtacggggtccctacgggtcccgttcgggtaccgtaacggtaccctttaaccgttccgtacgtcgacggtccgttgtacggtcgacggggtctacgggacgtaacgggcctacgagtgc

SEQ ID NO: 40874 - DNA, 612 bp, Homo sapiens
  misc_feature: GYAE6OF01DFQ9B.2.86.H09.1.454.CMB.1.raw
  modified_base (283)..(283): a, c, t, g, unknown or other
  misc_feature (283)..(283): n is a, c, g, or t
  modified_base (604)..(604): a, c, t, g, unknown or other
  misc_feature (604)..(604): n is a, c, g, or t
  modified_base (612)..(612): a, c, t, g, unknown or other
  misc_feature (612)..(612): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaaaggggctggagtgggtctcagctattgatggtggttctgttgtcccacactacgcggcctccgtgaacgggccgttcaccatgtccagagacaattacgaaaaacacgctgtatctgcaaatnaacaccctgagagcgagacacggcatctattatgtgacgaaggacagtagggccggcggcggagcgaatgacttcgtcggggaccgacgggacccgtggtccgaccgtcctcctcacgccctccaaccgaacgggcccagtccggtcccttccccgtcgggccctccctcgcctccgacgggacgccacccgtccgagaacgccaacgcggaccgggccctcgggcctacgggcccgttagggtaccaagggtacccttaaccgttccctggtcgacggttcggtcgttcggcggtccggggcgtcgggtaccaagggccncgaagtgn

SEQ ID NO: 40875 - DNA, 708 bp, Homo sapiens
  misc_feature: GYAE6OF01C6B89.2.86.H09.1.454.CMB.1.raw
  modified_base (145)..(145): a, c, t, g, unknown or other
  misc_feature (145)..(145): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (704)..(704): a, c, t, g, unknown or other
  misc_feature (704)..(704): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccnccaggctccaggaaggggctggagtgggtctcagctattgatggtggttctgttgtcccacacgtacgcggcctccggtgaacgggccggttcgacctagtcgtaccagagacaattacgaaaaacncgctgtatctgacaatgaaccacctgagacgacgaggacacggcagtctattntgngacgaaggacaggtacggggccggcggcgggagcgtaagtcgacgtttcggtcggggaccacgggaacccgtggtaccaccggtctcctacgacggtccctacccgaaccgtaaccggggccctaacggttcccgggttacccccttccccccggtagggcccccgtaccccgttcggaccccgttacccggaacggggtacctaccccgtacccgtaccggaacggaccgaccgaccggacggtccccgggtccggtcgggtaccgtcggtccggtacggtaccgtaacgtacccttaccggttcgtaccggtacgtacggtccgtacggtcgggaccggtcgggtcgtacgggaccggacggtccgtacgtagngtcg

SEQ ID NO: 40876 - DNA, 554 bp, Homo sapiens
  misc_feature: GYAE6OF01C61JL.2.86.H09.1.454.CMB.1.raw
  modified_base (204)..(204): a, c, t, g, unknown or other
  misc_feature (204)..(204): n is a, c, g, or t
  modified_base (256)..(256): a, c, t, g, unknown or other
  misc_feature (256)..(256): n is a, c, g, or t
  modified_base (312)..(312): a, c, t, g, unknown or other
  misc_feature (312)..(312): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
  modified_base (447)..(447): a, c, t, g, unknown or other
  misc_feature (447)..(447): n is a, c, g, or t
  modified_base (464)..(464): a, c, t, g, unknown or other
  misc_feature (464)..(464): n is a, c, g, or t
  modified_base (507)..(507): a, c, t, g, unknown or other
  misc_feature (507)..(507): n is a, c, g, or t
  modified_base (520)..(520): a, c, t, g, unknown or other
  misc_feature (520)..(520): n is a, c, g, or t
  modified_base (548)..(548): a, c, t, g, unknown or other
  misc_feature (548)..(548): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtggtccgcaggctccaggaaagggctggagtgggtctcagctattgatggtggttctgttgtcccanactacgcggcctcgtgagggccgttcacatgccagagacaattcgaaaaacncgctgtatctgacaaatgaaccacctgagacgcgagacacggccatctattattgngacgaaggacagtacgggccgcggcggancgaatgacttgngggcagggaaccctggaccacgtctcctcacgtcctaccacgtaacgggcccagtccgtccctccccgtggccctcccgtgcctaccgagggcnccaaccgtccgagacgnacgacgccggccgtggctcgccgtagccaggtacctcgtccgngtccgagtccgtntggcgcgggtctcggacgaacgtcgacngtgacg

SEQ ID NO: 40877 - DNA, 634 bp, Homo sapiens
  misc_feature: GYAE6OF01C2M10.2.86.H09.1.454.CMB.1.raw
  modified_base (257)..(257): a, c, t, g, unknown or other
  misc_feature (257)..(257): n is a, c, g, or t
  modified_base (519)..(519): a, c, t, g, unknown or other
  misc_feature (519)..(519): n is a, c, g, or t
tcagacgctcgacacacgaccggtgctcgatttagtgctatagacttggggtttgggggaggcttggtacagcctggggggtccctgagactctcctgtgcagcctctggattcacctttagtaactttgtcatgaggtgggtccgccaggctccgaggaaaggggctggaggtgggtctcagctattgatggtggttctgttgtccacactacgcgcctcgtgaggccgtcacatgcagagacaatacgaaaaacncgctgtatctagacaaatagaaccacctagagacgacgaggacacggccatctattattgtgacgaaggacaggtacggggccggcggacgggagacgaagtcgtacgttcggtcggggaccgaacgggacccgtcggaccgtaccgtccgtcctcgacgtccctacccgaccgaaccgggccctacgtccggttccccttccccgtcgggccctcccgttgacccttaccggaacgggcctacccgacccgtcgaacgacncgaccgacggccggcccgtcggcttcgaccgttacgtacgaacggtctaccgttcgcggtacgcggttcgtccggagcgggaccggtcgacgggacaacgggtcgacctaggcgc

SEQ ID NO: 40878 - DNA, 584 bp, Homo sapiens
  misc_feature: GYAE6OF01CL1IP.2.86.H09.1.454.CMB.1.raw
  modified_base (380)..(380): a, c, t, g, unknown or other
  misc_feature (380)..(380): n is a, c, g, or t
  modified_base (419)..(419): a, c, t, g, unknown or other
  misc_feature (419)..(419): n is a, c, g, or t
  modified_base (485)..(485): a, c, t, g, unknown or other
  misc_feature (485)..(485): n is a, c, g, or t
  modified_base (567)..(567): a, c, t, g, unknown or other
  misc_feature (567)..(567): n is a, c, g, or t
  modified_base (577)..(577): a, c, t, g, unknown or other
  misc_feature (577)..(577): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
tcagacgctcgacacacgaccggtgctcgatttagtgctatagacttgggtttgggggaggcttgggtacagcctggggggtccctgagactctcctgtgcagccctctggattcacctttagtaactttgtcatgaggtgggtccgccacggctccagggaaaggggctgggagtgggtctcagctattgatggtggttctgttgtcccacactacgcggcctccggtgaacgggccggttcaccatgtccagagacaaattacgaaaaaacacgtctgtaatctgacaaatgaacaccctgagagccgaggacacggcctatctattattgagcgaaaggacagtaggggccggcggcgggagcgaaatgactttcgnggggccgagggaaccctggtacaccgtcctctcacgccnccaaccgaacgggcccaagtccggtcccttcccccgtgcccgcctgcctccgagggactccgaccncgagacgcacgacgtccgcccgtgggctcgcctggtaccaacggtactacttccgtagtccgagtcgtcgtagcggcggcgnggacgaggcncaagngn

SEQ ID NO: 40879 - DNA, 567 bp, Homo sapiens
  misc_feature: GYAE6OF01D403L.2.86.H09.1.454.CMB.1.raw
  modified_base (360)..(360): a, c, t, g, unknown or other
  misc_feature (360)..(360): n is a, c, g, or t
  modified_base (471)..(471): a, c, t, g, unknown or other
  misc_feature (471)..(471): n is a, c, g, or t
  modified_base (522)..(522): a, c, t, g, unknown or other
  misc_feature (522)..(522): n is a, c, g, or t
  modified_base (548)..(548): a, c, t, g, unknown or other
  misc_feature (548)..(548): n is a, c, g, or t
  modified_base (559)..(559): a, c, t, g, unknown or other
  misc_feature (559)..(559): n is a, c, g, or t
  modified_base (566)..(567): a, c, t, g, unknown or other
  misc_feature (566)..(567): n is a, c, g, or t
tcagacgctcgacacacgaccggtgctcgatttagtgctatagacttgggtttgggggaggcttggtacagcctgggggtccctgagactctcctgtgcagcctctggattcacctttagttaactttgtcatgaggtgggtccgcaggctccaggaaaggggctggagtgggtctcagctattgatggtggttctgttgtcccacactacgcggcctccgtgaagggccgttcaccatgtccagagacaattcgaaaaacacgctgtatctgacaaatgaacaccctgagagccgaggacacggccatctattattgtgcgaaaggacataggggccgcgcgggaacgaatgacttcgngggcccagggaacccctggtccaccgtctcctcacgcctcccaaccgaacgggccctaatccggtccttcccccgtggccgcccctgccttccagtacgcaccgtccgagngcacgagccgggccctgggcctgcccttgggacaagggcctaacgttccgngtccgagccgttcgagacggcggtcngggccaaggcncgatggnn

SEQ ID NO: 40880 - DNA, 680 bp, Homo sapiens
  misc_feature: GYAE6OF01BX3E9.2.86.H09.1.454.CMB.1.raw
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (673)..(673): a, c, t, g, unknown or other
  misc_feature (673)..(673): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtccacactacgcggcctcgtgaagggccggttcacatgtccagagacaattacgaaaacncgctgtatctgacaaatgaacacctgagngaccgaggacacggcatctattatgtgcgaaggacagaggggccgcggcgggagacgaatcgtacttcggtcggggacccgaacgggaacccgtcgggtacctacccgtctcccgtacaccgcccctaccgaaccgaaccggggcccctaacggttcccggttaccccgtttccccccgtacgggccccgtccccgtggcccttacccggagggtaccgcccacccggtcccgaaggtacgaccaaccgccggcccggtaccccggtggggaccctcggtcccgtacgggtaaccaaccggtaccttacccgttccggtacggttccggacggtccgttacggacggacggtccggggacgttcgggacgaacgggcgaaccnggtgacg

SEQ ID NO: 40881 - DNA, 562 bp, Homo sapiens
  misc_feature: GYAE6OF01EL82J.2.86.H09.1.454.CMB.1.raw
  modified_base (352)..(352): a, c, t, g, unknown or other
  misc_feature (352)..(352): n is a, c, g, or t
  modified_base (453)..(453): a, c, t, g, unknown or other
  misc_feature (453)..(453): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
  modified_base (541)..(541): a, c, t, g, unknown or other
  misc_feature (541)..(541): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaaacacgctgtatctgcaaatgaacaccctgagagccgaggacacggccatctattattgtgcgaaaggacatagggggccggcgcggggancgaaatggacttcgtggggcccaaggggaaccctgggtcacccggtctccctcacgccctaccaccaaggggcccaagtccggtccttccccctgggcccncccgtgctcccgaggacgccaccgtccgagagcacagccgcctgggctgcctggtcaaggctacttcctgtcgngcgtnggacgcggngtcggcgaaggccgcagtagc

SEQ ID NO: 40882 - DNA, 676 bp, Homo sapiens
  misc_feature: GYAE6OF01D8VK1.2.86.H09.1.454.CMB.1.raw
  modified_base (265)..(265): a, c, t, g, unknown or other
  misc_feature (265)..(265): n is a, c, g, or t
  modified_base (325)..(325): a, c, t, g, unknown or other
  misc_feature (325)..(325): n is a, c, g, or t
tcagacgctcgacacacgaccggtgctcgatttagtgctatagacttgggtttgggggaggcttggtacagcctgggggggtccctgagactctcctgtgcagcctctggattcacctttagtaactttgtcatgaggtgggtccgccaggctccaggaaaggggctggagtgggtctcagctattgatggtgttctgttgtcccacactacgcgcctccgtgaagggccgttcaccatgtccagagaacaattacgaaaaaacncgctagtatctagacaaaatcgaacaccctgagacgccgagacacggccatctattatgngacgaagacgagtacggggccgacggcgggagacgaaatcgtacgttcggacgggggacccaacgggaaccctgggtaccctacccggtcctacccgtacacggtccctacccgaaccggaacggggtccccaacgttcccgggttccccttcccccggtgggccccgcccctggaccctaccggaacgggccgaccctacccgtccgaagtacgaccgacgacgggcccgacccgtgggacctcggacccgttggaccgaaacggtccttaccgttccgttaggaccgtacggtccggttacgcgggacggcccgggtagtaccgggacgaacggcgacgtaacgtagcg

SEQ ID NO: 40883 - DNA, 602 bp, Homo sapiens
  misc_feature: GYAE6OF01A2FDE.2.86.H09.1.454.CMB.1.raw
  modified_base (540)..(540): a, c, t, g, unknown or other
  misc_feature (540)..(540): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaaggccggttcaccatgtccagagacaattacgaaaaacacgctgtatctgcaaatgaacaccctgagagccgaggacacggccatctattattgtgcgaaggacagtaggggccgcggcgggagcgaatcgacttcgtcggggccaagggaaccctggtaccaccggtctcctcgacgccctccaacccgaaggggccctagtccggtccttcccccgtgggcccgtccctgcctccgaggacgccaccctcgacgacgcacgacgccggcccgtgggcctcggcccgttggacaacgggtccttaccgttccgnggtacggacggtccgttcgtggacggccgggcgtagggacccgaacgggcgacctagtagcg

SEQ ID NO: 40884 - DNA, 874 bp, Homo sapiens
  misc_feature: GYAE6OF01C22YE.2.86.H09.1.454.CMB.1.raw
  modified_base (263)..(263): a, c, t, g, unknown or other
  misc_feature (263)..(263): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgcaggctccgaaggaaaggggctggagtgggtctcagctatgatggtgttctgttcgtcccacactacgcggcctccgtgaacgggccgttcaccatgcagagacaatacgaaaaacncgctagtatctagactaaagtcgaaacctacccgtaggaacggaacggacccggaacggaacccgtaaccgggaccctaagtttacctttaagttttaacgtttgggtacgaacgggtaaaagggaaccgtaacgggttaaccggggggacccgggcgggacgggggtaacgaccggtaaaagtttcggtaacccgtttcgggtaccggggggaccctaaacgggggtaacccccttggggtacccctaacccggtttccgttacccgtaccgaaccggtccccgtaaccccgaaccggggtaaccggggccccttaacgggttccccggttaccccgtttcccccggtacgggccccgtccccgtaggtccccgtacgaccgggacgtacccgtaaccccgtaccggaagaccgaccgaccgaacgggtccccggtccccgggtcgggtacccgtccggtacccggttagggttaacccgaaaccgggttaccctttccgttaccccgtacgggttcccggtaacgggttcccggttacgtcggggtaacggggtcccggggtaccgttagggaacccggtaacggggtacccacggtaaaggtcggacg

SEQ ID NO: 40885 - DNA, 581 bp, Homo sapiens
  misc_feature: GYAE6OF01BCGDL.2.86.H09.1.454.CMB.1.raw
  modified_base (397)..(397): a, c, t, g, unknown or other
  misc_feature (397)..(397): n is a, c, g, or t
  modified_base (564)..(564): a, c, t, g, unknown or other
  misc_feature (564)..(564): n is a, c, g, or t
  modified_base (581)..(581): a, c, t, g, unknown or other
  misc_feature (581)..(581): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgcaaatgaacaccctgagagccgaggacacggccatctattatgtgcgaaggacagtacggggccggcggcgggagcgaatcgacttcgtggggccagggaaccctggtaccaccgtctccncacgccctacccaccgaacggcccatccggtccttccccccgtcggcccgtcccgtcgcctcccgacgggacgccacccgtccgagacgcaccacgcccggcccgtcgggctcgccgtaggtacaacggtactaccttcgtgtccgagtccgtcgtggcggccgggntcggcgaggcgcagtgn

SEQ ID NO: 40886 - DNA, 613 bp, Homo sapiens
  misc_feature: GYAE6OF01BSOJ2.2.86.H09.1.454.CMB.1.raw
  modified_base (612)..(612): a, c, t, g, unknown or other
  misc_feature (612)..(612): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgacaaatgaacaccctgagagccgaggacacggccatctattatgtgcgaaggacagtaggggccggcggcgggagcgaatgacttcgtggggccagggaaccctggtccaccgtctcctcacgccctccaccaacgggcccatccggtccttcccccgtggcccgccctcggcctcccgaggacgccacccgtccgacgacgccaccgacggcccggcccgtcgggcctcggtcccgttcgggtaccgaacggaccttaccgtttacccgtcgtccggacgtcccggttcgtcggcgggacgggccgtacgggaccggtaaaggccgacgagtacgng

SEQ ID NO: 40887 - DNA, 640 bp, Homo sapiens
  misc_feature: GYAE6OF01CCN90.2.86.H09.1.454.CMB.1.raw
  modified_base (447)..(447): a, c, t, g, unknown or other
  misc_feature (447)..(447): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgacaaatgaaccaccctgagacgccgaggacacggccatctattatgtgcgaaggcagtaggggccggcggcgggagcgaatgtacgttcgcggggaccaggtaaccctggtccaccgtctccctcacgccctaccaccgaacgggccctacgtccggttcccttcccccgnggcccgcccgtcgcctaccgacgggacgcccacccgtaccggagacgaccgaaccgcggccccggtcccgtcgggaccttcggacccgttgggtaacccgtaacggtaccttaccgtttccgtacgtaccggacggtccgttcgtggaccgggcgggtccgtacgggaccgaacgggccgtactaaggtgacg

SEQ ID NO: 40888 - DNA, 680 bp, Homo sapiens
  misc_feature: GYAE6OF01CVGYI.2.86.H09.1.454.CMB.1.raw
  modified_base (287)..(287): a, c, t, g, unknown or other
  misc_feature (287)..(287): n is a, c, g, or t
  modified_base (469)..(469): a, c, t, g, unknown or other
  misc_feature (469)..(469): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaagggctggagtgggtctcagctattgatggtggttctgttgtcccacactacgcggcctccgtgaagggccggttcaccatgtccagagacaattacgaaaaacacgctgtatctgacaaatgaaacnccctgagagccgaggacacggccatctattattgtgacgaagacagtacggggccggcgcgggagcgaagtgacgttcgtcggggcctaacggggaacccttggtccaccggttctcccgtcgacgcccttacccgaaccgaacggggcccctaacgttccgggttacccttttccccccgngggtccccgccccgtggacccgttacccgacgggacgccctaacccgtccgaagtacgccaaccgacggccggtaccccgtggggccttcggacccgttcggtacgaacgggtaccttacccgtttaccgtacgttccgggaacggtcccggtcttagggtacgggccggggtcctacggggaacgtaaacgggcccgacgagttaacggc

SEQ ID NO: 40889 - DNA, 658 bp, Homo sapiens
  misc_feature: GYAE6OF01CDZ0N.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgacaaatgaaaccaccctgagagccgaggacacggccatctattattgtgacgaaggacagtaggggccgcggcgggagcgaatgacttcgtggggccacgggaaccctggcaccggttctccctcacgtccctaccaccgaacggggcccaacgttccggttcccttcccccccgtgggcccgccccgtcgccctcccgacgggacgccgacccgtcccgaaggacgaccgaacgacggcccggtcccgtcggggtccttcggcccgttcgggtaccgtaacgggtaacccttaccgtttccgtcgggtacccgaaggtcccggttcgttacgggacggccggggtccgtcgggacggtaaacgggccgaaccgtagtcgag

SEQ ID NO: 40890 - DNA, 822 bp, Homo sapiens
  misc_feature: GYAE6OF01DFJM4.2.86.H09.1.454.CMB.1.raw
  modified_base (285)..(285): a, c, t, g, unknown or other
  misc_feature (285)..(285): n is a, c, g, or t
  modified_base (810)..(810): a, c, t, g, unknown or other
  misc_feature (810)..(810): n is a, c, g, or t
  modified_base (817)..(817): a, c, t, g, unknown or other
  misc_feature (817)..(817): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccgaggctccgaggaaaggggctggagtgggtctcgagctattgtagtggttggttcttgttcgtcccacactaccggcgcctccggtggaacgggtcccggttcaccgatcgtccagaacgactaattacgaaaaacncgctgtactctgactaagtacgaacctaccgtggacgaccggacggaacggaccgaaccggccctaattacttaactttagtcggtacgaccggaaggtaccagggtacggggcccggcggaccgggagacgtaacgtcgaccggtttcgggacgggggacccgacggtaacccgtcgtaccgtaccggttaccctccgtacccgtaccgtaccccgtacccgaaccggaacccggggaccccttaaccggttccccgggtttcccccgttaccccccgggttcgggtaaccccccgttcccgtaccggtaccccgttacccgggaacgggaccccggtaccgtaacccccgtaccgggaaccggttaacccgaacggtaacccgacccggggtcccggtccccgggtacgggtcccgtaccggttacccgggtacgttaacccgacgggttacccttccggttaccgtcggtaccggacgtcccggtggtacccggcgggaccggtacggtacggacgtacggngtaacgngtagc

SEQ ID NO: 40891 - DNA, 588 bp, Homo sapiens
  misc_feature: GYAE6OF01D6LWG.2.86.H09.1.454.CMB.1.raw
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (446)..(446): a, c, t, g, unknown or other
  misc_feature (446)..(446): n is a, c, g, or t
  modified_base (489)..(489): a, c, t, g, unknown or other
  misc_feature (489)..(489): n is a, c, g, or t
  modified_base (560)..(560): a, c, t, g, unknown or other
  misc_feature (560)..(560): n is a, c, g, or t
  modified_base (581)..(581): a, c, t, g, unknown or other
  misc_feature (581)..(581): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtgttctgttgtcccacactacgcggcctccgtgaacgggccgttcaccatgtccagagacaattacgaaaaacncgctagtatctgacaaatgaaccacctganacgccgaggacacggcatctattatgtgacgaagacagtagggccggnggacggagcgaaatgacttcggtggggaccagggaaccctggtacctaccgtctcctcgacgccctaccaaccgaacgggcccacgttccggtcccttccccgnggcccgtcccctgcctaccgaggtacgcctacccgtcgagacnccgaacgacggccggtccccgtggtccgtcgtcgtaggtacaacggtactccgttcgtcgcgaggtccgtnaggcgcggacgcgacgacgcncagtgcg

SEQ ID NO: 40892 - DNA, 648 bp, Homo sapiens
  misc_feature: GYAE6OF01DE6QN.2.86.H09.1.454.CMB.1.raw
  modified_base (146)..(146): a, c, t, g, unknown or other
  misc_feature (146)..(146): n is a, c, g, or t
  modified_base (280)..(280): a, c, t, g, unknown or other
  misc_feature (280)..(280): n is a, c, g, or t
  modified_base (480)..(480): a, c, t, g, unknown or other
  misc_feature (480)..(480): n is a, c, g, or t
  modified_base (495)..(495): a, c, t, g, unknown or other
  misc_feature (495)..(495): n is a, c, g, or t
  modified_base (518)..(518): a, c, t, g, unknown or other
  misc_feature (518)..(518): n is a, c, g, or t
  modified_base (599)..(599): a, c, t, g, unknown or other
  misc_feature (599)..(599): n is a, c, g, or t
tcagacgctcgacacacgaccggtgctcgatttagtgctatagacttggggtttgggggaggcttggtacagcctggggggtccctgagactctcctgtgcagcctctggattcacctttagtaactttgtcatgaggtgggtccnccaggctccaagggaaaggggctggagtgggtctcagctattgatggtggttctgttgtccacactacgcgctccgtggaagggccgttcacatgtcagagactaatacgaaaaacacgctgtatctgactaanagaaccacctgagacgccggaagacgacggaccattacttattatgtcgacggaaagacgagtacggggcccggcggacgggagacgaattggacgtacggtcggggacgaacgggaaccgtcggtcctaccggtctccctgacgccctaccaaccgaccggcctacgtcccggttaccttcccccgtcggcccgtcccncgtcctacgacggtnaccgcccgtacgaggacaccganaccgggccgccgtcggcgtacgtccgtagggtaccgtaaccggtcttaccgttccgtacggtccggtaggtccggtaacgngggtaccgggcggggtacacggggtaccggaaggaccctaggactaggc

SEQ ID NO: 40893 - DNA, 655 bp, Homo sapiens
  misc_feature: GYAE6OF01CRMAC.2.86.H09.1.454.CMB.1.raw
  modified_base (272)..(272): a, c, t, g, unknown or other
  misc_feature (272)..(272): n is a, c, g, or t
  modified_base (489)..(489): a, c, t, g, unknown or other
  misc_feature (489)..(489): n is a, c, g, or t
  modified_base (603)..(603): a, c, t, g, unknown or other
  misc_feature (603)..(603): n is a, c, g, or t
  modified_base (645)..(645): a, c, t, g, unknown or other
  misc_feature (645)..(645): n is a, c, g, or t
  modified_base (650)..(650): a, c, t, g, unknown or other
  misc_feature (650)..(650): n is a, c, g, or t
  modified_base (655)..(655): a, c, t, g, unknown or other
  misc_feature (655)..(655): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccgaggaaaggggctggagtgggtctcagctattgatggtggttctgttgtcccacactacgcggcctcggtgaacgggccggttcaccatcgtccagagaactaattaaccgaaaaacncgctgtatctgacaaatcgaaccaccctgaagacggccggaggaccacggcattcttattagtgtcgaacggaaggacaggtacggggccggcggcgggagacgaagtcgtacgttcggcggggaccgacgggtaccctggtccaccgttcctccgtcgacgtcccctaccaaccggaccgggaccccttacggttcccggttccccttcccccggnggccccgtcccgtcgcccgtaccggaggaccctacccgaccgtccgagaccgccaacggcggccccgggtccgtcgggcctcggccgttaggaccgtacgtccttacgttccgngtccggaggtccgtgacggcggtccggtcgacggcgtacggntacgngtcgn

SEQ ID NO: 40894 - DNA, 821 bp, Homo sapiens
  misc_feature: GYAE6OF01DCLRP.2.86.H09.1.454.CMB.1.raw
  modified_base (766)..(766): a, c, t, g, unknown or other
  misc_feature (766)..(766): n is a, c, g, or t
  modified_base (817)..(817): a, c, t, g, unknown or other
  misc_feature (817)..(817): n is a, c, g, or t
tcagacgctcgacacacgaccggtgctcgatttagtgctatagacttgggtttgggggaggcttggtacagcctggggggtccctgagactctcctgtgcagcctctggattcacctttagttaactttgtcatgaggtgggtccgcaggctccagggaaaggggctggagtgggtctcagctattgatggtggttctgttcgtcccacactacgcggcctccgtggaagggccgttcacatcgtccagagaactaattaacgaaaaacacgctgtatctgacaaagtagaaccaccctaggaagacggaccgaaggacaccggctaatacttatttagtgtggaacgaacggacgtagggtacgggggccggacgggacgggacggacgtaagtacggtacgttccggtacgggggacccgacggggtaaccctcgggtaccctacccggttccctcccgtacgacccggtaccccgttaccccgaacccggtaaccggggtccccctaaccgggttcccggttttcccccccgttccccccgggtcggacccccggttccccgttcggtaccccgttccccggaacgggacccgtacccccgtacccgtacccccgggagggaaacccgccgaaccggtaccggtccccgggtttcccggttacgggggtccttttaccggttcccggtaacggttaacccgtaaaccggttcgtttaaccccgttccggttaccgggtaccggtaccggtcggtttaccgggngggtaacccggggtccgggtacgtaacgggacgtaacggccgtaacgtagngtcg

SEQ ID NO: 40895 - DNA, 588 bp, Homo sapiens
  misc_feature: GYAE6OF01AZNDP.2.86.H09.1.454.CMB.1.raw
  modified_base (398)..(398): a, c, t, g, unknown or other
  misc_feature (398)..(398): n is a, c, g, or t
  modified_base (438)..(438): a, c, t, g, unknown or other
  misc_feature (438)..(438): n is a, c, g, or t
  modified_base (462)..(462): a, c, t, g, unknown or other
  misc_feature (462)..(462): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtggtccgccaggctccaggaaaggggctggagtgggtctcagctattgatggtggttctgttgtcccacactacgcggcctccgtggaacgggccggttcaccatgtccagagacaattacgaaaaacacgctgtatctgcaaatgaacaccctgagagcgaggacacggccatctattatgtgcgaaggacaggtacggggccggcggcgggagcgaatcgacttcgcggggccacgggaaccctggtccaccgtctccncacgccctacaccgacggcccagtccggtccttcccccgnggccccgccctgcctccgacggcnccgacccgtcgagcgcacgacgccggcccgtgggcctcgtccgtggtaccgaaggtacccgttaccttccgtcggtacgacgtccggtgtcgggacggcggggtcgcgggcgacgggcncngtgcg

SEQ ID NO: 40896 - DNA, 677 bp, Homo sapiens
  misc_feature: GYAE6OF01CBE8R.2.86.H09.1.454.CMB.1.raw
  modified_base (296)..(296): a, c, t, g, unknown or other
  misc_feature (296)..(296): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (504)..(504): a, c, t, g, unknown or other
  misc_feature (504)..(504): n is a, c, g, or t
  modified_base (654)..(654): a, c, t, g, unknown or other
  misc_feature (654)..(654): n is a, c, g, or t
tcagacgctcgacacacgaccggtgctcgatttagtgctatagacttgggtttgggggaggcttggtacagcctggggggtccctgagactctcctgtgcagcctctggattcctacctttagttaacttttgtcatggagggtgggtcccgccaggctccgaagggaaaggggctggagtgggtctcagctattgatggtggttctgttcgcccacactaccggcggcctccggtaggaacgggtccgttacaaccattcggaccaagacgtaactaaagttaaccgaaaaaacncgcttagtatcctagaacaaagtcgaaaccaccgtagaagacgaccggaggacaccggacctatcttattntgngacgaaganaggtacgggccgcggtcgggagtacgaagtcgacgttccggacgggacgaacgggtaccctggccaccgtctcctcgaacgtcccctaaccgaccgaacggccctacgtccgttccccgtcccgnggcccctccgtcgcctcgacggcgtaccaccgtcgaagcaccgtacgcggtcccggaccggtccgggacctccgggccgtacggttaaccgtaacgggtccttaccgttaccgcggttaccggacggttcgtcggtacggcggtccgggngacggacgacggcgacagtgacg

SEQ ID NO: 40897 - DNA, 737 bp, Homo sapiens
  misc_feature: GYAE6OF01D2RHP.2.86.H09.1.454.CMB.1.raw
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
tcagacgctcgacacacgaccggtgctcgatttagtgctatagacttgggtttgggggaggcttggtacagcctgggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtggaagggccggttcaccatgtccagagacaattcgaaaaacacgctgtatctgcaaatgaacaccctgagagccgagacacggccatctattattgngacgaaggacagtaggggccggcgngggagcgaatgacttcgcggggaccaagggaccctggtccaccggtctcctcacgccctccaccgaacggggccccacgttccggtaccctttcccccgtggggccccgtccccgtcgaccctcccggaacgggtaccgaccgtaacccccgttccgggaacgaccgtaccgaaccgacgggcccgggtcccccggttacggggcccgttacgggccccggttacggggtacccgaaacggggttacccctttaaacccgtttccccgggtacggttcccggtaaacgggttcccggttacccggttaggggaaccggggtccccggggggtacccgttacgggggaacccgggaaacggggtacccggtaaccggtaaggtaacggtcgg

SEQ ID NO: 40898 - DNA, 884 bp, Homo sapiens
  misc_feature: GYAE6OF01D2HTL.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgcaggctccaggaaaggggctggagtgggtctcgagctattgatggttggttcttgttcgtcccacactacgccggcctccggaggaacgggccggttcaccatcgtccaagagaactaagttaacgaaaaacacgctagtactcttagaacaaatacgaaccacccgtagaaggacgacggaggaccgaccggactatttactatttaagtttggtacggaacggaacggtaacggtaacggtacgggggaccgggaccggggacgggaacggtacgaaaggttacggttaccgttccgggttacgggggacccgtaaccggggtaaacccggttcggtaccgtaaccccggtttcttaccccgttacacccgtaccccgtacccggaaacccgggtaacccggggtacccccttaaccgggtttaccccggtttcccccggttttcccccccgttacggggcccccggtcccccgttcggaccccgttacccggaacggggtacccgtacccgtaaccccggttaccggaaccggtaaccgacccgaccggtaccgggccccggtacccgggtcgggtaccggttccggtacccggtttgggtaaccccgtaacggggttaccctttaacccggttcccggttacggtacccgggttaccggtccggttaccggtacggggtccggggaccgggttcggaccggggtaacccgggaagggacccgtatacgggagcg

SEQ ID NO: 40899 - DNA, 791 bp, Homo sapiens
  misc_feature: GYAE6OF01C3KNH.2.86.H09.1.454.CMB.1.raw
  modified_base (274)..(274): a, c, t, g, unknown or other
  misc_feature (274)..(274): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccagggaaaggggctggagtgggtctcagctattgatggtggttctgttcgtcccacactacgccggcctccgtgaagggccggttcacctatcgtaccagagaactaattaccgaaaacncgctgtactctgacaaatcgaaccaccctagagacgccgagacacgcatctattattgtgacgaaggacagtacggggccggcggacgggagacgaagtcgtacgttcggacggggtaccgaaccgggtaacccgtggtacccaccggttcctcctcgaccgtcccctacccgaacccggaacgggacccctacggttcccggttacccccgtttccccccggtcggggtacccccgttcccccgtcggtacccgttaccccggaacgggtaccgacccctaaccccccgtcccgggaacgacgtaccccaacccggaccgggaccccgggttcccccggttcggggtaccttccgggttcccggttacggggttaacccgaaccggggttaaccctttacccggtttacccgtcgggttacccggtaacgggtcccgtttacggtacgggaaccggggttcccgggggtaccgttacggggacccgaaaccggggttccgaacggtaagttcggga

SEQ ID NO: 40900 - DNA, 682 bp, Homo sapiens
  misc_feature: GYAE6OF01D0Z0Q.2.86.H09.1.454.CMB.1.raw
  modified_base (276)..(276): a, c, t, g, unknown or other
  misc_feature (276)..(276): n is a, c, g, or t
  modified_base (336)..(336): a, c, t, g, unknown or other
  misc_feature (336)..(336): n is a, c, g, or t
  modified_base (677)..(677): a, c, t, g, unknown or other
  misc_feature (677)..(677): n is a, c, g, or t
tcagacgctcgacacacgaccggtgctcgatttagtgctatagacttgggtttgggggaggcttggtacagcctggggggtccctgagactctcctgtgcagcctctggattcaccttttagtaacttttgtcatgaggtgggtccgccaggctccgaggaaaggggctggagtgggtctcagctattgagtggttggttctgttcgtcccacactacgcggcctccgtggaacgggccgttcaccatcgtccagagaactaattaacgaaaaacncgctgtatctgacaaatcgaaccacctgagacgcgagacacggactatcttattagttgngacgaaggacgaggtacggggccggacggcgggaagacgtaagtcgacgttcggacggggaccgacgggtaaccctggtacctacccgtcctcctacgacgtccctaccgaaccggaacgggccctacggttcccggttccccttccccggtcgggccccgtccctcgacccgtaccgacgggaccgcccacccgtcggacgaccgacaaccggcggcccgggaccggtcggaccgttccggaccgttcgggaactaacggtaccttccgttcgtacggtccgaccggtccgtcggtaggccggggtccgggtccgtacgggaaccggacgggactaacgngtgcg

SEQ ID NO: 40901 - DNA, 692 bp, Homo sapiens
  misc_feature: GYAE6OF01DQW46.2.86.H09.1.454.CMB.1.raw
  modified_base (265)..(265): a, c, t, g, unknown or other
  misc_feature (265)..(265): n is a, c, g, or t
  modified_base (358)..(358): a, c, t, g, unknown or other
  misc_feature (358)..(358): n is a, c, g, or t
  modified_base (635)..(635): a, c, t, g, unknown or other
  misc_feature (635)..(635): n is a, c, g, or t
  modified_base (674)..(674): a, c, t, g, unknown or other
  misc_feature (674)..(674): n is a, c, g, or t
  modified_base (683)..(683): a, c, t, g, unknown or other
  misc_feature (683)..(683): n is a, c, g, or t
  modified_base (687)..(687): a, c, t, g, unknown or other
  misc_feature (687)..(687): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaagggctggagtgggtctcagctattgatggtggttctgttcgtcccacactacgcggcctccgtgaacggccgttcaccatcgtccagagacaattacgaaaaacncgctgtatctgacaaatgaacctacctgagacgacccgaggacaccggcatccttaagttattagtcgacgaaggacaggtacggggcccggnggcggagcgaagtcgactttcgacggggaccacggggtaaccctggtacccgtaccttccgtcctccgacggtacccctacccgaacccgtaacccggggtacccctacggttccccgggttaacccctttccccccggacgggtcccgtacccccgttgcccgttacccggagggaccgtacccgccctaccgggacgtacggaccaaccgggcggtccccggcccgttagggtccctcgtaccgttcggtaacacgggttacctacctttccggnggttccgaagtccgtcgttcggcggcgggtccgaacggngaaccggtnacgngtgac

SEQ ID NO: 40902 - DNA, 796 bp, Homo sapiens
  misc_feature: GYAE6OF01DB5F1.2.86.H09.1.454.CMB.1.raw
  modified_base (273)..(273): a, c, t, g, unknown or other
  misc_feature (273)..(273): n is a, c, g, or t
tcagacgctcgacacacgaccggtgctcgatttagtgctatagacttgggtttggggggaggcttggtacagcctgggggggtccctgagactctcctgtgcagcctctggattctacctttagttaacttttgtcatgaggtgggtccgccaggctccaagggaaaggggctgggagtgggtctcagcttattgagttggttggttctgtttcgtcccacactaccggcgccctccggtggaacgggtccggttccaccatcgtccaagaanactaattaaccgaaaaacacgctgtaatctgaactaaagtcgaacctacccgtagaacgacggaccgaacggacgaccggcctaatttaccttaatttacgtttggtacggaaccggaaagggacgtacgggtaccgggggcccggccggggacgggaacgacggtaaagtccggtaccgtttcgggaccggggacccgtaacgggtaccccgttcggtaccctacccggttcctcccgtacgaccgtcccctacccgaaccggaaccggtcccctacgttcccgggttaccccctttcccccggacgggtccccgttcccgtcggacccctcgggaaccgcccgacccgtacccggtaccggaccgtacgcccgtaaccgccgggtcccggtcccgggttcggacccgttccggaccgttcgggttaacgaacggttacccttcccgtttccgacggttccggacggtccgtacgtacggggcggtccgggtccgtacgggaccgtaaggcctaactggctg

SEQ ID NO: 40903 - DNA, 698 bp, Homo sapiens
  misc_feature: GYAE6OF01EQ2E9.2.86.H09.1.454.CMB.1.raw
  modified_base (264)..(264): a, c, t, g, unknown or other
  misc_feature (264)..(264): n is a, c, g, or t
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (683)..(683): a, c, t, g, unknown or other
  misc_feature (683)..(683): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggttgggtccgccaggctccaggaaagggctggagtgggtctcagctattgatggtgttctgttgtcccacactacgcggcctccgtgaacgggccgttcaccatgtccagagacaattacgaaaaacncgctgtatctgacaaatcgaaccaccctgagacgccgaggacacggaccatctattntgtgacgaagacgagtaggggccgnggcggagcgatgacttcgngggccacggacctggtccacgtcctcncgacncctacccacgacgggtccacgttcccgtccttcccccgtggcccctcccgtacgccctaccggacggaccgccgtaccccgtacgtacggaccgacccgaacgggtaccggccccggtcccggtacggggtccccttacggcccgggtttacggtaacccggaaacggggttcccttttaacccggtttacccgttcgggtacccgtaccgggttcccggtttagggtaccgggtggggacccccggggttcggtaaccggggtaacccggaacggggtaccccgngttaaaccggtggcc

SEQ ID NO: 40904 - DNA, 594 bp, Homo sapiens
  misc_feature: GYAE6OF01A0IKU.2.86.H09.1.454.CMB.1.raw
  modified_base (264)..(264): a, c, t, g, unknown or other
  misc_feature (264)..(264): n is a, c, g, or t
  modified_base (363)..(363): a, c, t, g, unknown or other
  misc_feature (363)..(363): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
  modified_base (497)..(497): a, c, t, g, unknown or other
  misc_feature (497)..(497): n is a, c, g, or t
  modified_base (590)..(590): a, c, t, g, unknown or other
  misc_feature (590)..(590): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacncgctgtatctgcaaatgaacaccctgagagccgaggaccacggccatctattatgtgcgaaggacagtacggggccggcgcgggagcgaatgacttcgnggggccagggaaccctggtcaccgtctcctcagccctccaccgaacgggccccagtcccggtccttacccccgtgggcccnccctcgcctccagggacncctacccgtccgagacggccacgacggccggcccnggggcctggacccgttagggtaacgccttaacgttcctggtccgaggtaccgtcgtggacggtcgggcgtggaccgaacgggccacgataggntacg

SEQ ID NO: 40905 - DNA, 658 bp, Homo sapiens
  misc_feature: GYAE6OF01BY7B4.2.86.H09.1.454.CMB.1.raw
  modified_base (275)..(275): a, c, t, g, unknown or other
  misc_feature (275)..(275): n is a, c, g, or t
  modified_base (335)..(335): a, c, t, g, unknown or other
  misc_feature (335)..(335): n is a, c, g, or t
  modified_base (425)..(425): a, c, t, g, unknown or other
  misc_feature (425)..(425): n is a, c, g, or t
  modified_base (656)..(656): a, c, t, g, unknown or other
  misc_feature (656)..(656): n is a, c, g, or t
tcagacgctcgacacacgaccggtgctcgatttagtgctatagacttgggtttggggggaggcttggtacagcctggggggtccctgagactctcctgtgcagcctctggattcacctttagtaacttttgtcatgaggtgggtccgccaggctccagggaaaggggctggagtgggtctcagctattgatggtggttctgttcgtcccacactacgccggcctccggtggaacgggccggttcaccatcgtccagagaacaattacgaaaaacncgctgtatctgacaaatcaaccaccctgagacgaccgaggaccacggcatctattattgngcggaaggacaggtacggggccggcggacgggagacgaagtgtacgttcgcggggccgaacgggtaccctcggtccaccgtctccctacncgccctacccgacggaaccgggccctacggttcccggttccccttacccccggtcgggtaccccgtcccctcggtccctcccggaagggtaccgcctaaccccgtccgacgacgaccgaccgacggtcccggaccgtcgggcctcggcgtcggtaccgaacgtaccgttccttcctcgtcgtacggtccggtagtggccggtcggcggtacgccgggtaacggcgtctagngc

SEQ ID NO: 40906 - DNA, 675 bp, Homo sapiens
  misc_feature: GYAE6OF01CQAGX.2.86.H09.1.454.CMB.1.raw
  modified_base (265)..(265): a, c, t, g, unknown or other
  misc_feature (265)..(265): n is a, c, g, or t
  modified_base (601)..(601): a, c, t, g, unknown or other
  misc_feature (601)..(601): n is a, c, g, or t
  modified_base (643)..(643): a, c, t, g, unknown or other
  misc_feature (643)..(643): n is a, c, g, or t
  modified_base (651)..(651): a, c, t, g, unknown or other
  misc_feature (651)..(651): n is a, c, g, or t
  modified_base (657)..(657): a, c, t, g, unknown or other
  misc_feature (657)..(657): n is a, c, g, or t
  modified_base (671)..(671): a, c, t, g, unknown or other
  misc_feature (671)..(671): n is a, c, g, or t
tcagacgctcgacacacgaccggtgctcgatttagtgctatagacttgggtttgggggaggcttggtacagcctggggggtccctgagactctcctgtgcagcctctggattccacctttagtaacttttgtcatgaggtgggtccgccaggctccaggaaaggggctggagtgggtctcagctattgagtggtgttctgttcgtccacactacgcgcctcgtgacgggccgttcaccatcgtccagagacaattacgaaaaacncgctgtatcgtagacgaaatcgaaaccacccgtgaacgacgaccggaaggaccaccggcctagttacttaattagttcggtagacggaaggactaggtacggggccggacggcgggagacgagtcgtaccgttcggtacggggtaccgaacgggtaaccgtcggtaccacccggtctacccgtcgaccgtccctacccgaccgacgggcccctacggttacccggttccccgttacccccggtcgggccccgtcccgttcgacccgtaccgacggaccgtacccgtaccccgtacgaacgtacgaccgaacccgacggcccgcccggtacggtccnccggtcgtacgtacgacgtactccgttcgcgtcgacgtcgtntaggcggnggtcgnggtaccgaggcacngtgc

SEQ ID NO: 40907 - DNA, 757 bp, Homo sapiens
  misc_feature: GYAE6OF01AT660.2.86.H09.1.454.CMB.1.raw
  modified_base (267)..(267): a, c, t, g, unknown or other
  misc_feature (267)..(267): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctgggagtgggtctcagctattgatggtggttctgttgtcccacactacgcggcctccgtgagggccggttcaccatgtccagacgacaacttacgaaaaacncgactgtatctgacaaatgaaccacccgtagagacgacgacggacaccggcatcttaattatgtgacgaaggacaggtacgggggccggtcggacgggaggacgaacgtcgtactttcggacggggaccgacgggaacccttggtacccaccggttccctcctccgaccgtacccctacccgaacccggacggggacccctacggttcccggttcccgttaccccccggtggccccgtcccgtcgcccgtaccgacgggtaccacccgtaccctacggacgacggaccctaccggacggtcccgggacccggtcggggtcccgtccggtacccggttgggtaacccgtaaccggttaccgtttaccccgttccgggttaccggttaaccggggaaccggttcccgggtttaaccctacgggggcccgggttacccgggggtacgggtccggggtaaccggacccgggggtaccaaccggtaagtacggtc

SEQ ID NO: 40908 - DNA, 812 bp, Homo sapiens
  misc_feature: GYAE6OF01C57XC.2.86.H09.1.454.CMB.1.raw
  modified_base (268)..(268): a, c, t, g, unknown or other
  misc_feature (268)..(268): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaaaggggctggagtgggtctcagctattgatggtggttctgttgtcccacactacgccggcctccgtgaagggccgttcaccatcgtccagagactaattacgaaaaacncgctgtatctgacaaatacgaaccacccgtagacggacggaccggaaggaccgaccggacccattcgtaatttagttggtgacggaacggacgaggtacgggggccggcgggacggggaacgcgaagtcgtacgttccggtagggggacccggtaacggggtaacccgtcgggtacccgtaccccggttaccttcccgttaccgaaccgtccccgttacccgaacccgtaaaccgggggtacccctaacggttccccgggttcccccgttttccccccggtaccgggtccccggtccccgttcggtacccgtacccggaagggtaaccgtaccccgtacccgtacccgggaaccgaacggaccgaaccgaccgggccccgggtccccggtacccggggtccgttccgggaccggttcgggttaacccgtaacgggttaacccgttttaacccggttccgtaccgggttaccggtacggttcccggttcgtccgggtaacgggccgggtaccggccgggtacgaacgggtccgaacgtgtagacg

SEQ ID NO: 40909 - DNA, 742 bp, Homo sapiens
  misc_feature: GYAE6OF01C138J.2.86.H09.1.454.CMB.1.raw
  modified_base (310)..(310): a, c, t, g, unknown or other
  misc_feature (310)..(310): n is a, c, g, or t
tcagacgctcgacacacgaccggtgctcgatttagtgctatagacttgggtttgggggaggcttggtacagcctggggggtccctgagactctcctgtgcagcctctggattcaccttcagtagctactggatgcacgtgggtccgccaagctccgagggggaaggggctgggtgtgggtctcacgttattaatagtgaagtggggatagcaacgaagctacggcggactccggtaggaacgggcctattcaccattccgcagacgacaacgaccaaagaacacgcttgtatctagacaaaatcgaaacngttcagagacgccggaaggcacggtcttggtattaattacgtgacgacgaaagagtatagccaagcgtaaggccgtacgggtacccgaccgtaaacgttacgggcggggacccgtaaacggggtaccccttggggtaccctaccccggttccttacccgacgaccgtaccccacccgaacccgggaaccgggacccctacggttccccggttccccgttcccccggtcggccccgtaccccgtcgtacccgtaccggacggtacccgaccctaccgacccggacgaacgacccgaacggccggaccccgggtccggtccgggtcgttcccggcccggttacggtaacccgtaacggttaccctttaacccgtccggttacgggtacccggaccgttccggtacggtacggggcggccgggttacggaccggg

SEQ ID NO: 40910 - DNA, 697 bp, Homo sapiens
  misc_feature: GYAE6OF01BPDZG.2.86.H09.1.454.CMB.1.raw
  modified_base (149)..(149): a, c, t, g, unknown or other
  misc_feature (149)..(149): n is a, c, g, or t
  modified_base (213)..(213): a, c, t, g, unknown or other
  misc_feature (213)..(213): n is a, c, g, or t
  modified_base (355)..(355): a, c, t, g, unknown or other
  misc_feature (355)..(355): n is a, c, g, or t
  modified_base (689)..(689): a, c, t, g, unknown or other
  misc_feature (689)..(689): n is a, c, g, or t
tcagacgctcgacacacgaccggtgctcgatttagtgctatagacttgggtttgggggaggcttggtacagcctggggggtccctgagactctcctgtgcagcctctggattcaccttcagtagctactggactggcacgtgggtcccnccaagctccgaggggaggggctgggtgtgggtctcacgtattaatagtgagtgggacgtagcanaagctacgcggacctccggtaggaacgggcattcacatcaccagagacacgaccaagacacggctagtatcctagacaaatcgaaatgtactaggacgacggaccggtaggacctacgggctggttactatttacgtggtanacgaaaggtacgataacggcagcgaacggtccgttaggacccgtaccggacgttacgggccgggggaccaacggggtaaccccttgggtaccctaacccgttcctacccgtccgacgaccccgtaaccccgaaccggtaccggacccctacggttccccgtaacccgtttcccccgcgggcccttcccgtaccgtcccgtaccggccgaaccgcccgtacccgtacccgacggccgaccgaccgacggtccccggacggtcggaccgtcgcccggtacgtaccggacgttactaccgttccgacggcgtaccgtgtcccgtagcgggtaccggngtaccggg

SEQ ID NO: 40911 - DNA, 811 bp, Homo sapiens
  misc_feature: GYAE6OF01A0OGC.2.86.H09.1.454.CMB.1.raw
  modified_base (517)..(517): a, c, t, g, unknown or other
  misc_feature (517)..(517): n is a, c, g, or t
tcagacgctcgacacacgaccggtgctcgattttagtgctatagacttgggtttgggggaggcttggtacagcctggggggtccctgagactctcctgtgcagcctctggattcaccttttagtaacttttgtcatgaggtgggtcccgccaggctccgaaggaaggggctggagtgggtctcgagcttattgagttggtggttctgttcgtcccaactaccgtacgccggccttccggtaggaacgggtcccggttacaccctagtcgtaccaaggaacgaactaacgttaaaccgaaaaaccaccgcttacgtaacttctacgaactaaaacgtacgaaaccacccgtaggacggaacgaccggaacggaaccgaccggacctacgtttaccttaagtttacttcggtaggaacggaaacggtacgacgggtaacgggggcccgggcgggaccggggaggtacgaacgttcggtacgttccgggtcggggaccggacggtaacccgtcggtaccncccggttcctccctccgaccgtccctacccgaaccgaaccgggcccctacggttcccggttccccgttcccccggtaccgggtcccgtacccgtccgtcccgtaccggacggaccgaccctaccgtaccgagtaccgtccaaccgtacccgggcccgtccgggcggtcccaccggttcggaccggttaacggaaccgttacctttaccccgtacggttccgtacggtaccgggtccttagggtccgggaccggttaccgggtcggacggaacgtacggcccgtaagaacgtcgc

SEQ ID NO: 40912 - DNA, 636 bp, Homo sapiens
  misc_feature: GYAE6OF01ANH3C.2.86.H09.1.454.CMB.1.raw
  modified_base (632)..(632): a, c, t, g, unknown or other
  misc_feature (632)..(632): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctcgtgagggccgttcaccatgtccagagacaattacgaaaacacgctgtatctagacaaatcgaaccaccctagagacgccgaggacacgccatctattattgtgacgaaggacagtacggggccggcggcgggagacgaagtgtacgttcggtacggggccgaacgggtacccgtcggtccaccgtctccctcgaccgaccctccgaaccgaacggccctacgtcccggttccccttcccccgcgggcccgtccctgcccttacggacggtaccgcccacccgtccggaacgacgtccaccggtacgggcccggtacccgtgggtcctaccggtccgtacggtaacgaacggttaccttacgttccgtggtcgacgtcgtcgtaggccggcgggtccgcggacgacggcgacngtgc

SEQ ID NO: 40913 - DNA, 669 bp, Homo sapiens
  misc_feature: GYAE6OF01CJ2ZB.2.86.H09.1.454.CMB.1.raw
  modified_base (635)..(635): a, c, t, g, unknown or other
  misc_feature (635)..(635): n is a, c, g, or t
  modified_base (669)..(669): a, c, t, g, unknown or other
  misc_feature (669)..(669): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaaaggggctggagtgggtctcagctattgagtggtggttcttgttcgtcccacactaccgcggcctccgtgaagggccgttcaccatgtccagagacaattacgaaaacacgctgtatctgacaaatacgaacacccgtagacgacgaccggagaccgaccgactacttacttatttagttaggtagacggaaggacgtaggtacggggccggcgggacgggagacgaatcgtcttcggcggggaccgacgggtaccgtcggtaccgaccgttctcctacgaccgaccctacccgaccgaaccgggccctaacggttcccggtttaccccctccccggtggcccccgtcccgtcggtaccctcggaccggtacgccccaacccgtcggaacggaccgaccaccgggacggtccccggccggtgggcctccggtcgtacggacgtacggtaccttccgttcgtcgcgtacgccggtangggaccggcggtacgcggacgacgccatacgtgn

SEQ ID NO: 40914 - DNA, 1006 bp, Homo sapiens
  misc_feature: GYAE6OF01B78QD.2.86.H09.1.454.CMB.1.raw
  modified_base (308)..(308): a, c, t, g, unknown or other
  misc_feature (308)..(308): n is a, c, g, or t
tcagacgctcgacacacgaccggtgctcgatttagtgctatagacttggggtttgggggaggcttggtacagcctggggggtccctgagactctcctgtgcagcctctggattcacctttagtaacttttgtcatggagggtgggtccgccgaggctccgaagggaaaggggctggaggtgggtctcagcttattgagttggttggttctgttcgtcccactacgtaccggccggtcctccggtaggaacggggtcccggttacacctagtcgtaccgagaacgaactaaacgttaaccgaaaaaccncggtcgttagtacttcgtacgaactaaacgtacgaaaccctaccgtaggaacggacggaccgggtacggaacccgaccggtaccttaacgtttacctttaagtttacgttcgggtacggaaccgggtaaacgggtacggtaacgggtaccgggggggacccgggtacgggggaccggggaaggtaaccggtaacggttaccggttacccggtttcgggtaccggggggtacccgggtaaacccggggtaacccggtttacgggtaccccgtaccgttacccttccccgtacggtaccccgtacccccgtaaccccggaacccgggtaacccgggtaccccttaccggttacccccgggttttccccccgtaaccccccgggttcggggaccccccgttcccggtacccgtacccgggttaacccggaacccgggtaccggtaacccccgtacccgggtacccggaaccggaacccgtacccggaaccgggtaccgggtcccccggggttacccggaccggggttcccgttaacccggggttccgttaacccggggttaaccgtaacccgggttaccgtttacccgttaccggggttacccggtaccggtaccgggtccggtttaccggaccggggtacgggggtaccccggttagggacccgggtaaccgaaacgggttccgtaacgttaagcggtac

SEQ ID NO: 40915 - DNA, 888 bp, Homo sapiens
  misc_feature: GYAE6OF01AWWFF.2.86.H09.1.454.CMB.1.raw
tcagacgctcgacacacgaccggtgctcgatttagtgctatagacttgggtttggggaggcttggtacagcctgggggtccctgagactctcctgtgcagcctctggattcacctttagtaactttgtcatgaggtcggtccgccaggctccgaggaaagggctggagtgggtctcgagctattgatggtggttctgttcgtcccacacgtacgcggcctccggtgaacgggtccgttacaccgagttcgtaccgagacgtactaaacgttaacgaaaaaaccgtcgaccttgttaacgttcgtacggtacaaaacgttcggaaaccctacccgttggaaacggacggacccggaaacggaccgaaccggtacctaactttccgttaatttacgtttcggtagtaaccggtaaacgggacgttaacgggtaccgggggcccgggtacgggacggggaacgaccgtaaagttcggtaaccgtttccgggtacgggggtacccgaaaccgggtaacccgttcgggtacccgtaacccggttccgtttaccccgcgtaacccggtaccccgtaacccgaacccgggaaaccggggtcccccttaacgggtttcccccgggtttaccccccgtttcccccccggtagggtcccccgtcccgtcgtacccgtaccggtacgggacccgacccgttaacccgtaccggaacggactacccgaaaccggccgggtcccggtacccgggttcgggccccgtaccggtcccggttaacgggtaacccgtaacccggttaccgtttacccgtttacgggccggtaccgtaccggtcgtttaaccggcggtccgggacccggtcgttaccggacggaacggtaccgacgtagtccgacg

SEQ ID NO: 40916 - DNA, 860 bp, Homo sapiens
  misc_feature: GYAE6OF01B3U71.2.86.H09.1.454.CMB.1.raw
  modified_base (211)..(211): a, c, t, g, unknown or other
  misc_feature (211)..(211): n is a, c, g, or t
  modified_base (263)..(263): a, c, t, g, unknown or other
  misc_feature (263)..(263): n is a, c, g, or t
tcagacgctcgacacacgaccggtgctcgatttagtgctatagacttggggtttgggggaggcttggtacagcctggggggtccctgagactctcctgtgcagccctctggattcctacctttagttaacttttgtcatgaggtgggtccgccaggctccaaggaaagggctggagtgggtctcagctatgatggtgtctgttcgtcccanactacgcgccctccgtgaacgggcgtcacatgtcagagacaattacaaaacncgctgtattctagacaaactgaacaccgtgaggagccgaaggacaacggtccaagtctaatttatgttcgacggaaaggacacgggtaacggggcccgggacggtccgggaagtaccggagttacggacctttccggtacggggggaaccccgtaacggggtaaaccccgttcggtacccgttaacccgtccccgttcccgtaccgtaaccggtacccccgtaacccgaaaccgggaacccggggttacccgaacgtttccccgggtccccttttccccccggcggggttccccggtaccccgtaccggtcccgttaaccgggacgtaacccggtaccccaaccgggtttacccgaaaccgtacgggaccaaacccggttacgggacccccgggaaccccggttttcggggaaccccgttttcccggaccggggttaaccggttaaccgggtaaaccggtaacccgtttacccggttttaaccccggcggtttaaccccggggaacggtttccccctggggtacccggtacgggttacccgggtccggtacgggtacggaaacccgggttccccggtaaagaaccgttaggggtccc

SEQ ID NO: 40917 - DNA, 984 bp, Homo sapiens
  misc_feature: GYAE6OF02FIS2T.2.86.H09.1.454.CMB.1.raw
tcagacgctcgacacacgaccggtgctcgatttagtgctatagacttgggggtttcggggaggcttggtacacgcctggggggtccctgacgactctcctgttgcctagacctcttaggattcacctttaggtaacctttcgtcactcgagggtgggtaccgggccagggcgtccgagggaaacggggctggagttacgggtactcaggctattaagataggtggttcgtgttcgtccacgaacgtaccgcggtcctccgtagaacgggcccggttacaaccgaactacggtcccaaggaacgaccaaactttcggaaaaaacgaccgtctcgtaactactggaccgaaaacttggaaaacgaacccccgttggaaacggaacggaccccgggaagggtaccgtaaccggggtacccctaaacgttcccgttaaagtttaaccgtttagggtacggcccccggaaaaaggggttaccgaaagggttaacggggggtaccccgggacgggtccgggggggaaacggccggtaaaaacgttacggttaaccgtttaccgttacggggggggtccccggaaacgggggtaaaacccccggtacgggttccgtaaccccggtacccgtttccccttcccgaacggtccccgttccccaaaccccgaaaaccggggggacccccgaacttacccggggttcccgttttcccccccctttccggggcccggcccccgttacccggcccttaccccgaaaggggtaaccggcccaaccccgtttcccgggaacgggaacgacccgaaccgacgggaccccgggtccccggttcgggggccttacgggtccccgttacggggtaacccgtaaaacgggtaccctttaacccgtttcccggttagtacccggaacggtcccggttccgtacgggtaccggtaccgggggtcgttacggggaccggaaaccgggtccgaccggtaagtcggacg

SEQ ID NO: 40918 - DNA, 533 bp, Homo sapiens
  misc_feature: GYAE6OF02G58ZY.2.86.H09.1.454.CMB.1.raw
  modified_base (511)..(511): a, c, t, g, unknown or other
  misc_feature (511)..(511): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccggcgcggggagcgaatgacttctggggccaggggaaccctggtcaccgtctcctcagcctccaccaagggcccatccggtcttccccctggccgccctgcctccaggacgcacctccgagagcacagcggccctgggctgcctggtcaaggactactcctgtcgagcgtctgngcgggctggcaaggcgcatagc

SEQ ID NO: 40919 - DNA, 548 bp, Homo sapiens
  misc_feature: GYAE6OF02IDV5Z.2.86.H09.1.454.CMB.1.raw
  modified_base (325)..(325): a, c, t, g, unknown or other
  misc_feature (325)..(325): n is a, c, g, or t
tcagacgctcgacacacgaccggtgctcgatttagtgctatagacttgcgtttggggaggcttggtacagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagngatagcagcagctggtacgccgactacgtggggaccagggaaccctgggtccaccgtctcctcacgcctccaccaacgggcccactccggtccttccccgtggccgccctcgcctccaggacgccaccgtccgagacgcacacgccggcccgtgggcctcgccgtcgggtcaacggaccttaccgttcccgtggttccgagtccgtcgtggacggcgggtcgg

SEQ ID NO: 40920 - DNA, 527 bp, Homo sapiens
  misc_feature: GYAE6OF02F2WRT.2.86.H09.1.454.CMB.1.raw
  modified_base (360)..(360): a, c, t, g, unknown or other
  misc_feature (360)..(360): n is a, c, g, or t
  modified_base (527)..(527): a, c, t, g, unknown or other
  misc_feature (527)..(527): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccggcgcgggagcgaatgacttcnggggccaggggaaccctggtcaccgtctcctcagcctcaccagggcccatcggtctcccctggcgccctgctccaggagcacctccgagagcacagcggccctgggctgcctggtcaaggactacttcctgtcgagcgtctgacgcggctgggcaaggcgcagtagn

SEQ ID NO: 40921 - DNA, 540 bp, Homo sapiens
  misc_feature: GYAE6OF02HZLHP.2.86.H09.1.454.CMB.1.raw
  modified_base (448)..(448): a, c, t, g, unknown or other
  misc_feature (448)..(448): n is a, c, g, or t
  modified_base (540)..(540): a, c, t, g, unknown or other
  misc_feature (540)..(540): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaaatgaacaccctgagagccgaggacacggccatctattatgtgcgaaggacataggggccggcgcgggagcgaatgacttcgtggggccagggaaccctggtcaccgtctcctcagcctccaccaagggcccatccggtccttccccctggccgccctgcctccaggacnccacctccgagacgcacagccggccctgggctgcctggtcaaacggactacttcctgtcgagcgtctgagcgggctggcaaggcgacatagn

SEQ ID NO: 40922 - DNA, 601 bp, Homo sapiens
  misc_feature: GYAE6OF02H99IN.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgcaaaatgaacacctgagagccgaggacacggcatctattattgtgcgaaggacagtagggccggcgcgggagcgaatgacttcgtggggccgagggaaccctggtcaccgtctcctcacgcctccaccaacgggcccatccggtccttcccccgtggccgcccctgcctccgaggacgccacctccggagaagccaaccgagcccgggcccgtggggcctcggcccgttgggtccgaaaacggtacccttaccgtttccctcggttcgaacggtccgttcgtcggacgggcgggtcctacgggccgaacgggccgactagtagcg

SEQ ID NO: 40923 - DNA, 542 bp, Homo sapiens
  misc_feature: GYAE6OF02GICUR.2.86.H09.1.454.CMB.1.raw
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaaacacgctgtatctgcaaatgaacaccctgagagccgaggacacggccatctattattgtgcgaaggacataggggccgcgcgggagcgaatgacttctggggccagggaaccctggtcaccgtctcctcagcctccaccaagggcccatcggtcttccccctggccgccctgcctccaggacgccaccgtccgagacgccacagccggccctggggcctggccctggtcaaaggacctacgttcctgtcgagcgtctgacgcggctggcaggcgcanagn

SEQ ID NO: 40924 - DNA, 542 bp, Homo sapiens
  misc_feature: GYAE6OF02FX58O.2.86.H09.1.454.CMB.1.raw
  modified_base (542)..(542): a, c, t, g, unknown or other
  misc_feature (542)..(542): n is a, c, g, or t
tcagacgctcgacacacgaccggtgctcgatttagtgctatagacttgggttcgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccggcgcgggagcgaatgacttcgtggggccaggggaaccctggtcaccgtctcctcacgcctccaccaagggcccatcggtcttcccccgtggccgccctcgcctccacggacgccacctccgagacgcacagccggcccgtgggctgcctggtcaggactacttcctgtcgagcgtctgacgcgggctcggcgaggcgcatagn

SEQ ID NO: 40925 - DNA, 575 bp, Homo sapiens
  misc_feature: GYAE6OF02IPDG5.2.86.H09.1.454.CMB.1.raw
  modified_base (363)..(363): a, c, t, g, unknown or other
  misc_feature (363)..(363): n is a, c, g, or t
  modified_base (574)..(574): a, c, t, g, unknown or other
  misc_feature (574)..(574): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggtcggttcaccatgtccagagacaattcgaaaaacacgctgtatctgcaaatgaacaccctgagagccgaggacacggccatctattattgtgcgaaggacagtaggggccggcgcgggagcgaaatgagttcgnggggccagggaaccctggtcaccgtctcctcacgccctccaccgaagggcccatccggtccttcccccgtcggccgccctcgcctccgaggacgccacccgtccgacgacgccaccgacgccgggcccgtcgggcctcgcccgtgggtccgaggtaccttccgtcgtcgagcgtcgtggacggcgggtcgtcggcgacggcgacagtacgnc

SEQ ID NO: 40926 - DNA, 531 bp, Homo sapiens
  misc_feature: GYAE6OF02H2512.2.86.H09.1.454.CMB.1.raw
  modified_base (264)..(264): a, c, t, g, unknown or other
  misc_feature (264)..(264): n is a, c, g, or t
  modified_base (531)..(531): a, c, t, g, unknown or other
  misc_feature (531)..(531): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacncgctgtatctgcaaaatgaacacccctgagagccgaggacacggccatctattattgtgcgaaggacataggggccggcgcgggagcgaatgacttctggggccaggggaaccctggtcaccgtctcctcagcctccaccaaggcccatcgtcttccccctggccgccctgcctccaggagccacctccgagacgcaccagcggccctgggctgcctggcaaggactacttcctgtcgagcgtctgagcggctggcagcgcagtagn

SEQ ID NO: 40927 - DNA, 534 bp, Homo sapiens
  misc_feature: GYAE6OF02F0N00.2.86.H09.1.454.CMB.1.raw
  modified_base (429)..(429): a, c, t, g, unknown or other
  misc_feature (429)..(429): n is a, c, g, or t
  modified_base (534)..(534): a, c, t, g, unknown or other
  misc_feature (534)..(534): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccgcgcgggagcgaatgacttctggggccagggaaccctggtcaccgtctcctcagcctccaccaagggcccatccggtcctccccctggccnccctgcctcccaggagcacctccgagacgcacagccggccctgggcctgcctggtcaaggactacttcctgtcgagcgtctgagcggcgtggcaacggcgcatgn

SEQ ID NO: 40928 - DNA, 570 bp, Homo sapiens
  misc_feature: GYAE6OF02GSPOT.2.86.H09.1.454.CMB.1.raw
  modified_base (438)..(438): a, c, t, g, unknown or other
  misc_feature (438)..(438): n is a, c, g, or t
  modified_base (453)..(453): a, c, t, g, unknown or other
  misc_feature (453)..(453): n is a, c, g, or t
  modified_base (570)..(570): a, c, t, g, unknown or other
  misc_feature (570)..(570): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccgcgcgggagcgaatgacttcgtggggccaggggaaccctggtcaccgtctcctcacgccctccacgaacgggcccagtccggtccttccccctgggccnccctgcctccgaggnccacccgtcgagcgcacacgccggccctgggcctgccgttggtccaaaggtacctacgttcctggtccgacggtccgtcgtggacggtccgggctacgggcaagggccgactagtgn

SEQ ID NO: 40929 - DNA, 592 bp, Homo sapiens
  misc_feature: GYAE6OF02GHWSE.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccggcgcgggagcgaatgacttcgtggggccagggaaccctggtcaccgtctcctcacgcctccaccgaacgggccccaagtccggtccttcccccgtgggcccgccccgtcgcctcccgaggacgccacccgtccgaacgacgccacgacggccggcccgtgggcctcggcccgtggtccaaaggtacctaccttccgtgtccgacgtcgtacgtggacggccgggcgtcgggaccgaagggccgctagtagcg

SEQ ID NO: 40930 - DNA, 566 bp, Homo sapiens
  misc_feature: GYAE6OF02HHCJ5.2.86.H09.1.454.CMB.1.raw
  modified_base (566)..(566): a, c, t, g, unknown or other
  misc_feature (566)..(566): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgcaaatgaacaccctgagagccgaggacacggccatctattattgtgcgaaggacataggggccgcgcgggagcgaatgacttcgtggggcagggaaccctggtcaccgtctcctcacgcctccaccgaacgggcccagtccggtccttccccccgtggccgccctcgcctcccgaggacgccacccgtccgacgacgccaccaggccgggcccctggggcctcggcccgtggtaccaaaggaccttacttccgtgtcgacggcgtctggagcgggctggcaggcgcatgn

SEQ ID NO: 40931 - DNA, 630 bp, Homo sapiens
  misc_feature: GYAE6OF02GQP0I.2.86.H09.1.454.CMB.1.raw
  modified_base (363)..(363): a, c, t, g, unknown or other
  misc_feature (363)..(363): n is a, c, g, or t
  modified_base (626)..(626): a, c, t, g, unknown or other
  misc_feature (626)..(626): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtagggggccgcggcgggagcgaatgacttcgnggggccaggggaaccctggtccaccgtctccctcgacgccctcccgaaccgaacgggcccagtcccggttccctttcccccggtcggcccgtcccgtcgccctacccgagggaccgcccaccccgtccggagacgccacgcggccggcccgtgggcctcggccgttggtaccgaacggtaccttccgttccgtcgtacggacggtccggttactcggggacggtccgggacgttcgggaaccggtaacggggccgtacgtagnggtc

SEQ ID NO: 40932 - DNA, 567 bp, Homo sapiens
  misc_feature: GYAE6OF02JKL51.2.86.H09.1.454.CMB.1.raw
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (516)..(516): a, c, t, g, unknown or other
  misc_feature (516)..(516): n is a, c, g, or t
  modified_base (531)..(531): a, c, t, g, unknown or other
  misc_feature (531)..(531): n is a, c, g, or t
  modified_base (565)..(565): a, c, t, g, unknown or other
  misc_feature (565)..(565): n is a, c, g, or t
tcagacgctcgacacacgaccggtgctcgatttagtgctatagacttgggtttgggggtagggcgttgggtacagcctggggggtcccgtgaggactctcctgtgcagcctctggattcacctttagtaactttgtcatgagtgggtccgcaggctccaggaaaggggctgggagtgggtctcgagctattgatggtggttctgttgtcccacactacgcggcctccgtgaacgggccggttcaccatgtccagagacaattcgaaaaacacgactgtatctgcaaatgaacacctganagccgaggacacggccatctattatgtgcgaagacataggggcgcgcgggnacgaatgacttcgnggggcaagggaccctggcaccgtcgtcctcacgcctccacgacggcccagtcggtccttccccgnggccncccgtgcctcccgaggacgctaacccgtccgagacgccacgaggccgcccgtgggctcgcctggcaaacggacttctcccgngttccgagtccgttnacggtcgcggtgtacggcgacgggtcgacagtancg

SEQ ID NO: 40933 - DNA, 588 bp, Homo sapiens
  misc_feature: GYAE6OF02H3HYG.2.86.H09.1.454.CMB.1.raw
  modified_base (537)..(537): a, c, t, g, unknown or other
  misc_feature (537)..(537): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgagtctcagctattgatggtggttctgttgtccacactacgcggcctccgtgaagggccggttcaccatgtccagagacaattcgaaaaacacgctgtatctgcaaaatgaacaccctgagagccgaggacacggccatctattatgtgcgaaggacataggggccgcgcggggagcgaatgacttcgtggggccaggggaaccctggtacaccgtctcctcagcctccaccgaaggcccactcggtctccccctggccgccctcgctccacggcgcacctccgacgagccacgacgccggccctagggcctacgccgtggtacaacgggtacctaccgttcctcggttccggagtcccggttacncggtacggccggggtccgtacggggaccgtaagggccggtccgaagtacgg

SEQ ID NO: 40934 - DNA, 544 bp, Homo sapiens
  misc_feature: GYAE6OF02HCLXN.2.86.H09.1.454.CMB.1.raw
  modified_base (544)..(544): a, c, t, g, unknown or other
  misc_feature (544)..(544): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccggcgcgggagcgaatgacttcgtggggccaggggaaccctggtcaccgtctcctcagccctccaccgaaggggcccagtcggtccttcccccgtggcccgccctgcctcccgaggacgcaccctccgagacgcacagccggcccgtgggctgcctgtcaaggactactcctgtcgagcgtctgacgcggctggcaggcgcagagn

SEQ ID NO: 40935 - DNA, 658 bp, Homo sapiens
  misc_feature: GYAE6OF02JMPCJ.2.86.H09.1.454.CMB.1.raw
  modified_base (291)..(297): a, c, t, g, unknown or other
  misc_feature (291)..(297): n is a, c, g, or t
tcagacgctcgacacacgaccggtgctcgatttagtgctatagacttgggtttggggaggcttggtacagccgtggggtccctgagactctcctgtgcagcctctggattcacctttagttaactttgtcatgaggtggtccgccgaggctccgaggaaagggcgtggaggtggtcgtcgagctagttgtagtggtggttcgttgttcgtcccgacacgtacgcggccgtccgtggaacggccggttcgaccgacgtgtaccgagacgacaagtacgaaaacacgacgtannnnnnngtacgttacgtacgtaacgtaaacgtaacgaaaccgtaacccgtacgaacgacggaccggaacggaaccgaccggaccgacgtactacttagttagtagtacgaagacgaagtacgggacggacggacggacggacgaacgtacgtacgtacgtacggtacgacggaccgtacgtaccgtaccgtaccgtaccgtacgacgtaccgtaccgaccgacggaccgacgtaccgtccgttcccgtccgtccgtcccgtccgccgtaccgacgacgaccgaccgaccgacgacgacgacgacgcgccgcgcgcgcgtcgtacgacgtacgtacccccgtcgtacgtcgacgcgtcgtacgcgcgg

SEQ ID NO: 40936 - DNA, 578 bp, Homo sapiens
  misc_feature: GYAE6OF02F1H6R.2.86.H09.1.454.CMB.1.raw
  modified_base (397)..(397): a, c, t, g, unknown or other
  misc_feature (397)..(397): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgcaaatgaacaccctgagagccgaggacacggccatctattattgtgcgaaggacagtacggggccggcgcgggagcgaatgacttcgtggggccagggaaccctggtccaccgtctcctcngcctccaaccgacgggcccatccggtccttcccccgtggcccgccctcgcctcccaggacgccacccgtccgagcgccacacggccggcccgtgggcctcgccgttgtaccaaggccttaccgttcctggtccgaggtccgtctaggacggcgggcctgggaccgaaggccgacagtagcg

SEQ ID NO: 40937 - DNA, 726 bp, Homo sapiens
  misc_feature: GYAE6OF02JZDXC.2.86.H09.1.454.CMB.1.raw
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
tcagacgctcgacacacgaccggtgctcgatttagtgctatagacttgggtttgggggtaggtcgttgggtacgtagcctggggggtcccgtgaggactctcctgtgcagcctctggattcacctttagtaactttgtcatgaggtgggtccgccgaggctccgaggaaaggggcgtagggagtgggtctcgaggctattggatggtggttctggttgtcccatacctacgcggcctccggtgaacgggccggttcaccatcgccagagacaattaccgaaaaacncgcctagtaactctgtacaaaatcggaaaccacccgtagaacgngaccggaggaccgaccggacctagtcctaatttactagtggacgtaagggacagtacgggggccggtcggacggggagccggaaatcggacttcggacgggggtccaagggggaaccccgtggtacccgaaccggttcctacctcggaacgcccgtaccgaaccgtaacggggcccctagtacccgggttccccttttcccccgaggggcccctcccgtaacggtcccgttccgaacgggacgtccctacccggaccggacgtaacgccgtaacgcggtcggccccgttggggccctcggtaccgtcgggttacaacgggtacttacctccggttcgtacgcgtaccggtctcggacggccggggtctacgggtaccgaaccggtgacgtcgagta

SEQ ID NO: 40938 - DNA, 598 bp, Homo sapiens
  misc_feature: GYAE6OF02GXL5B.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgacaaatgaacaccctgagagccgaggacacggccatctattattgtgcgaaggacagtaggggccggcgcgggagcgaatgacttcgtggggccagggaaccctggtcaccggtctcctcacgccctccaccaacgggcccagtccggtccttcccccgtggccgccctgcctccgaggacgcacccgtcgacgacgcaccgaggccggacccgtgggcctcggtcccgtgggtaccgaaacggaccttaacgttcccgttcggtccggacgtccggtctggacggcgggtaccgtcgggaccgaagggccgacgtagtagcg

SEQ ID NO: 40939 - DNA, 562 bp, Homo sapiens
  misc_feature: GYAE6OF02JL4YT.2.86.H09.1.454.CMB.1.raw
  modified_base (158)..(158): a, c, t, g, unknown or other
  misc_feature (158)..(158): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
tcagacgctcgacacacgaccggtgctcgatttagtgctatagacttgggtttgggggtagggcgttggtacagcctggggggtcccgtgaggactctcctgtgcagcctctggattcacctttagtaactttgtcatgagtgggtcgccaggctccnggaaagggctggagtgggtctcagctattgatggtggttctgttgtcccacactacgcggcctccgtgaagggccgttcaccatgtccagagacaattcgaaaaacacgctagtatctgcaaatgaacaccctgagagccgaggacacggcccatctattattgtgcgaaggcatggggccgngcggagcgatgacttngggcagggacctggcacgtctcgtcagcctccaccaagggcccatccggtccttcccccgtggcccgcccgtgcctcccaggcgccacccgtccgacgacgccacgaggccggtccctggggcctggcccgttggtccgaaaggcctaccgttcctgtcgaggtccgtgtacggagcggcgtcggccgaaggccggcgagtgacg

SEQ ID NO: 40940 - DNA, 668 bp, Homo sapiens
  misc_feature: GYAE6OF02F2D9Z.2.86.H09.1.454.CMB.1.raw
  modified_base (347)..(347): a, c, t, g, unknown or other
  misc_feature (347)..(347): n is a, c, g, or t
tcagacgctcgacacacgaccggtgctcgatttagtgctatagacttgggtttgggggaggcttggtacagcctggggggtccctgagactctcctgtgcagcctctggattcacctttagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgacaaatgaacagtctgagagccgaggacacggctgtgtattactgtgcaagagatagcagcagctggtaccnccgactacgtggggaccaaggggaaccctgggtccacccgtcctccacgaccgtccctacccgaaccggaaccggccctacgttcccggttccccttccccggcgggccctcccgtgtcccgtaccggaggaccgaccccgtacccgtaccgggaacggaccgaccgtaaccggaccggtccccggggtcccggttcggggtacctcccgggtccggttacgggtaaccgaacgggttaaccctttaccgttccggtacggttaccggacggttcccggttcggtacgggaccggggtccgggtcggtacgggtaaccggg

SEQ ID NO: 40941 - DNA, 538 bp, Homo sapiens
  misc_feature: GYAE6OF02FKUNO.2.86.H09.1.454.CMB.1.raw
  modified_base (446)..(446): a, c, t, g, unknown or other
  misc_feature (446)..(446): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccggcgcgggagcgaatgacttctggggccaggggaaccctggtcaccgtctcctcagcctccaccaacgggcccatcggtcttccccctggccgccctgctccaggacnccacctccgagagcacgacgccggccctgggctggcctgggtcaaaggctacttccctgtcgagcgtctgagcggctggcaaggcncgatgn

SEQ ID NO: 40942 - DNA, 617 bp, Homo sapiens
  misc_feature: GYAE6OF02HYEGG.2.86.H09.1.454.CMB.1.raw
  modified_base (350)..(350): a, c, t, g, unknown or other
  misc_feature (350)..(350): n is a, c, g, or t
  modified_base (445)..(445): a, c, t, g, unknown or other
  misc_feature (445)..(445): n is a, c, g, or t
  modified_base (616)..(616): a, c, t, g, unknown or other
  misc_feature (616)..(616): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaaattacgaaaaaacacgctagtaatctgacaaaatgaaacaccctagagagccgaggacacggccatctattatgtgcgaaggcaagtaggggccggngcgggagcgaaatgacttcgtgggccagggacctggtacaccgtctcctacacgcctaccgaaccgaagggcccagttccggtcccttcccccgngggcctcccgtgcctccgaaggcgacctacccgtcgagacgcaccgaggcccggcccgtgggcctacggcccgttaggaccgaaaggtaccttacccgttccgcggttaccggaggtccgtcgtcggacggaccgggcgttacgggaaccgtaggaccggactacgtaggng

SEQ ID NO: 40943 - DNA, 604 bp, Homo sapiens
  misc_feature: GYAE6OF02GOFL3.2.86.H09.1.454.CMB.1.raw
  modified_base (264)..(264): a, c, t, g, unknown or other
  misc_feature (264)..(264): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacncgctgtatctgcaaatgaacaccctgagagccgaggacacggccatctattattgtgcgaaggacagtaggggccgcgcgggagcgaatgacttcgtggggccagggaaccctggtcaccgtctcctcacgccctccaccgaacgggccccagtccggttccttcccccgtggccgccctcgcctcccgaggacgccacctccgagacgcaccgacgccggcccgtgggcctcggcccgttcgggtccgaaacggtaccttaaccgttcccgtacgtccggacggtccggttcgtcggacgggtcgggaccgtcgggacgtaacgggcgacctagtagcg

SEQ ID NO: 40944 - DNA, 641 bp, Homo sapiens
  misc_feature: GYAE6OF02JZV2H.2.86.H09.1.454.CMB.1.raw
  modified_base (641)..(641): a, c, t, g, unknown or other
  misc_feature (641)..(641): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgacaaatgaacaccctgagagccgaggacacggccatctattattgtgcgaaggacagtacggggccggcggcgggagcgaatgacttcgcgggggccaggggaaccctggtaccaccgtctcctcacgccctccgaccgaacgggcccacgtccggtcccttcccccgtgggcccgtccctcgccctaccgacggacgccaccccgtcgacgacgccaccgacggcccgggtccctcggggcctcggtacccgtggtaacccgaacgggtacccttaccgttcccgtagggtccgtacggtccgttaccgtcgggtaccggccggggtacctcggggtaccgaacgggtccgaccgtaagtcggn

SEQ ID NO: 40945 - DNA, 637 bp, Homo sapiens
  misc_feature: GYAE6OF02HQMOT.2.86.H09.1.454.CMB.1.raw
  modified_base (269)..(269): a, c, t, g, unknown or other
  misc_feature (269)..(269): n is a, c, g, or t
  modified_base (350)..(350): a, c, t, g, unknown or other
  misc_feature (350)..(350): n is a, c, g, or t
  modified_base (389)..(389): a, c, t, g, unknown or other
  misc_feature (389)..(389): n is a, c, g, or t
  modified_base (431)..(431): a, c, t, g, unknown or other
  misc_feature (431)..(431): n is a, c, g, or t
tcagacgctcgacacacgaccggtgctcgatttagtgctatagacttggggtttgggggaggcttggtacagcctggggggtccctgagactctcctgtgcagcctctggattcacctttagtaacttgtcatgaggtgggtccgccaggctccaggtaaacgggctggagtgggttactcagctattgatggtgttctgttgtcccacactacgcggcctccgtgaaggccggttcaccagtcgtccaagacgacaattcgaaaaacncgctgtatctgcaaatgaacaccctgagagccgaggacacggccatctattatggtgcgaaggcagtagggcgcgcgggancgaatgacttcgtggggccagggaaccctggtcaccgtntccctcagccctcaccaacggcccagtccggtccttccccgnggccgccctcgtcctccgaggacgcctaccgtcggacgacgccaaccgtacggccgggcccgtacgggccttcggtacccgttacgggttaccgtaaacggtaaccttaccgttacccgttcggttccggtaacggtccggttcgtacgggtaacggccggggtacgttacgggaccgaaacgggtccggtaccgagttacggacg

SEQ ID NO: 40946 - DNA, 574 bp, Homo sapiens
  misc_feature: GYAE6OF02HBX5X.2.86.H09.1.454.CMB.1.raw
  modified_base (320)..(320): a, c, t, g, unknown or other
  misc_feature (320)..(320): n is a, c, g, or t
  modified_base (462)..(462): a, c, t, g, unknown or other
  misc_feature (462)..(462): n is a, c, g, or t
  modified_base (481)..(481): a, c, t, g, unknown or other
  misc_feature (481)..(481): n is a, c, g, or t
  modified_base (543)..(543): a, c, t, g, unknown or other
  misc_feature (543)..(543): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgngcgaaggacagtaggggccggcgcgggagcgaatgacttcgtggggccagggaaccctggtcaccggtctcctcacgcctccaccgaacgggcccagtccggtccttcccccgtgggcccgccctcggcctcccgagggtcnccaccgtcgagacgcacgnggccggcccgtgggcctgccgttcggcaacggaccttacgttcccgtggtccgagccggttntggacgtcgggctgggcaaggcgactagtgc

SEQ ID NO: 40947 - DNA, 637 bp, Homo sapiens
  misc_feature: GYAE6OF02GR0NO.2.86.H09.1.454.CMB.1.raw
  modified_base (438)..(438): a, c, t, g, unknown or other
  misc_feature (438)..(438): n is a, c, g, or t
  modified_base (637)..(637): a, c, t, g, unknown or other
  misc_feature (637)..(637): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgacaaatgaacaccctgagagccgaggacacggccatctattattgtgcgaaggacagtacggggccgcggcgggagcgaatgacttcgtggggccagggaaccctggtacaccgtctcctcacgccctccaccgaacgggcccagtccggtccttcccccgnggccgccctgccctaccgacggcgcctaccgtccgacgtcgaccgacgaccgggcccggtacccggcgggtccgtcggtcccgttacgggtaccgaaacggtaccctttaccgttcccgttcggtaccggtacggtccggttaccggtacggaccggtccgggtacgtaccgggacggaaccgggcgtacgagtacggn

SEQ ID NO: 40948 - DNA, 661 bp, Homo sapiens
  misc_feature: GYAE6OF02IJSDM.2.86.H09.1.454.CMB.1.raw
  modified_base (396)..(396): a, c, t, g, unknown or other
  misc_feature (396)..(396): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaaaccaccctgagagccgaggacacggccatctattattgtgcgaagacagtaggggccggcgcgggagcgaatgacttcgtggggccacggggaccctggtcaccgtctccctnacgccctaccgacccgaacgggccccaagttcccgggtccctttccccccgtcgggcccgtcccgtcgcccttcccgacggacgtaccacccgttcccggaaggaccgaccgaccgtaccggcccggtaccccgtcggggcctccggcccgttacgggtccgaaacgggtaaccgttaacctttcccgtcgtccggtacggtccggttaccgtggtaccggccggggtaccgttcgggaccgaaacggggccgacgtacgtagcg

SEQ ID NO: 40949 - DNA, 541 bp, Homo sapiens
  misc_feature: GYAE6OF02JFWJK.2.86.H09.1.454.CMB.1.raw
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
  modified_base (516)..(516): a, c, t, g, unknown or other
  misc_feature (516)..(516): n is a, c, g, or t
  modified_base (541)..(541): a, c, t, g, unknown or other
  misc_feature (541)..(541): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccgttcaccatgtccagagacaattcgaaaaacacgctgtatctgcaaatgaacacccctgagagccgaggacacggccatctattatgtgcgaaggacataggggccggcgcgggagcgaatgacttcgtgggggccagggaaccctggtcaccggtctcctcacgccctccaccgaagggcccatccggtcttccccctggccnccctgctccaggngccacctccgagacgcacgagccggcccgtgggctcgcctggtcaaggactcttcctgtcgagcgtcngacgcggctggcgaggcgcagtagn

SEQ ID NO: 40950 - DNA, 614 bp, Homo sapiens
  misc_feature: GYAE6OF02ID70R.2.86.H09.1.454.CMB.1.raw
  modified_base (437)..(437): a, c, t, g, unknown or other
  misc_feature (437)..(437): n is a, c, g, or t
  modified_base (460)..(460): a, c, t, g, unknown or other
  misc_feature (460)..(460): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaaatgaacaccctgagagccgaggacacggccatctattattgtgcgaaggcagtaggggccgcgcgggagcgaatgacttcgtggggccagggaaccctggtcaccgtctccctcacgcctaccacccgaacgggcccagttccggtcctttcccccgnggccgcccctgcctccgaggacncacctccgagacgcacagccggccctgggccttcggcccgttgggtaccgaaacgggtacccttaaccgtttcccgtaggtacccggacggtccggttacgtcgggacgggtcccggggtctcggggaccgaaacgggcccgacgtagttagcg

SEQ ID NO: 40951 - DNA, 557 bp, Homo sapiens
  misc_feature: GYAE6OF02I3R7X.2.86.H09.1.454.CMB.1.raw
  modified_base (267)..(267): a, c, t, g, unknown or other
  misc_feature (267)..(267): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (467)..(467): a, c, t, g, unknown or other
  misc_feature (467)..(467): n is a, c, g, or t
  modified_base (527)..(527): a, c, t, g, unknown or other
  misc_feature (527)..(527): n is a, c, g, or t
  modified_base (539)..(539): a, c, t, g, unknown or other
  misc_feature (539)..(539): n is a, c, g, or t
  modified_base (551)..(551): a, c, t, g, unknown or other
  misc_feature (551)..(551): n is a, c, g, or t
  modified_base (557)..(557): a, c, t, g, unknown or other
  misc_feature (557)..(557): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaaaggggctggagtgggtctcagctattgatggtggttctgttgtcccacactacgcggcctccgtgaagggccggttcaccatgtccagagacaattacgaaaaaacncgctgtatctgcaaatgaacaccctgagagccgaggacacggccatctattattgtgcgaaggacagtaggggccggngcgggagcgaatgacttcgnggggccagggaaccctggtcaccgtctccncncgcctccacaacgggcccagtcggtccttcccccgtggccctccctgcctccgagacgcaccctcgagcncacgcgccggcccgtgggctcggcgtggcaaaggtctacttccgtgtccgaggccgttgnggacgcgggcgnggcaacgggccncagtgn

SEQ ID NO: 40952 - DNA, 611 bp, Homo sapiens
  misc_feature: GYAE6OF02I7KBU.2.86.H09.1.454.CMB.1.raw
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccggcgcgggagcgaatgacttcgtggggccagggaacccgtggtcaccgtctcctcagccctccaccgacgggcccagtccggtccttcccccgnggccncccgtcgcctccgaggcgcacccgtccgacgacgcacgacgccggcccgtgggcctcggtcccgttcgggtaccgaaacggtaccttaccgtttccgtcgtccggaacggtccggttcgttcgggaacggtccggggacgttcgggaccgtaacgggccgactacggtagacg

SEQ ID NO: 40953 - DNA, 536 bp, Homo sapiens
  misc_feature: GYAE6OF02I0NNK.2.86.H09.1.454.CMB.1.raw
  modified_base (350)..(350): a, c, t, g, unknown or other
  misc_feature (350)..(350): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccaatctattattgtgcgaaggacagtaggggccggcgcgggancgaatgacttctggggccagggaaccctgggtcaccggtctcctcagcctccaccgaagggcccatcggtcttcccccgtggccgcctgcctccaggacgcacctccgagcgcacagcgcctgggctgcctgtcgaaacgactcttcctgtcgagcgtctggacgcggngtcggcaggcgcactgn

SEQ ID NO: 40954 - DNA, 619 bp, Homo sapiens
  misc_feature: GYAE6OF02JQQ4R.2.86.H09.1.454.CMB.1.raw
  modified_base (256)..(256): a, c, t, g, unknown or other
  misc_feature (256)..(256): n is a, c, g, or t
  modified_base (518)..(518): a, c, t, g, unknown or other
  misc_feature (518)..(518): n is a, c, g, or t
  modified_base (575)..(575): a, c, t, g, unknown or other
  misc_feature (575)..(575): n is a, c, g, or t
tcagacgctcgacacacgaccggtgctcgatttagtgctatagacttgggtttgggggaggcttggtacagcctgggggtccctgagactctcctgtgcagcctctggattcacctttagtaactttgtcatgaggtggtccgccaggctccaggaaagggctggatgggtctcagctattgatggtggttctgttgtccacactacgcggcctccgtgaagggccgttcacatgccagagacaattcgaaaaacncgctgtatctgacaaatgaacaccctgagacgccgaggacacggccatcgtattagtgtgcggtaacgcagtacgggccgacggcggagcgaaatcggaacgttcgtcggggcctaaggggaaccctggtaccaccgttctccgtcgacgcccgtccaaccgtaacgggcccctaggttcccgtccttccccgtggccctcccgtcgcctaccgacggcgacccaccgttaccggaagccgtcgaaccgacggcggtcccgngggtctacgcccgttaggtacgaacggtcgtaccttccgtgtacgcggtcgttacgnggtacggcggaacggttcggcgtaaccggcgacgtaggtacgcg

SEQ ID NO: 40955 - DNA, 551 bp, Homo sapiens
  misc_feature: GYAE6OF02IJRRG.2.86.H09.1.454.CMB.1.raw
  modified_base (439)..(439): a, c, t, g, unknown or other
  misc_feature (439)..(439): n is a, c, g, or t
  modified_base (481)..(481): a, c, t, g, unknown or other
  misc_feature (481)..(481): n is a, c, g, or t
  modified_base (515)..(515): a, c, t, g, unknown or other
  misc_feature (515)..(515): n is a, c, g, or t
  modified_base (526)..(526): a, c, t, g, unknown or other
  misc_feature (526)..(526): n is a, c, g, or t
  modified_base (545)..(545): a, c, t, g, unknown or other
  misc_feature (545)..(545): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacacccctgagagccgaggacacggccatctattattgtgcgaaggacagtaggggcccgcggcggggagcgaatgacttcgtggggccagggaaccctggtcaccggtctcctcacgcctacccaccgaagggccccagtccggtccttcccccgnggcccgccctgcctcccgaggacgccaccctccgagcgcacncgccggcctgggctcgcctggcaggactacttcngtcgagcgtcnggacgcggctggcaaggcncatagc

SEQ ID NO: 40956 - DNA, 733 bp, Homo sapiens
  misc_feature: GYAE6OF02IIICU.2.86.H09.1.454.CMB.1.raw
  modified_base (288)..(288): a, c, t, g, unknown or other
  misc_feature (288)..(288): n is a, c, g, or t
tcagacgctcgacacacgaccggtgctcgatttagtgctatagacttgggtttgggggaggcttggtacagcctggggggtccctgagactctcctgtgcagcctctggattcaccttcagtagctactggatgcactgggtccgccaagctccagggaaggggctggtgtgggtctcacgtattaatagtgatgggagtagcacaagctacggcggactccgtagaagggccattcaccatctccagagacaacgcaaagacacgctgtatctgacaaaatgaaacngtctagagagaccgaggactacggctgtagtattactgtagacaaaggatatagcagcaagcgtaggtaccgaccgaacgtaagtcgggggacccaaggggaaacccctggtaccacccgttactcctacgacgcccctaccgaaccgaacgggccctaacgttcccggtcccttacccccgtcgggacccgtccccgtcgtaccgttacccgaacgggaccgtacccgtaaccccgttaccgaaacgggtaaccgacccgaaccggaccgggaccccggggtccccggttaccgggggtcccttaccgggtaccccggtttacgggtaacccggtaaaacgggttaacccctttaacccgtttccccggtttacggttacccgggtaacggtccccggtacgtttaccgggaaccgggttcccgggggtaacccgtaccggggg

SEQ ID NO: 40957 - DNA, 545 bp, Homo sapiens
  misc_feature: GYAE6OF02GOL05.2.86.H09.1.454.CMB.1.raw
  modified_base (264)..(264): a, c, t, g, unknown or other
  misc_feature (264)..(264): n is a, c, g, or t
  modified_base (544)..(544): a, c, t, g, unknown or other
  misc_feature (544)..(544): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacncgctgtatctgcaaatgaacacccctgagagccgaggacacggccatctattattgtgcgaaggacataggggccggcgcgggagcgaatgacttctggggccagggaaccctggtcaccgtctcctcagcctccaccaagggcccagtcggtccttccccctggccgccctcgcctcccaggacgccaccctcgagacgcacagccggccctgggcctgcctggtccaaggtactaccttcctgtcgagcgtctgagcggctcggcgaggcgctagtgng

SEQ ID NO: 40958 - DNA, 562 bp, Homo sapiens
  misc_feature: GYAE6OF02F42W9.2.86.H09.1.454.CMB.1.raw
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgacaaatgaacaccctgagagccgaggacacggccatctattatgtgcgaaggacagtaggggccgcggcgggagcgaagtgacttcgcggggcacggggaaccctggtacaccggtctcctcgagccctccaaccgagggccccagtccggtccttcccccnggccgtccctgcctccgnggacgccacctaccgagacgcacgacgccggccgtcggctcgccgtcggtcaaggccttactcctgtcgacgtcgtcgtgcgcggcgtcggacgaggcncgtangc

SEQ ID NO: 40959 - DNA, 689 bp, Homo sapiens
  misc_feature: GYAE6OF02JOGK4.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttacgtaacttttgtcatgaaggtgggtccgccaggctccaggaaaggggcgtggagtgggtctcagctattgataggtggttctgttgtcccacacgtacgcggcctcgtaggtaagggccggttactaccgatacggtaccgagaagaactaattaacgaaaacacgcttagtactctacgacaaacgtacgaaccaccgagacgacgaccggacggaccgaccgaccactactacttacttggtcggacggaacggacgacggtacggggccgggcgggcgggacggacggaacgtacgtacgttacggtcgggaccggacgggtaaccgtacggtaccgtaccgtccgtccgtcgacgaccgaccgaccgaaccggacccgtacgtaccgttcccgttccccgtccggccgcccgtccgtccgtaccgacggacgaccgaccgaccgacgacgaccgacgaccggccggccggtcggccgtcgtccgtcggtacgtaacgtaccgtaccgttccgtcgtcggtcgtcgtcgtcggtacggcggcggcggacggacggacgacgagacg

SEQ ID NO: 40960 - DNA, 610 bp, Homo sapiens
  misc_feature: GYAE6OF02HJTTG.2.86.H09.1.454.CMB.1.raw
  modified_base (610)..(610): a, c, t, g, unknown or other
  misc_feature (610)..(610): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagaacaattcgaaaaaacacgctgtatctgacaaaatgaaacacctgagagccgaggacacggccatctattattgtgcgaagacagtacggggccggcgcgggagcgaatgacttcgtggggccgaagggaaccctggtccaccgtctcccgtcacgccctccaaccgaacggcccagtccggtccttcccccgcggccgccgtcgcctccgaggacgccaccgtaccgagacgccaacgacggccggcccgtcgggcctcgtcccgtcggtaccgaaaggtacctaaccgttcctacgtccggaggtccgtacgtcggtaacggccgggtccgtacgggacgaacggcgtacgagtaacgn

SEQ ID NO: 40961 - DNA, 576 bp, Homo sapiens
  misc_feature: GYAE6OF02HB2R8.2.86.H09.1.454.CMB.1.raw
  modified_base (322)..(322): a, c, t, g, unknown or other
  misc_feature (322)..(322): n is a, c, g, or t
tcagacgctcgacacacgaccggtgctcgatttagtgctatagacttgggtttgggggaggcttggtacagcctgggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaaatgaacaccctgagagccgaggacacggccatctattattgngcgaaggacataggggccggcggcgggagcgaaatgacttcgtggggccagggaaccctggtcaccgtctcctcagccctccaccaagggcccagtcggtcttccccctggccgccctcgcctccaggcgcaccctccgacgagccacacgccggcccgtgggcctcgcccgttgggtaccaaaggtacctaccttccgtcggtcgacggtcgtcctggacggccgggcgtcgggcgaacgggcgcgacgtagc

SEQ ID NO: 40962 - DNA, 580 bp, Homo sapiens
  misc_feature: GYAE6OF02GGMKQ.2.86.H09.1.454.CMB.1.raw
  modified_base (362)..(362): a, c, t, g, unknown or other
  misc_feature (362)..(362): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgacaaatgaacaccctgagagccgaggacacggccatctattattgtgcgaaggacagtaggggccggcgcgggagcgaatgacttgnggggccagggaaccctggtcaccgtctcctcagcctccaccaacgggcccagtccgtctccccgtggccgccctcgcctcccgaggacgccaccgtccgacgacgccacgacgccggcccgtgggcctcggcccgttcggtcgaacggaccttaccgttcccgtgtccgaggtccgtcgtggacggtcgggcgtcggtcgaacgggtcgacagtagcg

SEQ ID NO: 40963 - DNA, 587 bp, Homo sapiens
  misc_feature: GYAE6OF02IYUEM.2.86.H09.1.454.CMB.1.raw
  modified_base (452)..(452): a, c, t, g, unknown or other
  misc_feature (452)..(452): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgcaaatgaacaccctgagagccgaggacacggccatctattattgtgcgaaggacagtaggggccggcgcgggagcgaatgacttcgtggggccaggaaccctggtcaccgtctcctcacgcctccaccgaacgggcccagtcggtcccttcccctggccgcctgcctccgaggacnccacccgtccgagacgccacgacgccggccctcgggcctacggccgtcgggtaccaaacggtaccttaccgttccgtcgtcgacggtccggtctcggacggccggtcgcgggaccgaagggccgaccgtatgacg

SEQ ID NO: 40964 - DNA, 582 bp, Homo sapiens
  misc_feature: GYAE6OF02FG7O6.2.86.H09.1.454.CMB.1.raw
  modified_base (475)..(475): a, c, t, g, unknown or other
  misc_feature (475)..(475): n is a, c, g, or t
  modified_base (582)..(582): a, c, t, g, unknown or other
  misc_feature (582)..(582): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgacaaatgaacacctgagagccgaggacacggccatctattattgtgcgaaggacagtaggggccggcgcgggagcgaatgacttcgtgggggccaggggaaccctggtccaccgtctcctcacgccctccaccgaacgggcccatccggtccttcccccgtcggccgcccgtcgcctcccgaggacgccacctccgagcncacaggccggcccgtgggcctgccgttggcaacggaccttacgttcctcgtcgaggtccggtctaggacggtccgggactcggggacgaacgggccgacgtagtagn

SEQ ID NO: 40965 - DNA, 641 bp, Homo sapiens
  misc_feature: GYAE6OF02HP1RF.2.86.H09.1.454.CMB.1.raw
  modified_base (640)..(640): a, c, t, g, unknown or other
  misc_feature (640)..(640): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgacgaaggacagtaggggccggcgcgggagcgaaagtgacgtttcgcggggcaggggaaccctggtcaccgtctccctcgacgccctaccaccgaacgggccctacgtccggtccttcccccggtgggcccgcccttcgcccgtcccgaacgggacgccgtaaccgtccggacgacgtccaaccgacggtaccgggtccccgtcggggccttacggcccgttagggtaccgaaacggtccttaccgtttccgtcggtaccgtacggtccggtccttagggacggtccgggcgtcgggaccgaagggtccgctaggtacgng

SEQ ID NO: 40966 - DNA, 620 bp, Homo sapiens
  misc_feature: GYAE6OF02JWHU2.2.86.H09.1.454.CMB.1.raw
  modified_base (238)..(238): a, c, t, g, unknown or other
  misc_feature (238)..(238): n is a, c, g, or t
  modified_base (306)..(306): a, c, t, g, unknown or other
  misc_feature (306)..(306): n is a, c, g, or t
  modified_base (455)..(455): a, c, t, g, unknown or other
  misc_feature (455)..(455): n is a, c, g, or t
  modified_base (619)..(619): a, c, t, g, unknown or other
  misc_feature (619)..(619): n is a, c, g, or t
tcagacgctcgacacacgaccggtgctcgatttagtgctatagacttgggtttgggggaggcttggtacagcctggggggtccctgagactctcctgtgcagcctctggattcacctttagtaacttttgtcatgaggtgggtccgccaggctccaggaaaggggctggagtgggtctcagctattgatggtggttctgttgtcccacactacgcggcctccggtgaagggccggttnaccatcgtccagagacaattacgaaaaacacgactgtatctgcaaatgaacacctgagagccgagacncggccatctattattgtgacgaaaggcaagtacgggggccgcggcgggagccgaagtgacttcggtcggggccaagggaccctggtccaccgtctccctcgacgtccctaccaccggaacggccctacgtcccggtcccgttcccccgnggcccgtcccgtcgcctcccgaggccgccgaccctcgacgacgaccaccgacggcccgacccggcgggtccgcggtccgtacggtaccggaaagtccgttaccgttccgtcgtcggcggtcttcggtcgaccggtggcgtcggacggaccggcgacgtcgacgng

SEQ ID NO: 40967 - DNA, 548 bp, Homo sapiens
  misc_feature: GYAE6OF02IVBTY.2.86.H09.1.454.CMB.1.raw
  modified_base (264)..(264): a, c, t, g, unknown or other
  misc_feature (264)..(264): n is a, c, g, or t
  modified_base (345)..(345): a, c, t, g, unknown or other
  misc_feature (345)..(345): n is a, c, g, or t
  modified_base (533)..(533): a, c, t, g, unknown or other
  misc_feature (533)..(533): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatctccagagacaacgccaagaacncgctgtatctgcaaatgaacagtctgagagccgaggacacggctgtgtattactgtgcaagagatagcagcagctggtacnccgactcgcggggccaagggaccctggtaccaccgtctcctcagccctccaccgaacggcccagtcggtccttccccgtggccgccctgcctccgtaggcgcacccgtcgagcgcacgacgccggccgtcggctcggcctgtaccaacgtcttacttcgtcgtcgacgtccgtcgtgtacggccgggntcggcgtacggcacg

SEQ ID NO: 40968 - DNA, 628 bp, Homo sapiens
  misc_feature: GYAE6OF02IPEOR.2.86.H09.1.454.CMB.1.raw
  modified_base (374)..(374): a, c, t, g, unknown or other
  misc_feature (374)..(374): n is a, c, g, or t
  modified_base (463)..(463): a, c, t, g, unknown or other
  misc_feature (463)..(463): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagaccaattacgaaaaaacacgctgtatctgacaaatcgaaaccaccctgagacgccgagacacggccatctattattgtgacgaaggacagtacggggccggcgcgggagccgaatggacttcggnggggccacgggaaccctggtcaccgtctcctcgacgccctaccgaaccgaacgggccctacgtccggtcccttcccccgtcgggtcccncccgtcgcctacccgacggacgtaccacccgtcccgaagacgaccaacgacggccgggtcccgtgggcctcggccgttacggtaccaaacggtaccttaccgttccgtcgtcgacggtccgtcgtggacggtcgggactcgggacgaacggccgacgtacgtagc

SEQ ID NO: 40969 - DNA, 669 bp, Homo sapiens
  misc_feature: GYAE6OF02JXJMM.2.86.H09.1.454.CMB.1.raw
  modified_base (210)..(210): a, c, t, g, unknown or other
  misc_feature (210)..(210): n is a, c, g, or t
  modified_base (268)..(268): a, c, t, g, unknown or other
  misc_feature (268)..(268): n is a, c, g, or t
tcagacgctcgacacacgaccggtgctcgatttagtgctatagacttgggtttgggggaggcttggtacagcctggggggtcccgtgaggactctcctgtgcagcctctggattcacctttagtaactttgttcatgaggtgggtccgccaggctccaggaaaggggctggagtgggtctcagctattgatggtggttctgttgtcccanactacgcggcctccgtgaagggccggttcaccatcgtccagagacaattacgaaaacncgctgtatctgacaatgaacaccctgagagccgaggacacggccagtctattatgtgcgaaggacagtaggggccgcggcgggagcgaagtgacttgtggggacccagggaacccgtggccaccgttctcctacacggccctcccgacgaacgggacccacgtccggttaccttccccccgtgggtcccgtaccccgtcggtccctacccggtacgggcgacccgtacccgttcccgacggtacgaccgaccgaaccggccgggacccgtcgggtacccgtggccccgttgggtaccggaaacggttaccgtaccgttacccgtggtaccggacgtccggttcgtacggacggtcccgggtagtccgggaccggtaacggcccggacgtaccgtagtacgg

SEQ ID NO: 40970 - DNA, 633 bp, Homo sapiens
  misc_feature: GYAE6OF02JI25K.2.86.H09.1.454.CMB.1.raw
  modified_base (205)..(205): a, c, t, g, unknown or other
  misc_feature (205)..(205): n is a, c, g, or t
  modified_base (351)..(351): a, c, t, g, unknown or other
  misc_feature (351)..(351): n is a, c, g, or t
  modified_base (416)..(416): a, c, t, g, unknown or other
  misc_feature (416)..(416): n is a, c, g, or t
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
  modified_base (629)..(629): a, c, t, g, unknown or other
  misc_feature (629)..(629): n is a, c, g, or t
tcagacgctcgacacacgaccggtgctcgatttagtgctatagacttgggtttgggggtaggcttggtacagcctggggggtccctgagactctcctgtgcagcctctggattcacctttagtaactttgtcatgaggtggtccgccaggctccaggaaagggctggagtgggtctcagctattgatggtggttctgttgtccanactacgcgcctccgtgaacgggccgttacaccgatcgtccagtagacaattcgaaaaacacgctgtatctgaccaaatcgaaacacctgacgagccgaaggaccacggccatctatttatgcgtcgaaaggcagtacggggaccgnggacgggagccgaagtcgacgtcgtggggaccaggggaaccctggtaccaccggtctccgtaccncggtcccttcccaaccgaccgggacccaccgttacgggtcccctttccccccgtggaccccgtcccgttacgccttcccgaacgggacgcccgtacccgttcccggaacggcgtacccaacggacgggccggtccccgtggccgtcgtaccgtcgacgtacggactcgtccgtcgtcgaccngtacngtcgcgtgtcgcgaggtccgacgtancgcg

SEQ ID NO: 40971 - DNA, 617 bp, Homo sapiens
  misc_feature: GYAE6OF02HPQ78.2.86.H09.1.454.CMB.1.raw
  modified_base (294)..(294): a, c, t, g, unknown or other
  misc_feature (294)..(294): n is a, c, g, or t
  modified_base (483)..(483): a, c, t, g, unknown or other
  misc_feature (483)..(483): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgcaaatgaacaccctgagngccgagacacggccatctattatgtgcgaaggaaatggggccggcgacggggagacggaagtgcttcgtcggggaccagggaaccctggtcacgtctcctcacgcctccaccaacgggcccacgtccggtccttcccccgtcggccgccctcgccgtccacggacgccaccctaccggacgacgccacncggaccggcccgtgggccgtacgccggtcggtaccaacgggaccttaaccgttccgtacgtaccggtacgtacccggtcgttcggacgggccggtaccggtcgggacgtaacgggccgaccgtagtaccgagcg

SEQ ID NO: 40972 - DNA, 760 bp, Homo sapiens
  misc_feature: GYAE6OF02GFSCA.2.86.H09.1.454.CMB.1.raw
  modified_base (147)..(147): a, c, t, g, unknown or other
  misc_feature (147)..(147): n is a, c, g, or t
  modified_base (670)..(670): a, c, t, g, unknown or other
  misc_feature (670)..(670): n is a, c, g, or t
  modified_base (698)..(698): a, c, t, g, unknown or other
  misc_feature (698)..(698): n is a, c, g, or t
  modified_base (722)..(722): a, c, t, g, unknown or other
  misc_feature (722)..(722): n is a, c, g, or t
  modified_base (728)..(728): a, c, t, g, unknown or other
  misc_feature (728)..(728): n is a, c, g, or t
tcagacgctcgacacacgaccggtgctcgatttagtgctatagacttgggtttgggggaggcttggtacagcctggggggtccctgaggactcgtcctgtgcagcctctggattcacctttagtaactttgtcatgagttgggtccncgaggctcaggaaagggctggagtgggtctcagctatgatggtgtttcttgtccacacgtacgcgccgtccgtacggaaggtccgggtctaccatgtcctagaggaacacttaacgaaaaccaaacgccgtatagttactacgcgtaaaactaagtaccgaaaccgtccgtaagacggaccggtaacggaacgacccgggttaaccacgtaaccgttaatttacgttaacggttcgtaaccggtaaggaaaccgtaacggtaaaggggttcccgggcgggtaccggggaacgggacggtaaaactcgggacgtttaaccggttcggggacccggggaaacggggtaaccccgtacggggtaccgttacccggtaaacccgttccgtacccgtaacgtacccggtaccccttaccgaaaaccggggcccggtacccgtaacccggtcccgttaccccgttacccggtcccggtcccgtaccgccggtacccgtcgaccgcgtacccgtaccgaccgacacgacncgaccgtccgtcggcgtccgacgtccgngacgtacgtacgtctcgtcgtacncggtcngacgtcgcgtgcggtacgacgtcgcagcgtag

SEQ ID NO: 40973 - DNA, 604 bp, Homo sapiens
  misc_feature: GYAE6OF02IOETX.2.86.H09.1.454.CMB.1.raw
  modified_base (354)..(354): a, c, t, g, unknown or other
  misc_feature (354)..(354): n is a, c, g, or t
  modified_base (476)..(476): a, c, t, g, unknown or other
  misc_feature (476)..(476): n is a, c, g, or t
  modified_base (604)..(604): a, c, t, g, unknown or other
  misc_feature (604)..(604): n is a, c, g, or t
tcagacgctcgacacacgaccggtgctcgatttagtgctatagacttgggtttgggggaggcttggtacagcctgggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccgttcaccatgtccagagacaattacgaaaaacacgctgtatctgacaaatgaacaccctgagagcgagacacggcatctattatgtgacgaagacagtaggggccggcggagggagcgaagngtaccttcgaggggccaacggggaaccctggtcaccgtctcctcacggccctaccgaaccgaacgggtcccaagtcccggtcccttcccccgtgtacccgcccgtcgccgtccgacgggacnccgaaccgtccggaacgagccacgagcccggccgtgggctacgcgtggaccgaaggtaccttaccgttctacgccgtaggtccgtccgaggcggtcggacgtcggtacggacgacggacctagacggn

SEQ ID NO: 40974 - DNA, 583 bp, Homo sapiens
  misc_feature: GYAE6OF02JJM8W.2.86.H09.1.454.CMB.1.raw
  modified_base (261)..(261): a, c, t, g, unknown or other
  misc_feature (261)..(261): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (555)..(555): a, c, t, g, unknown or other
  misc_feature (555)..(555): n is a, c, g, or t
  modified_base (583)..(583): a, c, t, g, unknown or other
  misc_feature (583)..(583): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgagggccgttcacatgtccagagacaattcgaaaaacncgctgtatctgacaaaatgaaccacctgagagccgaggacacggccatctattatgtgcgaaggacagtagggccggngcgggagcgaatgacttcgnggggccagggaaccctggcaccggtctccctcagccctccaaccgaacggcccatccggtccttcccccgcgggtccgcccgtgcctcccgaggtacgccgaccctccgacgacgccacgacgccgcccgtcggcgtcgccgttgacgacggtacctaccgttcctgtccgacgtccgtacgtcggacggtccggngcgggtacgaccggaccggcacgtaggn

SEQ ID NO: 40975 - DNA, 644 bp, Homo sapiens
  misc_feature: GYAE6OF02FYQIH.2.86.H09.1.454.CMB.1.raw
  modified_base (264)..(264): a, c, t, g, unknown or other
  misc_feature (264)..(264): n is a, c, g, or t
  modified_base (362)..(362): a, c, t, g, unknown or other
  misc_feature (362)..(362): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacncgctgtatctgcaaatgaacaccctgagacgcgaggacacggccatctattatgtgacgaaggacagtagggccggcgcgggagcgaatgactttcgnggggccagggaaccctggtaccaccgtctcctcacggccctccaaccgaacggggccccagtccggtccttcccccgtgggcccgccctggccctaccgacgggtacgccgaacccgtccggaacgacggaccaacgacggacccgggtcccgtggggcctcggcccgttcgggtaccaaacgggtaccttaaccgtttcccgtcgtaccggaaggttccggtacgtacggacggccgggtaccgttacgggaccgtaaaccgggccgacgtaacggtgacg

SEQ ID NO: 40976 - DNA, 604 bp, Homo sapiens
  misc_feature: GYAE6OF02JGPJ7.2.86.H09.1.454.CMB.1.raw
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
tcagacgctcgacacacgaccggtgctcgatttagtgctatagacttgggtttgggggaggcttggtacagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgagggccattcaccatctccagagacaacgccaagaacacgctgtatctgacaaatgaacagtctgagcgccgaggacncggctgtgtattacgtgtgcaagagatagcagcagctggacncgacgtacgtcggggaccacgggtaaccctggtaccaccgttcctcctcacgtccctacccaccgaacggccctacgttcccggttacccttcccccgtcggcccgtccccgtacgtcccgtcccgacggaccgtacccgacccgtacccggacgaccgcaccgacggccggcccgttcgggcctcgcccgttggtaccgaacggtaccttaccttccgtccggtacgacggtcgtccgcggacggtccgggtcgtcggg

SEQ ID NO: 40977 - DNA, 647 bp, Homo sapiens
  misc_feature: GYAE6OF02JI9S2.2.86.H09.1.454.CMB.1.raw
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
tcagacgctcgacacacgaccggtgctcgatttagtgctatagacttgggtttgggggagggcttgggtacagcctggggggtccctgagactctcctgtgcagcctctggattcacctttagttaactttgtcatgaggtgggtccgccaggctccaggaaaggggctggagtgggtctcagctattgatggtggttctgttcgtccacactacgccggcctccgtgaacgggccggttcaccatcgtccagagaacaattacgaaaaacagctagtatctgacaaatgaaccacctgagacgccgaggacaccggcatcctaattatgtagcgaaggaccaggtacggggcgcgggcgggancggaatcggactcgnggggaccacggggaaccctggtccaccggtctcccgtcacgtccctaccgaccgaacggccccagtcccggtccttcccccgtggcccgccctgccgtaccgagaccgccaccgtccgagacgcgacgacgtccggcccgtagggtcctcggccgttacgggtacgtaaacggccttaccgttccgttacgggtaccgtacggcccggttggaccgtacgggcggtccgggtccgggacggtacccggacggtaccggacgtagtcgg

SEQ ID NO: 40978 - DNA, 614 bp, Homo sapiens
  misc_feature: GYAE6OF02G3TWK.2.86.H09.1.454.CMB.1.raw
  modified_base (340)..(340): a, c, t, g, unknown or other
  misc_feature (340)..(340): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattatgtgcgaaggacagtagggccggngcgggagcgaatgacttcgtggggccagggaaccctggtcaccgtctcctcagccctccaccgaacgggcccagtccggtccttcccccgtcgggccgtccctgcctccgacgggacgccaccctccggagacgccaaccgacggccgggccccgtggggcctcgggtcccgttcgggtaccgaacgggtaccttaccgtttccctcggttccggacggtcggttccgtcgggtacggccggggtcgtcgggaccgtacggccgactagtagcg

SEQ ID NO: 40979 - DNA, 751 bp, Homo sapiens
  misc_feature: GYAE6OF02HTBC7.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagaagacaattacgaaaaacacgctgtatctgcaaaatgaaccaccctgagacgccgaaggacacggccatctattattgtgcgaagacagtacgggccggcggcgggagacggaataggacctttcggtcgggggaccgaacggggtaacccctgggtaccacccgggttacccttccgtaccgacggtcccccttaccgaacccggaacggggcccctaagtcccgggttcccctttccccccgtacgggtcccggtccccgtcggtacccttcccggaacggtaccgacccgtaaccccgtcccggaagacggaccgtaacccgaacggcccgggtcccggttacggggccgtccgaccccggttagggtacccgaaagggttaccccttaccgttaccctttccgggtaccggtacggtacccggttccgacgggttaaccggggccgggttaccggtaccggggaccggtaacccggggtacggacccgtacggtaggacg

SEQ ID NO: 40980 - DNA, 574 bp, Homo sapiens
  misc_feature: GYAE6OF02GBQAR.2.86.H09.1.454.CMB.1.raw
  modified_base (471)..(471): a, c, t, g, unknown or other
  misc_feature (471)..(471): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgacaaatgaacacccctgagagccgaggacacggccatctattatgtgcgaaggacataggggccggcgcgggagcgaatgacttcgtggggccagggaaccctggtcaccgtctcctcagccctccaccaacgggcccagtcggtccttcccccgtggccgccctgcctccgaggagccacctccgagacgcaccnggccggcccgtgggcctcgccgttggtaccaaggtacctaccgttcctgtccgagtccgtcgtcggaggccgggcgttcgggccaacgggcgacgtagagtcg

SEQ ID NO: 40981 - DNA, 628 bp, Homo sapiens
  misc_feature: GYAE6OF02H48Y6.2.86.H09.1.454.CMB.1.raw
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
  modified_base (625)..(625): a, c, t, g, unknown or other
  misc_feature (625)..(625): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttnaccatgtccagagacaattcgaaaaacncgctgtatctgcaaatgaacacctgagagccgagacacggcatctattatgtgcgaaggacagtacggggccggcgacggganacgaatgaaccttcgtagggggccaagggaaccctgggtaccaccgttctcctcgacgtccctcgaacccgaagggccctagtccggtacccttcccccgtggcccacccgtcctaccgaacgacgaccaccgttcggtcggggaccacgtacggacccggcccgtacgggcctcgcccgttcggtaccgtaaagtccctacttcccgttcggtccgacggtccgttcggcggtacggcgggccgttcggacggtacggacgaccgtagtacgtacgnacg

SEQ ID NO: 40982 - DNA, 880 bp, Homo sapiens
  misc_feature: GYAE6OF02I4EHF.2.86.H09.1.454.CMB.1.raw
  modified_base (877)..(877): a, c, t, g, unknown or other
  misc_feature (877)..(877): n is a, c, g, or t
tcagacgctcgacacacgaccggtgctcgatttagtgctatagacttgggtttgggggaggcttggtacagcctggggggtccctgagactctcctgtgcagcctctgattcacctttagtaactttgtcatgaggtgggtccgccaggctccaggaaaggggctggagtgggtctcagactattgagtggtggttctgttcgtcccacacctacgccggcctccgtggaacgggtccgttcgacatcgtaccagacgaactaataacgaaaaacacgactgtatctagacaaatacgaaaccaccgtagaagacggaccggaacggacgtaacccggaccaacttacttaatttagttgtcggacgaaacggaacacggtaacgggggcccggcggtacgggaggacgtaacgtacgtaccgttaccgggtacgggggacccgaaccgggtaaccccgttcggtaccgtacccggtccctcctaccgtaccgcccctacccgaacccggaaccgggtcccttaacgtcccggtttaccccgttacccccggtcggaccccgttccccgtggtacccctacccggaggtacccgaccgtaaccccggtacccgggtaacgaccggaacccgtaaacccggacccgggtaccccgggtaccccgggttccggggaacccgtttcgggttcccccgttaacgggttttaaaccccggaaaccggtttaaacccggttttaaccccgtttccccgggttaccgggtaaccgggttaaccgggttccccggttacgggttaccgggggtaccgggtaccgggggtaccccgggttaggggaccccgggtaaacccggggtcggtaaccgtaggggtaaccncgg

SEQ ID NO: 40983 - DNA, 819 bp, Homo sapiens
  misc_feature: GYAE6OF02JQ3PF.2.86.H09.1.454.CMB.1.raw
tcagacgctcgacacacgaccggtgctcgatttagtgctatagacttgggtttgggggaggcttggtacagcctgggggggtccctgagactctcctgtgcagcctctggattcacctttagtaactttgtcatgaggtgggtccgccaggctccaggaaaggggctggagtgggtctcagctattgatggtggttctgttcgtcccacactacggtcgcctcgtggaagggtccggttcaccatcgtccagagaacaattacgaaaacacgctagtatctacgacaaagtacgaacaccgtagaggacgccggaaggaccgaccggacctaagttccttaagtttacgttaggtacggacggaaacggacgtaggtaaccgggggccggacgggacggggtacgacggaagtcgaaccgtttccgggtacggggaccgaaccggggtacccgtttacggtaccgtaccgttcctacccttcgaaccgtccccgtaccgaacccgaaccggggtccctaccggtttacccggttccccgttaccccccgggtcggccccgtacccgttacgaccccgttaaccggaaccggtaccggacccctaaccgttcccgggaacgtaccgcccgaaccggaccgggtcccgtccccgggttagggcccttccggggtacccgtttggggtaaacccgaccgggtttaacccgtacccgtttacccggttagggacccgttaccgggtccggtttaccggacgggttccggggccggttacgggaccgggtaccggtaaggggtacccaccggtacgtacggtcg

SEQ ID NO: 40984 - DNA, 716 bp, Homo sapiens
  misc_feature: GYAE6OF02GP4LY.2.86.H09.1.454.CMB.1.raw
  modified_base (267)..(267): a, c, t, g, unknown or other
  misc_feature (267)..(267): n is a, c, g, or t
  modified_base (357)..(357): a, c, t, g, unknown or other
  misc_feature (357)..(357): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggcctcagctattgatggtggttctgttgtcccacactacgcggcctccgtgaagggccggttcaccatgtccagacgacaattaccgaaaaacncgctagtatctgacaaatgaaccacccctagagacgccgaggaccacggccatactatttattgtcgacggaagacagtaggggcccggnggcgggagcgaagtgtacttcggcggggccgaacgggtaacccgtggtaccaccggtctcccgtcacgccctacccgaaccgaacgggccctacgtccggtccttccccgnggcccncccgtgcccgtccgacggacgccacccgtacgacgtacgaccaccgacggcccgggcccgtacggggtctaccgggtcccggttacggtaacccggtaaacggtaccgtttaacccgtttcccggttacgggttacccggtaacggttcccggttacccggttagggtacccggggtacccggggttccggtaaccgggggttccggaaacggggtcccgggtaccgtaacggtacgtacgg

SEQ ID NO: 40985 - DNA, 622 bp, Homo sapiens
  misc_feature: GYAE6OF02I5KEA.2.86.H09.1.454.CMB.1.raw
  modified_base (262)..(262): a, c, t, g, unknown or other
  misc_feature (262)..(262): n is a, c, g, or t
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
  modified_base (516)..(516): a, c, t, g, unknown or other
  misc_feature (516)..(516): n is a, c, g, or t
  modified_base (618)..(618): a, c, t, g, unknown or other
  misc_feature (618)..(618): n is a, c, g, or t
  modified_base (622)..(622): a, c, t, g, unknown or other
  misc_feature (622)..(622): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgagggccgttcaccatgtcagagacaattacgaaaaacncgctgtatctagacaaatgaaccaccctagagacgccgaaggacacgccatntattattgtgcggaaggacaggtacggggccgnggcggagacgaatcgacttcgnggggaccgaacggaacccgtcggtaccgacgtcctacccgtcacgtccctacccgaaccgaacgggtcccaagtttcccggtccccgttcccccgtcggcccgtccctcgcctccgaacggccgtacacccgtcgagacgaccgacncggccggtaccgtcggctcggccgtgtacgaacgtaccttacgttccgtcgtcgtacggtcgtcgaggtacggccgggtcgcgggacgtacggcgacggtanaggn

SEQ ID NO: 40986 - DNA, 567 bp, Homo sapiens
  misc_feature: GYAE6OF02GN4YS.2.86.H09.1.454.CMB.1.raw
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (452)..(452): a, c, t, g, unknown or other
  misc_feature (452)..(452): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgcaggctccaggaaaggggctggagtgggtctcagctattgatggtggttctgttgtcccacactacgcggcctccgtgaacgggccggttcaccatgtccagagaacaattacgaaaaacacgctagtatctgacaaatgaacacctgagagcgagacacgccatctatatgngcgaagcagtagggcgngcggagcgagtnactcgngggccacggaacctggcaccgtctccncacgccncaccgaggcccagtccgtcctccccgtggcccgcctcgcctaccgcggacgccaccctcgaacgngaccacgacgccggtcccgcggtctcgccgtacgacgaacggtactaccgttctcgacgtacggccgtactcggcggtccggtcgacgggtacgtacggaccgtcgtaagcgtag

SEQ ID NO: 40987 - DNA, 735 bp, Homo sapiens
  misc_feature: GYAE6OF02IMUOH.2.86.H09.1.454.CMB.1.raw
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
  modified_base (345)..(345): a, c, t, g, unknown or other
  misc_feature (345)..(345): n is a, c, g, or t
tcagacgctcgacacacgaccggtgctcgatttagtgctatagacttgggtttgggggaggcttggtacagcctgggggggtccctgagactctcctgtgcagcctctggattcacctttagtaacttttgtcatgaggtgggtccgccaggctccaggaaaggggctggagtgggtctcagcttattgatggtgttctgttgtccacactacgcggcctcgtgaaggccgttnaccatgtccagagacaattacgaaaaacncgactgtatctgacaaatcgaaccacctagacgacgcgaggacacggcatactattattgngacgaagactagtagggccgngacgggagacgaatgacttcgaggggaccacgggtaaccctgggtaccaccggttctaccgtacacgtaccctacccgaaccggtaacgggtccctacgttacccggttcccgtttaccccccgtacgggtacccgtccccgttcggaccgttaaccccggtaagggaccgtaacccgtaacccgtaccgggaacgtaccgtaccgaaccgacgggtcccgggtacccgttagggggcccttacggtaccccggttagggttaaacccgaaacgggtaacccttttacccggtttcccgtaggtacccgtaacggtccggttacgtacgggtaacgtccggggtaccgtacgggtccaaacggggtcccgtaaccggttataccggtacg

SEQ ID NO: 40988 - DNA, 782 bp, Homo sapiens
  misc_feature: GYAE6OF02F6EH9.2.86.H09.1.454.CMB.1.raw
tcagacgctcgacacacgaccggtgctcgatttagtgctatagacttgggtttggggggaggcttggtacagcctggggggtccctgagactctcctgtgcagcctctggattcacctttagtaactttgtcatgaggtgggtccgcctaggctccgaggaaagggcgttggagtgggtctctagcttagttgagtggtgttctgttactccacactacgcggccgtcggtggaacgggccgttacaccgatcgtaccagacgactaacttacgaaaaacgcgctacgtactcgtacgactaaatcgtaaccacccttaggagacgtccggaacggaccacggcctaagttacttatttacgttgtacggaacggaagggaacgtaacgggtacggggtccggacggtcgggaaggacgtaagtcggtacgttcggtcgggacgtaacgggacccttcggtacgtacccgtccgtaccgtcgaccgtcccgtacccgaaccgtacgggtcccctaagttcccggttaccccttccccgggtacggccccgtacccgtggacccgttacccgaaggcctaccgtacccgttacggaacggacgacccgtaacggacggtacccgggtcccggtacgggttcctcggttacccggtaggttaacccgaaacggtttacccgttaccgtttccgggtacggtccggtaaccggttcccggttaggacgggggtcccgacgggggtacctacggggacccgtaggggccgtacggtagtacggcgg

SEQ ID NO: 40989 - DNA, 674 bp, Homo sapiens
  misc_feature: GYAE6OF02JJCDM.2.86.H09.1.454.CMB.1.raw
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
  modified_base (490)..(490): a, c, t, g, unknown or other
  misc_feature (490)..(490): n is a, c, g, or t
tcagacgctcgacacacgaccggtgctcgatttagtgctatagacttgggtttgggggaggcttggtacagcctgggggggtccctgagactctcctgtgcagcctctggattcacctttagtaactttgtcatgaggtgggtccgccaggctccaggaaaggggctggagtgggtctcagctattgatggtggttctgttgtccacactacgcggcctccggtgaacgggccgttcacatgtccagagacaacttacgaaaacacgctagtatcngacaaatgaaccaccctgagnggaccgacggacaccggaccatactattagtgagacgaaggactaggtacggggcggacggcgggagacgaatggtacttcggtcggggaccgtaacgggaacccgttcggtacctaccggtacctcccgtacgacgtacccgtacccaaccggtaccggggccctacggttacccgttccccgtttccccgnggcccgtaccgtcgacctccggacgtacggccacccggttcgaacgcgaccgacgtaccggccggtcccggtaggccgtacggtcccggttagaccggaaacgttcctaccgttccgtgtacggcgtccggtctagggacggtccgggacgtaccggacggtaccggacgtacgacggtagacg

SEQ ID NO: 40990 - DNA, 718 bp, Homo sapiens
  misc_feature: GYAE6OF02GM6MP.2.86.H09.1.454.CMB.1.raw
  modified_base (259)..(259): a, c, t, g, unknown or other
  misc_feature (259)..(259): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtggtctcagctattgatggtggttctgttgtccacactacgcgcctccgtgagggccgttcacatgtccagagacaattacgaaaaacncgctagtatctgacaatgaaccacctgagacgccgagacacgctatctattatgtgacgaaggacaggtacggggccggcgggcgggagacgaatggtacgttcggacgggggacccgaacgggtaacccgtggtacccgtacccggttcctcccgtaccgaccgtaccctaccccgaaacccggaaccgggtcccctacggtttccccgggttccccctttccccccggtacgggtcccccgttacccgtccggacccttacccggacggtacgacccgtaaccccgttcccggaacgaccgaccaaccgggaccgggtcccggtcccgttggggcccttcggtcccggtagtaccgaaacggtacccttaccgttccgtcggtacggtcggtccgttcggtacggaccgggtccgggtacggaccgggtacggaaccgggtccggactacggtcgcg

SEQ ID NO: 40991 - DNA, 869 bp, Homo sapiens
  misc_feature: GYAE6OF02H9WRP.2.86.H09.1.454.CMB.1.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (706)..(706): a, c, t, g, unknown or other
  misc_feature (706)..(706): n is a, c, g, or t
tcagacgctcgacacacgaccggtgctcgatttagtgctatagacttgggtttgggggaggcttggtacagcctggggggtccctgagactctcctgtgcagccctctggattcacctttagtaactttgtcatgaggtgggtccgcaggctccgaggaaagggctggagtgggtctcagctattgagtggttggttctgtcgtcccanactacgcggcctccggtgaagggccgttnacctatcgtaccagaagactaaattacgaaaaacncgcgttagtactcgtagacaaagtanaacctaccgagaacgaacgccggacggaacgccggactactacgttaacttgtgtacggacgaaaggacgaagggtgggacccggcgggaccgggaagtcgaaagttcggtaaccgtttgggtaccgggggaaccggtaaccggggtaacccgtcggttacccgaacccggtttcctaacccgtaccgtaacccggtaccccctttacccggaaaccccggttaaccgggggtaaccccgtaaccggtttccccggggttttaaacccccccgttttcccccgggaccgggtaccccggtttccccgtaccggggtacccaccgggttaaacgggaacccgtaaccccgtaacccggttaccgaagggtaccgtaccgaaccggtaccgggtcccggggttaacccnccggggtaccttccgggtaacccggttacgtaaaccgggtaacccgtaacgtttacccgggtttccgtaccggtaacgggtcccggtccggttaccgtacggtacgggtaaccgggcccggttaacgggaaccggttaacggacccggtaagtaggttaacgc

SEQ ID NO: 40992 - DNA, 621 bp, Homo sapiens
  misc_feature: GYAE6OF02FN5PM.2.86.H09.1.454.CMB.1.raw
  modified_base (264)..(264): a, c, t, g, unknown or other
  misc_feature (264)..(264): n is a, c, g, or t
  modified_base (367)..(367): a, c, t, g, unknown or other
  misc_feature (367)..(367): n is a, c, g, or t
  modified_base (621)..(621): a, c, t, g, unknown or other
  misc_feature (621)..(621): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacncgctgtatctgcaaatcgaacaccctgagagccgaggacacggccatctattattgtgacgaaggacagtaggggccggcggcgggagcgaatggacgttcgnggggccaaggggaaccctggtaccaccggtctcctcacggccctccgaaccgaacgggcccaagttccggtccttcccccgtgggcccgtcccgtcgtcctacccgaaggcgaccaccgttccggagacgccaacgacggccggtcccgtgggcctcggccgtacggtacaaacggtccttaccgttccgtagtccggacgtccgtacgtgggacggccgggtctacgggacctaacgggccgactacggtcgn

SEQ ID NO: 40993 - DNA, 714 bp, Homo sapiens
  misc_feature: GYAE6OF02FSCW3.2.86.H09.1.454.CMB.1.raw
  modified_base (703)..(703): a, c, t, g, unknown or other
  misc_feature (703)..(703): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgagtgggtccgccaggctccaggaaaggggctggagtgggtctcagctatgatggtgttctgttgtccacactacgcggcctccggtgagggccggttcacatgtccagagacaattacgaaaacacgctgtatctagcaaagtcgaactaccctgagacggcgaaggaccacggccatcttaattcgttgtcgtacgaaggacaggtacgggggcccggcgggcggggacgacggtaagtcggtaccgtttcgggcgggggtaccgaacggggtaaccctgggtacctacccggttctacccgtcaccgtccctacccgaccgaacgggtccctacggttaccgttcccctttccccggacgggtccctacccgtcgacccgttccggaacggtaccggtaccctacccggtacccggtaacgaccgtaccgaccgtaccgggcccgggtccggtcgggtaccttcccgggtacgttccgggtaaaccgtaacggtaccttaccgttcgtacggtacgacgtccggtacggtcggtaccggcggtaccgtgggtaccgacgggtaccgngtacggtgacg

SEQ ID NO: 40994 - DNA, 667 bp, Homo sapiens
  misc_feature: GYAE6OF02G433A.2.86.H09.1.454.CMB.1.raw
  modified_base (276)..(276): a, c, t, g, unknown or other
  misc_feature (276)..(276): n is a, c, g, or t
  modified_base (621)..(621): a, c, t, g, unknown or other
  misc_feature (621)..(621): n is a, c, g, or t
  modified_base (656)..(656): a, c, t, g, unknown or other
  misc_feature (656)..(656): n is a, c, g, or t
tcagacgctcgacacacgaccggtgctcgatttagtgctatagacttgggtttgggggaggcttggtacagcctgggggggtccctgagactctcctgtgcagcctctggattcacctttagtaactttgtcatgaggtgggtccgccaggctccagggaaaggggctgggaggtgggtctcagctattgatggtggttctgttgtcccacactacgccggcctccgtggaacgggccgttacaccatcgtaccagagaacaacttacgaaaaacncactgtatctgacaaatcgaaccaccctagagacgacgaggacaccggctatctattatgtgacgaaggactagacggggccgcggacgggacgcgaatggtacttcggcggggaccggaacggaacccggtggtacccaccgtcctccgacacgccctaccgaaccgacgggccctagtccgtacccttccccgtggaccctcccgtagccgtacccgaggtacaccgtacccgtacgagaccgtacgaacgaccggccgggtacccgtcggggtctaccggtaccgttacgggtaaccgaacgtaccttaccgttccgtagggtacgaccggtccggttacgnggaaccgggtcggtacgtaggacggaacccgggtnacgtaggctgg

SEQ ID NO: 40995 - DNA, 591 bp, Homo sapiens
  misc_feature: GYAE6OF02IV7VK.2.86.H09.1.454.CMB.1.raw
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (445)..(445): a, c, t, g, unknown or other
  misc_feature (445)..(445): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattacgaaaaacacgctgtatctgcaaatgaacaccctgagagccgagacacggcatctattatgtgacgaaggacagtaggggccggcgcgggagcgaatgactcgtggggccagggaaccctggcaccgtctcctcgacncctccaccgaggcccngtccggttccttcccccgtggcccgtcctacgccnccgacggacgcctaccgtccgagcgaccacgacgccggtccgtggggtcctcggcccgttgaacctacggaaccttacgttccgcgtccggacgtcggttcgtaggacggtccgggcgtacgggacgtaccggcggccagtacgcg

SEQ ID NO: 40996 - DNA, 710 bp, Homo sapiens
  misc_feature: GYAE6OF02H7X0W.2.86.H09.1.454.CMB.1.raw
  modified_base (207)..(207): a, c, t, g, unknown or other
  misc_feature (207)..(207): n is a, c, g, or t
  modified_base (266)..(266): a, c, t, g, unknown or other
  misc_feature (266)..(266): n is a, c, g, or t
  modified_base (386)..(386): a, c, t, g, unknown or other
  misc_feature (386)..(386): n is a, c, g, or t
  modified_base (586)..(586): a, c, t, g, unknown or other
  misc_feature (586)..(586): n is a, c, g, or t
  modified_base (698)..(698): a, c, t, g, unknown or other
  misc_feature (698)..(698): n is a, c, g, or t
tcagacgctcgacacacgaccggtgctcgatttagtgctatagacttgggtttgggggagcttggtacagcctggggggtccctgagactctcctgtgcagcctctggattcacctttagtaactttgtcatgaggtgggtccgcaggctccaggaaggggctggagtgggtctcagcttattgatcgggtgttctgttcgtcccanacctacgcggcctcggtgaagggccgtttcaccatcgtccagagacaatacgaaaaacncgctagtattctagactaaatcgaacctaccctgaacgcggaccggaaggaaccgacggacctagtccttaattttacgttaggtcgacggaacggtaagacggtaaacgggggcccggnggtaccggggaacgcgtaaattcggtaccgttcgggtcgggggaccaacggggtaaacccgtggtcctaaccgtattcccgtactccggacctccggaaaccacggggccctaacggtttccgggttccccttccccggacggtcccgtccgtaccggtactccggacggactccgaacccgtcgaacgtccgacaccgnggtcccgaccgtcgggcttccggccgttacggcgtaacggtaacttccgttaccgtagtaccgtacgtccgtcgtaggccggtaccgggcgtacggaccggaacggtacccncggtaattaggc

SEQ ID NO: 40997 - DNA, 654 bp, Homo sapiens
  misc_feature: GYAE6OF02GXZ8V.2.86.H09.1.454.CMB.1.raw
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (442)..(442): a, c, t, g, unknown or other
  misc_feature (442)..(442): n is a, c, g, or t
  modified_base (620)..(620): a, c, t, g, unknown or other
  misc_feature (620)..(620): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaagggctggagtgggtctcagctattgatggtggttctgttgtccacactacgcgcctcgtgaggccggttcacatgtcagagacaattacgaaaacacgctagtatctgacaatgaacaccgtgagacgcgagacacgcatctattatgtgacgaagacaggtacgggccgnggcgggagcgaatgtacttcggngggccgaacgggacctggacctaccgtctccctcgaccgccctaccgaaccgaccgggtaccctcggttcccgttccgttcccccggnggtaccctcccgtcgtcccgtaccggacggtacccgccgtaccctaccgggacaccgaccgtaccggccggtcccgggtccgtccggggtctacccgggttcggtacgtaaaccgtacggttaaccctttcgttaccgtcggtacggtcgtccgtaccggtagggaccgggttccggngtaacccgggagaccggtccgtacgtaggtagcg

SEQ ID NO: 40998 - DNA, 848 bp, Homo sapiens
  misc_feature: GYAE6OF02JXQYK.2.86.H09.1.454.CMB.1.raw
tcagacgctcgacacacgaccggtgctcgatttagtgctatagacttggggtttgggggaggcttggtacagcctggggggtccctgagactctcctgtgcagcctctggattcctacctttaagtaactttgtcatggagggtgggtccgccgaggctccgaagggaaaggggcgtggaggtgggtctcgagctagttgagtgggttgttctgttcgtcccacacgtaccggcggccgtccggtaggacgggtccgttaccacctagtcgtccagacgaactaactaacgaaaactcgcgtagtatcgtagactaaagtacgaacctaccgtaggacggacggaccggaacggtaccgaaccggtaccctacgttacgttaatttaatcggtacggaaccggtaaaggaccggtagggtacgggggacccgggcgggaccgggagtacggaacgttcgtacggtttccggacgggggaccgaacgggtaaccccgttggaccctaccggttcgtacccgtacgacccggtaccctacccgtaacccgggaaccgggtaccccgtaccgggtacccggtttacccccgtttcccccggtacccggtaccccgttaccccgttaaccccgtaacccggtaaccggtaccgtcccgttaacccgggtaccggggtacccggggacccgaaccggcccgggacccgggtcccggcgggtaccggtcccggtccggtacggtaccggtaccgttaccgttacccgtccgtccgtccggtacggtcggtacggtcggtaccgggcgggtcggtacgaccgggaccggaacggtacggtaaccgtgagcgtacg

SEQ ID NO: 40999 - DNA, 852 bp, Homo sapiens
  misc_feature: GYAE6OF02IATXB.2.86.H09.1.454.CMB.1.raw
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttcgtccacactacgcggcctccgtgaagggccggttcaccatgtccagagacaacgttacgaaaaacgtacgctagtaactcttagaactaaaatacgaaaccctaaccctggaacgagacccggaggaccgaaccggacctacgttacttaagttttaacgtttaggttacggacgggaaaggaccgtaacgggttaacggggggccccgggcgggaccgggggacggacgtaaacgtcggtaaccgtttccggtccggggggaccgtaaccggggggtaaacccttcgggtacccgtaacccgttccgtacccttcggtaccgtacccctaccccggaaacccggtaaccgggggtaccccaacggtttcccggtttacccccttttcccccggtccggggtcccgtaccccgttcggaccccttaccggaacgggtaaccgccccgtacccgttccggaacggaccgtccgaaccggaccggtcccgggtaccccggttgggaccgttccgggccggttacgggtaacccgtaaacgggtaaccctttaaccgttcccgttacgggtaccggtacggttcccggttaacggttcggaaccggggtccgggtacggtacgggaccggtaccgggccgtacgaaccgtagcg

SEQ ID NO: 41000 - DNA, 927 bp, Homo sapiens
  misc_feature: GYAE6OF02JNK59.2.86.H09.1.454.CMB.1.raw
tcagacgctcgacacacgaccggtgctcgatttagtgctatagacttgggtttgggggaggcttggtacagcctggggggtccctgagactctcctgtgcagcctcgtggattcacctttagtaactttgtcatgaggtgggtccgccaggcctccgagggaaacgggcgtggaggtcgggtctcgagtcgttatgagtggtggtttctcgttcgtcccactacgtaccggccggtcccttccggtaggtaccggggtcccggtttaccaaccctagtccgttaccgaaggaacgtaaacctaaacgttaaaacccggaaaaaaaccgtccggtacctttagtaacttccgtacggaacctaaagtaccgaaacccgtaccgtacggaacgaccggaccggaacggaacccgtaccggtaaccacttacgttaattagtttacggcggaacggtaaaacggacggtacggggtaaccggggggcccggtacgggaccggggtacggaaccgtaaaggcgttaaccgttccggggtcggggaaacccgtaaccggggaacccgtttcggtacccgaccgttccgtacccgtcgacccggttccctaacccggaaccggtaccggtaccctacggtttcccggttcccccgttcccccgggtaggcccccggttcccgtacgtcccggtaccgaccgggtaccaccccggttaccgaccggacggacccggtaccaaccgggtccccgggcccgggtttcccccgggtgggtcccggttaaccggttccccgggtttaacggttacccggtaaaccggtccccggttaaccctttccgggtacggtcccggttaacggtccgttcgggtaccggcggggttaccgggccgtaaagggggtacccgagtacccggtagttacgagtaccg

SEQ ID NO: 41001 - DNA, 1011 bp, Homo sapiens
  misc_feature: GYAE6OF02IL2C3.2.86.H09.1.454.CMB.1.raw
  modified_base (182)..(182): a, c, t, g, unknown or other
  misc_feature (182)..(182): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
tcagacgctcgacacacgaccggtgctcgatttagtgctatagacttgggtttgggggaggcttggtacagcctggggggtccctgagactctcctgtgcagcctctggattctacctttagtaacttttgtcatgaggtgggtccgccaggctccagggaaacggggctggagtgggtctnagctattgagtggttggttctgttcgtcccacactacgcgcctcggtagaacgggtccgttcacctatcgtccagaanaactaattaaccgaaaaacncgacttagtactcgtgaacgaaactacgaaacctacccgtaggaacggaacggaccggaacggtaacccgaaccgggtaaccctaagtttacctttaaagttttaaccggttttagggaccggtaaaccgggtaaaaacgggtaaccgttaaacggggttaaacccggggggggcccccggggtaacggggaaccgggggtaacgttaacccgggtaaaagttccgggttaaacccgttttccgggggaaccggggggtaaccccggtaaacccgggggtaaccccgtttacggggttaaccctaaccccggtttaccgttaaccccgtacgtaaacccgggttcccctaaacccccggtaaacccgggtaaaccgggggtaccccttaacgggtttaccccgggtttaccccccgttttaaccccccggtgggggtaccccccgttaacccgttcgggtacccttaaacccggggaagggttaacccggaccccttaaacccggtacccgggaaacgggtaaccgacccgaaccggtacccggggtacccggtcccccgggtttacgggggaacccttccgggtacccggttaacgggttaaaccaaacgggttaccctttaccggtttcccggtagttacccgggaacgttcggttcccggtagggaaccgggtcccggggttagacggggtaacccggaagggtaccccgtacgtaaccgggagtacg

SEQ ID NO: 41002 - DNA, 698 bp, Homo sapiens
  misc_feature: GYAE6OF02HWTP3.2.86.H09.1.454.CMB.1.raw
  modified_base (269)..(269): a, c, t, g, unknown or other
  misc_feature (269)..(269): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcgagctattgatggtggttctgttcgtccacactacgccgctcgtggaacgggtccgttcaccagtcgtccagagacaagttaccgaaaacncgtctagtatcgagacaaagtcgaaccacctggagacggaccggacgacgaccgactagttactatttagtgcggacgaaacgcgaggtacgggcccggtcgggacggagtaccgtaaggtcgtaccgttagggcggaccgtaacgggaccgtcggtacctacgtcctaccgtacacggtccctaccgaaccgtaccggtcctaaccggttccgtttcccgttaccccccgcggggtcccgtccgtccggtaccgtaccggaacggtacccaaccgtaccggacgtaccgacgtacggaccggccgggtcccggtagggtccctaggtccgtacggtaccgaacggtaaccgtccgtttcgacggtcggacgttaccggtcgtacggcgggtacgtcggtacgccggtacggccgacgtacgtagcgtg

SEQ ID NO: 41003 - DNA, 591 bp, Homo sapiens
  misc_feature: GYAE6OF02F8A3H.2.86.H09.1.454.CMB.1.raw
  modified_base (317)..(317): a, c, t, g, unknown or other
  misc_feature (317)..(317): n is a, c, g, or t
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
  modified_base (426)..(426): a, c, t, g, unknown or other
  misc_feature (426)..(426): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaagggctggagtgggtctcagctattgatggtggttctgttgtccacactacgcggcctccgtgaagggccggttcaccatgtccagagacaattcgaaaaacacgctgtatctgacaaatgaacaccctgagagcgagcacggccatctattattgtncgaagacagtagggcgacgcggancgaatgacttcgtgggccagggaccctggacaccgtcncctcgacgcctccacaacgggccctagtcgtccttccccgtggaccnccctgcctccgaggacgcctaccaccgtacgacgacaccgaggcccggcccgtaggcctacggtccgtacggttccgaaacgggtaccttaccgttccgtacgtcggacgtccgttcgtcggtaacggcggtacgttcgggcgtaacggtccggactacgtagcg

SEQ ID NO: 41004 - DNA, 860 bp, Homo sapiens
  misc_feature: GYAE6OF02FMBJK.2.86.H09.1.454.CMB.1.raw
  modified_base (146)..(146): a, c, t, g, unknown or other
  misc_feature (146)..(146): n is a, c, g, or t
  modified_base (211)..(211): a, c, t, g, unknown or other
  misc_feature (211)..(211): n is a, c, g, or t
  modified_base (271)..(271): a, c, t, g, unknown or other
  misc_feature (271)..(271): n is a, c, g, or t
tcagacgctcgacacacgaccggtgctcgatttagtgctatagacttgggtttgggggaggcttggtacagcctggggggtccctgagactctccgtgtgcagcctctggattcacctttagtaactttgtcatgaggtgggtccnccagggctccaggaaacgggctggagtgggtctcagactattgatggtggttctgttgtcccacnctacgcgcctccgtggaacgggccggttcaccatgtaccagtagacaattacgaaaaacncgctgtatctgactaaatgaacaccctgacgacgccgaggacacggcctattaccgtattacgttggtcgacggaaaggaccaaggtacgggggcccggacgggaccggggaacgtccggtaacgtccggtaaccgtttcgggtacggggggacccgtaacggggggaaacccctttcgggaaccgtacccggttaccgttacccgtcgtaaaccggcccccgtttaacccgggaacccgtaaaacccgggggtccccctaacgggttaccccggtttccccggtttaccccccggtacggtcccccggtaccccgttaccggtcccgtacccggacgggtacccggtcccgaacccggtcccggtaggaacggtcccgaaaccggtcggcccgggtaccccgtcgggggtccctcggtacccggtttcggggtaaccgaaaccgggtacccttttaccgttacccgtaggggttacccggtaccgggttacccgggttacgttacccgggggaaccgggtacccggggttccggtacgggggttacccgaaacccggggtaccggtaccggttacgttaccggtacgg

SEQ ID NO: 41005 - DNA, 810 bp, Homo sapiens
  misc_feature: GYAE6OF02IT560.2.86.H09.1.454.CMB.1.raw
  modified_base (147)..(147): a, c, t, g, unknown or other
  misc_feature (147)..(147): n is a, c, g, or t
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (277)..(277): a, c, t, g, unknown or other
  misc_feature (277)..(277): n is a, c, g, or t
tcagacgctcgacacacgaccggtgctcgatttagtgctatagacttgggtttgggggaggcttggtacagcctggggggtccctgagactctcctgtgcagcctcgtggattcaccttttagtaactttgtcatgaggtgggtccncaggctcgagggaagggcttggagttgggtctcgagctagttgagtgggtgttctgttacgtccccanacctacgcggcctcgtaggaacgggtccgttnacctatcgaccagagacaacgcctaagacncgcttagtactcgtagaccaaagtagaaacgcgtacgtggaagacgggtacggaaggaaccgccgggtacgtgttgttaacttctggtacgacgaaggtaagagttacgagtacggacacgttcgacgggtaccgcccggtaactacgggggtcggaacccggtaacggaaccgttcggggtaccgtacccgttaccttacccggctaacccgggtcccctaaccgaaacccggtaacgggtaccccttaaccgggttccccgtttaccccggttaacccggtcccgggttacccggtaccccgttccggtacccggttaccggtaacccggtaccgtaccccgtacccggtaaccgtaccgggacgacccgtaaccgcccggtaacccgggtcccggtaccggggtccttaccgggtccgttaacgggacttaaccgggtaccttacccggttacgttacgggtacccgcggttaccggtacggtacgggtcggtaccggggtcgtaccggggacggtacggtacggaacgg

SEQ ID NO: 41006 - DNA, 674 bp, Homo sapiens
  misc_feature: GYAE6OF02FOGBS.2.86.H09.1.454.CMB.1.raw
  modified_base (238)..(238): a, c, t, g, unknown or other
  misc_feature (238)..(238): n is a, c, g, or t
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
  modified_base (673)..(673): a, c, t, g, unknown or other
  misc_feature (673)..(673): n is a, c, g, or t
tcagacgctcgacacacgaccggtgctcgatttagtgctatagacttggggtttgggggaggcttggtacagccctgggggggtccctgagactctcctgtgcagcctctggattcacctttagtaactttgtcatggaggtgggtccgccacggctccgaagggaaaggggctggagtgggtctcagcttattgatgggtggttctgttcgtcccacactacggccggccttccggnggaacgggtccggttacacctatcgtcagagactaacttacgaaaaacacgctgtatctgacaagtacaaccacctgagagccggacggacgcgcctacgtcttattattggtcggacgaaggacagggtacgggggccggcggngggacggagatcggacttcggcggggaccgacgggtacccgngtcgccctctccctcacgcccacccacgaccgggaccctacgtcccggttccccttccccgtcggtcccgcccttcgacccgtccgacggccgtacccgtaccccgtacgggacgaccgaccgaccggacgggtccccgaccggtcgggtccgtccgccggttcggtaacgtaaccggtcttacccgtcgtcgacgtcgggtccctacggtcgtacgggccggttcgccggacgaccggcggctagcng

SEQ ID NO: 41007 - DNA, 666 bp, Homo sapiens
  misc_feature: GYAE6OF02HNTFH.2.86.H09.1.454.CMB.1.raw
  modified_base (270)..(270): a, c, t, g, unknown or other
  misc_feature (270)..(270): n is a, c, g, or t
  modified_base (508)..(508): a, c, t, g, unknown or other
  misc_feature (508)..(508): n is a, c, g, or t
tcagacgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccagggaaagggctggagtgggtctcagctattgatggtggttctgttcgtcccacactacgcggcctccgtgaacgggtccggttcaccatcgtccagagactaattacgaaaaacncgctgtatctgacaaatacgaacaaccctgacgagccgaggacacggccatctattattgtgacgaaggacagtaggggccggcgccgggagcgaatggtaccttcggtaggggccacggggtaacccgtggtaccaccgtcctcctacaccggtccctacccgaacccgaccgggcccaacggttcccggttacccttccccccgtgggcccgtccctcggtccctaccgacggacnccctacccgtacggacgacgaccaccgacggcccggtaccgtgggccgtccgaccgttcgggacgaaacggtaccttaccgttccgtacggtccggtaggtccgttaccggtacggtacggccgggtcgacgggacgacgggccgtacgcgtaacgtg

SEQ ID NO: 41008 - DNA, 946 bp, Homo sapiens
  misc_feature: GYAE6OF02I0LBA.2.86.H09.1.454.CMB.1.raw
tcagacgctcgacacacgaccggtgctcgatttagtgctatagacttggggtttgggggaggcttggtacagcctgggggggtccctgagactctcctgtgcagcctctggattcactttagtaactttgtcatgaggtcgggtccgcgaggcctaccgaagggaacggggcgtgggaggtgggtcctcgagtcttagtttggagttgggttcggtttcttggttccgtccccaacgacgtaccggtccggtccctaccgggtagggtaaccggggtccggtttaccaaccgtgttaccggaccgaaggaacggtaacctaaacgttaaaccgaaaaacctacggtctagtaccgttctcgtaacgtaaagtaccgaaacctaccgtaggaacggaacggaccggaacgggaccgtaaccggtcccgtaacttaccgtttaagttttacggttacggtacggtaacgggaaaccgggtaaggtaccggggttaaccgggggggcccgggtaccggggaacgggggtaccggtaaggtaaacgttccggtaccggttacccgggggtaccgggggtaccggggtaaccgggttaaccccggtacgggttacccggtacccgtttaaccggtcccttacccggaccccgttacccggttaaccccggaaacccggtacccgggtaccccgttaaccgggtttccccggtaccccgtttcccccggtcgggtccccgtacccgttcggtacccgtacggaccggtaccgacccgtaccgtccggacgtaccgaccgaccggtcccggaccggtcccggtaccggtcgtccgggaccgttaccgggtacgaccggttaccgtaccgtccgttaccggttcggaccggttccggacggtcgggtaccggaccgggttcgtacggacgggtaggcccggagtaccgagtcgg

SEQ ID NO: 41009 - DNA, 507 bp, Homo sapiens
  misc_feature: GYAE6OF01BXSNG.15.21.B10.1.454.CMB.1.raw
  modified_base (486)..(486): a, c, t, g, unknown or other
  misc_feature (486)..(486): n is a, c, g, or t
  modified_base (504)..(504): a, c, t, g, unknown or other
  misc_feature (504)..(504): n is a, c, g, or t
tcagtctacgtagccacgaccggtgctcgatttagtgtcgtcgcaagagaggaggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaagtggggtccacgaaggttcagcgcagtgaatctgggacagatttcactctcaccatcagcagcctgcagcctgaggtattttgactaacttactattgtacaacgaggtacttaactacgtttccctctctacgtttcggcggagggaccaagggtggatanacaaacgactgtgctgcncta

SEQ ID NO: 41010 - DNA, 743 bp, Homo sapiens
  misc_feature: GYAE6OF01AQ09E.15.21.B10.1.454.CMB.1.raw
  modified_base (107)..(107): a, c, t, g, unknown or other
  misc_feature (107)..(107): n is a, c, g, or t
  modified_base (234)..(234): a, c, t, g, unknown or other
  misc_feature (234)..(234): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
tcagtctacgtagccacgaccggtgctcgattttagtgtcgtcgcaagaggagaggggtccaggctggaacctgaggaggcaggtgggggcactttctcctctaacnctctcccccgactcagctccgtgggcctcctgcctgcctcttcggttcccaggtttccagactaggcgtacatccgagagtgacgcctaggtctccatccttcggagtcctgactatacgtggtagnacagagtcacctatcgacgttgcgggactagtcgtaaggtatgngagtcgtggtagctggtacncgaggccgaagaaaccgagggaacgtcccgtaaggtctccgtagtactacgtagttcggtactactacgttccgtaaggttttacgggaaacggttcggggtacccctaaacgtaacgggtttccgaaccggtccggtaacgtacggttacgaaacttcccggtaaggacctagtacgttttaccacgttcctacgaaccgtataccgacgtaccgtacgttcccgtagaccgtacgggtccgtaggtaacgggttctttacggtaacccttacgtttaccgttaagttcccggtaacaaccggttaacggtttacctaaaccggttcgtttcccccgtaggttaccgttaccggtttcggaaccggtaggttaacccggtaggttcgtaagtactaaccggaaacgtttacgtcggacggttacctccgtaccgttccttaacg

SEQ ID NO: 41011 - DNA, 794 bp, Homo sapiens
  misc_feature: GYAE6OF01ADU25.15.21.B10.1.454.CMB.1.raw
tcagtctacgtagccacgaccggtgctcgatttagtgtcgtcgcaagagaggaggggggtcaggctggaactgaggagcaggtgggggcacttctccctctaacactctccccgctcagctcctggggctcctgctgcttcgtggttcccaggttccaggtatgcgactatccagatgagccagtctccatcttccgtgtctgcagtctgtaggagacagagtcaccatcacttgtcgggcgagtcagggtattagcagtctggttagcctggtatcagcagaaaccagggaaacgccccgtaagcctaccgtgactcgtagtgggtgcgtaagtccgtaggttttacgggaaaggttcgggggtaccccaacgtaaagggtttcaacgggcggtacgaagtagtaattcgtagggaccaggttactttccaaccgttcctaccgaaccgtataccgacggtacctaacggtccccgtacggaccgtaacggtaccccgttagggaaacggtttacgttttttaccggaaccctttaaacgtttttaaccgtttaacgttttaaccggtaacccgtaaaaccggttaaccgggttaacccttaaaaccggtttaccccgttttttaccccgttaccttaccggtttaaacccggtttccgggggtaaccggggtaaacggggtaaccccgttaaagggggttacggttaaacgttaaccgttaacccggtaaaaaaccggttccgtttaacgggtacgggtaacccttacgggaacccgtaacccgttaaccgg

SEQ ID NO: 41012 - DNA, 746 bp, Homo sapiens
  misc_feature: GYAE6OF01C87YP.15.21.B10.1.454.CMB.1.raw
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
  modified_base (505)..(505): a, c, t, g, unknown or other
  misc_feature (505)..(505): n is a, c, g, or t
  modified_base (725)..(725): a, c, t, g, unknown or other
  misc_feature (725)..(725): n is a, c, g, or t
tcagtctacgtagccacgaccggtgctcgatttagtgtcgtcgcaagagaggagggggtcaggctggaactgaggagcaggtgggggcacttcctccctctaacactcctcccccgctcagcctccgtggggcctcctgctgctctcggttcccaggttccagtatcgcgaacactccagatgagccagtcctccattccgttccgtgtctgctatcgtaggtaaggagacgaagactaccaaccattctacgttggccgggagtacgtacggtaaggggttatacgcgtagtcgttacggttacgtaccgttaggtactacgaagaaccgaaacggaaaaccggaacggggaaaaccgtcccctaagtccctaccgtagtacttacgtaggtgacgtactacgttacgtaggttaaggaacgggtccggtacccaaacgtagggtacncgggacncgttaggagtacgtcggtacggaactagtacttacacgtacctacaacnctacgagacctcgacgtagactcggtacgtaggtacgtttacgtttacgaacctttaacgttaccgttactttaccgaacgtacgtaaccgtacttaaaccgtttcccttaccctacgttaacccgttacgtacccggggtacgggaacggtaacccggtaaaggtacgtaacgttaaaccgaaaccggttaacggttaaccggttggtaacccggttanaccgttaacctaccggttacc

SEQ ID NO: 41013 - DNA, 924 bp, Homo sapiens
  misc_feature: GYAE6OF01CBVBO.15.21.B10.1.454.CMB.1.raw
  modified_base (180)..(180): a, c, t, g, unknown or other
  misc_feature (180)..(180): n is a, c, g, or t
tcagtctacgtagccacgaccggtgctcgatttagtgtcgtcgcaagagaggagggggtcaggctggaactgaggagcaggtgggggcacttctccctctaacactctccccgctcagctcctggggcctcctgctgctcgtcggttcccgaggttccagatgcgacataccagatgacnccagtcctaccattccgttcgtgtctgctatcgtaggtacggaagtacgagtacgtaccaactataccgtacgttcgggtacgggtacgaggttaccgtagggttacttaggaccaaggttccgttaggttaccgtaccgttaggttaacacgaacggacgaaaaccggaaaccggaacggggaaaacctccccgtaagtccgtaccttgaacgtttctaggtcgggtacaccgtacgttaccggttaaagggtttaacgggaaccgggttccgggtaacccctaaggttaacgggttaccggaggtaccggtagtaacgggtacgaaccgggttgtaacgggaacgttaacgttctttaacccgaccttaccgtaaccctaacgtaccgtataaccgggaccgttaccgaccgttacgggaaccttacggggtacccgttaagggtttacgtttaaaccgttttacccgaaaccgttttaagtttaaccgtttacggttaacccgtaaacgttaaaaccccggttcgggttaaaacccctttttaaccccgtttccccgtttttaacccccgtttacggttaaccccggtttaaacgggtttacccgggggaaacccgggtaaaacgggttaaccggttaaaccgggggtaactttaaacgttaaacccggtaaaccgtaaaacgggtttcggttaaccggggttattaacccccggaacgttaacggttaccctttaccggg

SEQ ID NO: 41014 - DNA, 624 bp, Homo sapiens
  misc_feature: GYAE6OF02HN9KN.15.21.B10.1.454.CMB.1.raw
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
tcagtctacgtagccacgaccggtgctcgatttagtgtcgtcgcaagagaggaggggtcaggctggaactgaggagcaggtgggggcaacttctccctctaacactctccccgcttcagctcctggggctcctgctgctctgggttcccaggttccagactgcgacatccaggatgagccagtctccatcttcccgtgtcctgctatctgtagggagacaggacgttccacctatcacgttggtcggggcagtcgagggttattacgcagcctgggttagccgtggtatcgagcaggaaaccagggaaacnccccgtaaagcgtcctagatcgttagtgggtnacattcctaaggtttagggaaacgttcggggtacccacgtaaggttcaagcggtactagtgaagtcgtagggactagtactttcactctcctacatacagcgacgcctgcacgcctgagtactttgacgtaacttacttattcgtactaacgacgtacgtaaccgttacgtttccctacgtccgttacgttccgggacgggtaacgggtaccgtaagggtcggtaacttacgtaacgaaacggtacgttcgggtacggtaccgtacggaccgtaccgtacg

SEQ ID NO: 41015 - DNA, 580 bp, Homo sapiens
  misc_feature: GYAE6OF02GFDMM.15.21.B10.1.454.CMB.1.raw
  modified_base (431)..(431): a, c, t, g, unknown or other
  misc_feature (431)..(431): n is a, c, g, or t
tcagtctacgtagccacgaccggtgctcgatttagtgtcgtcgcaagagaggagggggtcaggctggaactgaggagcagggtgggggcacttctccctctaacactctccccgctcagctccgtggggctcctgctgctctcggttcccaggttccagatgcgacatccagatgagccagtctccatcttccgtgtctgcatctgtaggagacagagtcaccatcacttggtcgggcagtcgagggtattagcagctggttagcctggtatcagcaagaaaccgaagggaaacgcccctaagcctcctgatctagtggtgcatccgtaggtttaggaaaggtcggggtacccacgtaaggttcaggcggcaggtgaatcgtagggacagtactttcactctacaccatcagcagcctgcagcctgagttntttgacttaacttatattcgtacaacgaggtacttaactacgttttccctcttcctacgtttccgggacggtaacgggtaaccgtaagggtcggtaattaacgtaaccgtaaacgtacgttggtacggtaccgtacgacctaccgtacg

SEQ ID NO: 41016 - DNA, 712 bp, Homo sapiens
  misc_feature: GYAE6OF02JMFUB.15.21.B10.1.454.CMB.1.raw
  modified_base (248)..(248): a, c, t, g, unknown or other
  misc_feature (248)..(248): n is a, c, g, or t
tcagtctacgtagccacgaccggtgctcgatttagtgtcgtcgcaagagaggagggggtcaggctggaactgaggagcaggtgggggcacttctccctctaacactctcccgctcagctcctgggctcctgctgctctcggttccgtacggttccagatgcgacatccagatgagccagtctccactcttccgtgtctgcatcgtgtaggagacagagtacaccactctacttgtcggcgagtacgangggttagttacgtacaacggtacgttacgggtttaacggtacccgttacgggttaacgttaccgtaacggtaccgaaacggaaaaccggaaacggggtaaaaccggtaacccccgttaaaccggtaccgttacccgttacggtaacgttaccgttaacgttacgggttacggtaccgtaacgttaccgttaacggttttaacgggtaaaacgggttacgggggttaaccccgtaacccggtaaacgggttaccggtaacgggtaccgggtacggtaacggttacggtaaacgttacggttacggggtaacggtaacggtaacgtttaccgtaaccgttaccgtacctaacctaacgtacgtaacgtacgtaacgtaccgtacgtacgtacgtaccgtacggtacggttcgtaactacttacgtactaacgttacgtacttacgtacgtaacctacgtacgtacc

SEQ ID NO: 41017 - DNA, 883 bp, Homo sapiens
  misc_feature: GYAE6OF02GXJB2.15.21.B10.1.454.CMB.1.raw
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
tcagtctacgtagccacgaccggtgctcgatttagtgtcgtcgcaagagaggagggggtcaggctggaactgaggagcaggtgggggcacttctccctctaacactctccccgctcagctcctggggctcctgctgctctggttcccaggttccagatgcgacactccagatgacgccagtctccattcttccgtgtctgcattctagtagganacaggacgtcacatcgtacgttggtcgggngagtcgaaggtattagcagtcgttagggttaacgccgttaggtactacgaacgaaccgaaaaggaaaaaccggaacgggaaaacccgtaccccgttaaacggtacccttacccggtaaggtaaccttaccggttaaggttcgggtacgtaaccttaacgttaaccggtttaaaggtttaaggggaaaaccgggtttacccggggtaaccctaaacgggttaaaacgggttcgaacgggtccggtaagtaacggtaacgtaaacggttcgggtaacgggtaaacgtaacggtttacctttaacgtaaccctttaccgtaaccctaaccgtaacgtttacccgaaaccgtacgtaaaccggtccgttaacggaacccggaaccgtaccgggttaaaggttaaccggtttaaacgtttaccggttaaactttaaaaccgtttaacgtttaacgtaccgtaaaacgtaacccgttaaccgtaaaccgttttaaaccgtttccgttttaacccgttaccgtttaaccggttaaccgggtttacccggggaacggggtaacgggtaaccgggtaacggttaacggtaaactaaccggttaaccgaaacgttagttcggtaccgtacgtaccggacctacgttacg

SEQ ID NO: 41018 - DNA, 679 bp, Homo sapiens
  misc_feature: GYAE6OF02IUIVX.15.21.B10.1.454.CMB.1.raw
  modified_base (245)..(245): a, c, t, g, unknown or other
  misc_feature (245)..(245): n is a, c, g, or t
  modified_base (347)..(347): a, c, t, g, unknown or other
  misc_feature (347)..(347): n is a, c, g, or t
tcagtctacgtagccacgaccggtgctcgatttagtgtcgtcgcaagagaggagggggtcaggctggaactgaggagcagggtgggggcacttctccctctaacactctccccgctcagctcctggggctcctgctgctcgtggttcccaggttccagatgcgacatccaagatgacgcctagtcctccatcttccgtgtctgcatcgtggtaggagacagacgtcaccatcacgttggaccggngagtacgagggtaatacgcagcgttaggtacgtccgtaggtatcagacaacgaaaaccgaggtaaaccgtacccctaaagctacctagtactctaagtgggntacaagttccgtaaggtttacgggaaaggtacgggtacccaacggtaaggttccgaagcggtacgagtaggaatccggtagggaaactaggttactttacgaacctactacaacgatccgagaccacgcgtaacgcacgtaccgtaggtaagtaacgtttacgtaaccttaaagttaacttacttaggtaacccaagtacgtaacctaacgtttaccgtttccctacttaccgtcggtttaaccgggacgggtaacgggtaaccgtaacggtacggtaactaacgttaaccgaaagtaaccgtggtacgtccgtactaccgtaccttaacgg

SEQ ID NO: 41019 - DNA, 994 bp, Homo sapiens
  misc_feature: GYAE6OF02IA96Y.15.21.B10.1.454.CMB.1.raw
  modified_base (222)..(222): a, c, t, g, unknown or other
  misc_feature (222)..(222): n is a, c, g, or t
tcagtctacgtagccacgaccggtgctcgatttagtgtcgtcgcaagagaggagggggtcaggctggaactgaggagcaggtggggcacttctccctctaacactctccccgctcagctccgtgggctcctgctgctcgtcggttcccaggttccagatgcgacactccagatggacgccagtcctaccattccttccgtgtctgactatcgtagtaggganaacgagtacgtaccaccgtattacctacgttcggtacggggcctaaggtccgtaaagggttactttacggctaggtaccgttagggttaccgtacccggtaggttaccgtcgaacgccgaaaacgggaaaacccggtaaacggggtaaaacccgtcccccggttaaaaggtcccgtttacccggtacgtaaccgtttaccgttaaggttcggggttaccgtaacccgtaagtttaccccggttaaaggggttttaacggggtaaaccgggttcccggggttaaccccaaaccggttaacgggtttaccgagggacccggtacgtaacggttacgtaacgttccggtaaggggtacccgttaagtttaacgttttccaaccggtttaccctacgttaacccgtaacgtaaccgtacggtaacccgtacgtaccgtaccgtaccgtaccggttaccgttacgggtaacggtttaacgtttaccggaaaccgttttaaacgtttaccgtttaacgttaagggtttaacccgtaaaccggttaaccgtttaaccgtttaaaacccggttttaccccgtttttaaccccgttaaccggttttacccttaacccgggggtttttacccggggaccggggttaaaacccggggttaaccggtttaaaccgggggtaaaccggttacgttttaaacccggaaccgtttaaaaccgggtaacggttttaccgggtacccgggttaccggttaaccggtaccccgttttaaccggttacccg

SEQ ID NO: 41020 - DNA, 681 bp, Homo sapiens
  misc_feature: GYAE6OF02F7D6N.15.21.B10.1.454.CMB.1.raw
  modified_base (431)..(431): a, c, t, g, unknown or other
  misc_feature (431)..(431): n is a, c, g, or t
  modified_base (677)..(677): a, c, t, g, unknown or other
  misc_feature (677)..(677): n is a, c, g, or t
tcagtctacgtagccacgaccggtgctcgatttagtgtcgtcgcaagagaggagggggtcaggctggaactgaggagcaggtgggggcacttctccctctaacactctccccgctcagctccgtgggctcctgctgctctggtcccaggttccagatgcgacatccagatgagccagtcctacattcttccgtgtctagcatcgtagtaggaactagagtaccacatccacgttggcgggcgtagggtcgggtaattcgacgtagtcgttggttacgccgttggtatacgagtaccgaaggaaaaccgaacgggaaaccgtaccccgtaaagccgttaccttagacttacgtaagttcgggtcactactccggtaaggtttacggggaaaacggttccggggacctaaacggtaaggttccgaggaccggntaagtacggtaagtcgtaagggaactacgtaacgtttacaccgttaccacctaacctactcgaacggtacgtaaccgtccgtaagcccgtaacggtcgtacggtaaggtttactttaggaccttaaacgtttactagttacgaacgacgtaagtaccttaacgtccgtttacctcgtacgttagttcgggacggacgtaacgtagggctaataacgtactaaacgcgtggtcgatacgcttacgtnttcg

SEQ ID NO: 41021 - DNA, 820 bp, Homo sapiens
  misc_feature: GYAE6OF02GO7L3.15.21.B10.1.454.CMB.1.raw
  modified_base (442)..(442): a, c, t, g, unknown or other
  misc_feature (442)..(442): n is a, c, g, or t
tcagtctacgtagccacgaccggtgctcgatttagtgtcgtcgcaagagaggagggggtcaggctggaactgaggagcaggtgggggcacttctccctctaacactctccccgctcagctcctggggctcctgctgctctggttcccaggttccagatgcgtacatccagatagagccagtcctccatccttccgtgtctgacatcgtggtaggagaccagagtccaaccatctacgttgggtcgggcgtagtcgtaggggttattacgacgagtcgttaggttacgtccgttaggtatcgagcaacgaaacgacgggaaacgtccccgtaagcctaccgtgactcttaacggtggtcgacgtagttaccgtaaggtttacgggaaaggtccggggtacccaacgtaagggtttcacggccggtacgtacgtagacttcggngggaactacgttactttaccgtacttcctacctacccgtaataccagggtacctaccggtccgttacgaccgtaccggtaccggttacgggtacgtttacgttttaccgaaaccgtttaaaccgttttaaaccgtttacggttaaccgaaacccgttaaccgggtaacggtaacccgtttaaacccgttttaccgttttccccccgttaacttacccggtttacccgggttaccggggtacggggaacccgggtttaaccggttaacgggggttaacggtaaacccgtttaaccggtaaaacccggttaaaaccggttacccgggtttacgggttaacccggtccgtttaaccgggacccttaaccgggtttaacccg

SEQ ID NO: 41022 - DNA, 509 bp, Homo sapiens
  misc_feature: GYAE6OF01B8J1R.41.27.C05.1.454.CMB.1.raw
  modified_base (503)..(503): a, c, t, g, unknown or other
  misc_feature (503)..(503): n is a, c, g, or t
tcagtctatactatcacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccagtaaacgccccaaactcatcatctatgagcctataagagccctcagggtttctaatcgcttcactgcctcaagtccgcaacacggcctcctgacaatctctgggctccgaggctgaggacgagctgattattattgttgctcagtatgttcgtcgctatctacttatgtcttcggaagtgggaccaggtcaccgtctaggtcacgcccaacgcccaaccccatgtcntcgtcg

SEQ ID NO: 41023 - DNA, 330 bp, Homo sapiens
  misc_feature: GYAE6OF01BEMJ7.41.27.C05.1.454.CMB.1.raw
  modified_base (323)..(330): a, c, t, g, unknown or other
  misc_feature (323)..(330): n is a, c, g, or t
tcagtctatactatcacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcacgtggagccagcggtcacgcccaaggcccaaccccatcgtcactctcgttccccgccctcctactatactactgtctggacgcgggctggacaacggcgcatagnnnnnnnn

SEQ ID NO: 41024 - DNA, 560 bp, Homo sapiens
  misc_feature: GYAE6OF01DAQS1.41.27.C05.1.454.CMB.1.raw
tcagtctatactatcacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaagtaaacgcccccaaatcatcatctatgagcctataagacggccctgagggtttcaatcgcttcactgcctccgaagtccgacaacacggcctccctgaacatctctgggctccaggtctggaggacgaggctgtatttattattgttcgcttcagtacttgtttcgtcgctaacttctacttatgttacttacgggaaggttcgggacctaaaggtccaccggttcgtaaggtccacggaccccaaaggcccctaaaccccactacgtccaccgttctacccg

SEQ ID NO: 41025 - DNA, 589 bp, Homo sapiens
  misc_feature: GYAE6OF02GEX9C.41.27.C05.1.454.CMB.1.raw
  modified_base (283)..(283): a, c, t, g, unknown or other
  misc_feature (283)..(283): n is a, c, g, or t
tcagtctatactatcacgaccggtgctcgatttagacgcgatcgaagggtttggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtctgggggaggattggcacagcctggggggtccctgagactctcctgtgcagcctctggcttcccctttaggngctatgccatcgaccgtgggtccgccaggcctccgagggaaggggctcggagtcgggtctcgacaattggcgctagtgcaactgacacatacgtacggagacgtccgtggaacgggccgcttcaccatcctccagacgacaacttaccgaaaccactacttttcgaggtaaatgaacacgcctgacggagtacgaagaccaccggtccctttatttctgtcggacgaagggaggggggacgtggacgtccgagtaggtgggtgggtcggttacacggtccgtcggggacctacggggagtccccgg

SEQ ID NO: 41026 - DNA, 615 bp, Homo sapiens
  misc_feature: GYAE6OF02HP8K2.41.27.C05.1.454.CMB.1.raw
  modified_base (190)..(190): a, c, t, g, unknown or other
  misc_feature (190)..(190): n is a, c, g, or t
  modified_base (325)..(325): a, c, t, g, unknown or other
  misc_feature (325)..(325): n is a, c, g, or t
  modified_base (344)..(344): a, c, t, g, unknown or other
  misc_feature (344)..(344): n is a, c, g, or t
tcagtctatactatcacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcaccatcctcctgcacgtggacgccagacggtaatattcttagtctttaactttgtcttcctggtatcaactatcactccaaggtaaaccgaccccctaaactcatcatctatgacgctanagacgcctgtagggtttcnggtcgtcttcgtctggctctaagtctcggcaacgcgcctccctcgaccatctcgtggcctcgcggtcgtggacggtacggacggtctaggtacttagttaccgtgactcgtctactaaataaattaaaacgaacgtaccaactacttagttaattacggtacggaacgggtacggtaaccgagtccgtaccggtaccggttacgtcggtaccgaacccgaccggtaacggcccgtcccggtcccccggtacgtacccgtacgtttccccgg

SEQ ID NO: 41027 - DNA, 370 bp, Homo sapiens
  misc_feature: GYAE6OF02JVLEC.41.27.C05.1.454.CMB.1.raw
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (314)..(314): a, c, t, g, unknown or other
  misc_feature (314)..(314): n is a, c, g, or t
  modified_base (322)..(370): a, c, t, g, unknown or other
  misc_feature (322)..(370): n is a, c, g, or t
tcagtctatactatcacgaccggtgctcgatttagacgcgatcgaagggtttgggggggggtcacaagaggcagcgctctcgggacgtctccaccatgcctgggctctgctgctcctcactctcctcacccaggacacagggtcctgggccccagtctgccctgactcagcctgcctccgtgtctgggtccncctggacngtcgtcaccntctcctgcactggcnccngcgtcacgcccagcccaacccntcgcactctcgtccccacctctctatatctgtctgacgccgggtctcggcaagggccgtactanaggctgcnnnnnnnnnnnnnnnnnnnnnnnnnnnnnnnnnnnnnnnnnnnnnnnnn

SEQ ID NO: 41028 - DNA, 152 bp, Homo sapiens
  misc_feature: GYAE6OF01CGQ2M.1.80.H03.1.454.CMB.1.raw
  modified_base (152)..(152): a, c, t, g, unknown or other
  misc_feature (152)..(152): n is a, c, g, or t
tcagacgagtgcgtcacgaccggtgctcgatttagctgtgcgtcgtcgcgggggaccaaggtggagatcaaacgaactgtggatgcaccatctgtcttcatcttcccgccatctgaacgcactcgtctgagcgggctggcaaggcgcatagn

SEQ ID NO: 41029 - DNA, 153 bp, Homo sapiens
  misc_feature: GYAE6OF01D6U4P.1.80.H03.1.454.CMB.1.raw
  modified_base (152)..(153): a, c, t, g, unknown or other
  misc_feature (152)..(153): n is a, c, g, or t
tcagacgagtgcgtcacgaccggtgctcgatttagctgtgcgtcgtcgcgggggaccaaggtggagatcaaacgaactgtggctgcaccatctgtcttcatcttcccaccctcctcacgcactcgtctgagcgggctggcaaggcgcatagnn

SEQ ID NO: 41030 - DNA, 180 bp, Homo sapiens
  misc_feature: GYAE6OF01DXPMB.1.80.H03.1.454.CMB.1.raw
  modified_base (152)..(155): a, c, t, g, unknown or other
  misc_feature (152)..(155): n is a, c, g, or t
  modified_base (157)..(158): a, c, t, g, unknown or other
  misc_feature (157)..(158): n is a, c, g, or t
  modified_base (160)..(160): a, c, t, g, unknown or other
  misc_feature (160)..(160): n is a, c, g, or t
  modified_base (162)..(180): a, c, t, g, unknown or other
  misc_feature (162)..(180): n is a, c, g, or t
tcagacgagtgcgtcacgaccggtgctcgatttagctgtgcgtcgtcgcgggggaccaaggtggagatcaaacgaactgtggctgcaccatctgtcttcatcttcccgccatctgaacgcactcgtctgagcgggctggcaaggcgcatagnnnngnngnannnnnnnnnnnnnnnnnnn

SEQ ID NO: 41031 - DNA, 204 bp, Homo sapiens
  misc_feature: GYAE6OF01BIFHY.1.80.H03.1.454.CMB.1.raw
  modified_base (151)..(204): a, c, t, g, unknown or other
  misc_feature (151)..(204): n is a, c, g, or t
tcagacgagtgcgtcacgaccggtgctcgatttagctgtgcgtcgtcgcggggggaccaaggtggagatcaaacgaactgtggctgcaccatctgtcttcatcttcccgcatctgaacgcactcgtctgagcggctggcaaggcgcatagnnnnnnnnnnnnnnnnnnnnnnnnnnnnnnnnnnnnnnnnnnnnnnnnnnnnnn

SEQ ID NO: 41032 - DNA, 152 bp, Homo sapiens
  misc_feature: GYAE6OF01EPEE5.1.80.H03.1.454.CMB.1.raw
  modified_base (152)..(152): a, c, t, g, unknown or other
  misc_feature (152)..(152): n is a, c, g, or t
tcagacgagtgcgtcacgaccggtgctcgatttagctgtgcgtcgtcgcgggggaccaaggtggagatcaaacgaactgtggctgcaccatctgtcttcatcttcccgccatctgaacgcactcgtctgagcgggctggcaaggcgcatagn

SEQ ID NO: 41033 - DNA, 153 bp, Homo sapiens
  misc_feature: GYAE6OF01AO2T3.1.80.H03.1.454.CMB.1.raw
  modified_base (152)..(153): a, c, t, g, unknown or other
  misc_feature (152)..(153): n is a, c, g, or t
tcagacgagtgcgtcacgaccggtgctcgatttagctgtgcgtcgtcgcgggggaccaaggtggaagtcaaccgaactgtggctgcaccatctgtcttcatcttcccgccatctgaacgcactcgtctgagcgggctggcaaggcgcatagnn

SEQ ID NO: 41034 - DNA, 152 bp, Homo sapiens
  misc_feature: GYAE6OF02GKTS5.1.80.H03.1.454.CMB.1.raw
  modified_base (151)..(152): a, c, t, g, unknown or other
  misc_feature (151)..(152): n is a, c, g, or t
tcagacgagtgcgtcacgaccggtgctcgatttagctgtgcgtcgtcgcggggaccaaggtggagatcaaacgaactgtggatgcaccatctgtcttcatcttcccgccatctgaacgcactcgtctgagcgggctggcaaggcgcatagnn

SEQ ID NO: 41035 - DNA, 566 bp, Homo sapiens
  misc_feature: GYAE6OF02JQRMI.1.80.H03.1.454.CMB.1.raw
  modified_base (151)..(151): a, c, t, g, unknown or other
  misc_feature (151)..(151): n is a, c, g, or t
  modified_base (499)..(499): a, c, t, g, unknown or other
  misc_feature (499)..(499): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagacgagtgcgtcacgaccggtgctcgatttagctgtgcgtcgtcgcggggaccaaggtggagatcaaacgaactgtggctgcaccatctgtcttcatcttccacctcctcacgcactcgtctgacgcggctggcaaggcgcatacgcncgcgcgcgcgcgcgcgcgcgcgcgcgcgtcgtcgcgtcgcgtcgcgtcgcgcgtcgcgtcgcgcgtcgcgcgcgcgcgacgcgcgtctacgcgtcgcgtacgcgacgtcgtcgcgtcgcgtacgtcgcgacgtcgtacgcgtcgtccgcgcgtacgcgacgtaccgcggtacgcgtccgacgtcggacgtacgtcggacgtcggacggtcgaccgtacgtacggaccgtacggtacgtccggtacgttacggccgtaacggtcggtaccgcggtaccgtaacgggtcgacggtacgtccggaacgttcggtaaccgcgttacggacgtcgcgtcgcggtactcggacnggacgtcgctacgngtacgngacgcgtcaacgggctacgccgtgtcgcacggctcggacgcgacgcg

SEQ ID NO: 41036 - DNA, 146 bp, Homo sapiens
  misc_feature: GYAE6OF02HJ6C0.1.80.H03.1.454.CMB.1.raw
  modified_base (146)..(146): a, c, t, g, unknown or other
  misc_feature (146)..(146): n is a, c, g, or t
tcagacgagtgcgtcacgaccggtgctcgatttagctgtgcgtcgtcgcgggaccaaggtggagatcaacgaactgtggctgcaccatctgtcttcatcttccgcctcctcacgcactcgtctgagcggctggcaaggcgcatagn

SEQ ID NO: 41037 - DNA, 151 bp, Homo sapiens
  misc_feature: GYAE6OF02G8OWP.1.80.H03.1.454.CMB.1.raw
tcagacgagtgcgtcacgaccggtgctcgatttagctgtgcgtcgtcgcgggggaccaaggtggagatcaaacgaactgtggctgcaccatctgtcttcatcttcccgccatctgaacgcactcgtctgagcgggctggcaaggcgcatag

SEQ ID NO: 41038 - DNA, 152 bp, Homo sapiens; identical to SEQ ID NO: 41032
  misc_feature: GYAE6OF02GZN6G.1.80.H03.1.454.CMB.1.raw
  modified_base (152)..(152): a, c, t, g, unknown or other
  misc_feature (152)..(152): n is a, c, g, or t

SEQ ID NO: 41039 - DNA, 172 bp, Homo sapiens
  misc_feature: GYAE6OF02JJM7V.1.80.H03.1.454.CMB.1.raw
  modified_base (148)..(148): a, c, t, g, unknown or other
  misc_feature (148)..(148): n is a, c, g, or t
  modified_base (153)..(172): a, c, t, g, unknown or other
  misc_feature (153)..(172): n is a, c, g, or t
tcagacgagtgcgtcacgaccggtgctcgatttagctgtgcgtcgtcggcgggggaccaaggtggagatcaaacgaactgtggctgcaccatctgtcttcatcttcccacctcctcacgcattcgtctggagcgggctggacaaggcnatagnnnnnnnnnnnnnnnnnnnn

SEQ ID NO: 41040 - DNA, 540 bp, Homo sapiens
  misc_feature: GYAE6OF01DQV5L.36.85.H08.1.454.CMB.1.raw
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
tcagtacgctgtctcacgaccggtgctcgatttagtatcactcagtcgggctgaaatgaagagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgattttggactggtgaatacaaggggtttcgacccgtggggccagggaaccctggtcaccgtctcctcagcctccaccaagggccccatcggtcttccccctggccacccctcctccaacgacgccaccctcgtcgggggcaccgacgccggccctgggcctcgcctggtccaaggactacgttccagacngcgtacngacgcgggntggcaggcg

SEQ ID NO: 41041 - DNA, 513 bp, Homo sapiens
  misc_feature: GYAE6OF01EBB6O.36.85.H08.1.454.CMB.1.raw
  modified_base (506)..(506): a, c, t, g, unknown or other
  misc_feature (506)..(506): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaaacaaaaagctggccaggctcccaggctcctcatctatgatgcttccaaaagggcccctggcatcccaacaggttcagtgccagtgggtctgggacagacttcactctcaccatcagcagcctagagcctgaagtattttgctacttttatactgtacaacagcgtaccaactggcggtacgttcggaccaagggaccaaggtcgaaggtcaaacgactgtgctgcacagtctgtcttcatctcccgcatcngagcacg

SEQ ID NO: 41042 - DNA, 528 bp, Homo sapiens
  misc_feature: GYAE6OF01B2V4S.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttagcctggtatcaacaaaagctggccaggctcccaggctcctcatctatgatgcttccaaaagggcccctggcactcccaaccaggttcagtgccagtgggtctgggacagacttcactctcaccatcagcagcctagacgcctagaagtattttgcttactttattactgtacaactagtcgtaccaacgtggcggtacgttcggacgaagggaccaaggtcgaaggtaccaaacgactgtggctgccacagtctgtcttcatccttcccgccatctgaagcacg

SEQ ID NO: 41043 - DNA, 533 bp, Homo sapiens
  misc_feature: GYAE6OF01C71JG.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgatttttggactggtagaatacgaagggttcgacccgtggggccagggaccctggtcaccgtctcctcagcctccaccacggcccatcgtccttcccctggccaccctcctccaagacgcacctcgtcgggggcacgagcggccctgggctcgccgtggccgaagctacttccagacacgcgtacgtgacgcggctggcgaacgg

SEQ ID NO: 41044 - DNA, 631 bp, Homo sapiens
  misc_feature: GYAE6OF01DHTWY.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagaacaacgtattttggacttggtagaagtacgtaaggggttccgaccccgtggggaccgacgggtaacccgtggtaccaccgtctccctcacgccctacccgaacccgaacgggcccctacgttcccggttaccctttccccccgtcgggtcccctaccccgtcccttacccgaacgaccgcctaacccgtcggtcggggacctacgaccggccggccccgtgggacctcggcccgtgggtaccaaacggtacctaccgttcccgagaccgacgtccgtactcggacggccgggcgtcgggcgaagggccg

SEQ ID NO: 41045 - DNA, 600 bp, Homo sapiens
  misc_feature: GYAE6OF01CLOUV.36.85.H08.1.454.CMB.1.raw
  modified_base (393)..(393): a, c, t, g, unknown or other
  misc_feature (393)..(393): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctccagataccaccggagaaattgtgttgacacagtctccagccaccctatctttgtctccgaggggaagagccaccctctcctgcagggccagccagagtgttagtacaaaacttgcctggtatacaaacaaaaagctaggccaggctccaggctcctcatctatgatgcttacgaaaacggcccctaggccatcccaaccaggttcagtgccagtgggtctgggacagacttcactctcacatcagcagctagagctagaatntttgactactttatactgtacaacacgtcgtaaccaactgggacggtacgttacgggaccgtaaacgggaccgaagggtaccgaagggtaaccgaaacgaacgtggtacggctacggacctaaccgtacgtaccgttggttacctttcctaccgttacccgtttccccgacccttaacttaccgttacggaaaggtacgtaaccggg

SEQ ID NO: 41046 - DNA, 506 bp, Homo sapiens
  misc_feature: GYAE6OF01AWBC8.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacgcagtttccagacaccctgtctttgtctccaggagacagagccaccctctcctgcagggccagtcagagtatcagaagcgactacgtagcctggtaccggcagaaacctggccaggctccagtctcctcatctatgatgcatccagtagggccgctggcatcccagacaggttcagtggcagtgggtctgggacagacttcacgctcaccatcagcagactcggacccctgaagtattttgctagtctattactgtcagcagtataggtaatacgtacctcggtacgttccggacaacgggacgaaggtagaatacgaagactggtgcgtgcacatctgtctctac

SEQ ID NO: 41047 - DNA, 523 bp, Homo sapiens
  misc_feature: GYAE6OF01BOCB4.36.85.H08.1.454.CMB.1.raw
  modified_base (514)..(514): a, c, t, g, unknown or other
  misc_feature (514)..(514): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggagagccaccctctcctgcagggccagccagagtgttagcaaaacttgcctggtatcaaacaaaagctggccaggctcccaggctcctcatctatgatgcttccaaaaggcccctggcatcccaacaggttcagtgccagtggtctggacagacttcactctcacatcagtcagcctagacgcctagaatatttgactactttatactgtacaactacgctaaccaacgtcggcggtacgttccggaccgaaagggaccaaggtcgaaggtacaaacgtactcgtagctgcaccatctgtcttcacttctcccgtcactntgagctacg

SEQ ID NO: 41048 - DNA, 512 bp, Homo sapiens
  misc_feature: GYAE6OF01B42T1.36.85.H08.1.454.CMB.1.raw
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagccaccctctcctgcagggccagccagagtgttagtcaaaacttgcctggtatcaaacaaaaagctggccaggctcccaggctcctcatctatgatgcttccaaaagggcccctggcacgtcccaaccaggttcagtgccagtgggtctgggacagacttcactctcaccatcagcagcctagacgcctgaagtattttgctactttatactgtacaacagctaccactggcggacgttcgaccaagggaccaaggtcgaggtcaaacgactgtggctgcacatctntctcntctcccgcatctgaagcacg

SEQ ID NO: 41049 - DNA, 618 bp, Homo sapiens
  misc_feature: GYAE6OF01C7J3M.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagttacatgaactgaacagtctgagctccgaggacacggccgtatacttactgtcgacgagagacaacgtatttttaggactgggtagaagtaacgaagggttcgacccgtgggccgagggaaccctggtcaccgtctcctcgacgcctccaccgaacgggcccaacgtccggttacctccccccgtggcctaccccctccctacccaacgacgccgacctccgtcgggggccaccgacgccggcccgtcgggccgtcgtcccgtcggtaccgaaacggtacccgttaccgttacccacggtaccaccggtccggttaaccgtcggtaacggccggggccttgggcccgaaacgggg

SEQ ID NO: 41050 - DNA, 608 bp, Homo sapiens
  misc_feature: GYAE6OF01B02RT.36.85.H08.1.454.CMB.1.raw
  modified_base (154)..(154): a, c, t, g, unknown or other
  misc_feature (154)..(154): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgngttgacacagtctccagccaccctatctttgtctccaggggaagagccaccctctcctgcagggccagccagagtgttagtcaaaaacttgcctggtatcaacaaaaagctggccaggctccaggctcctcatctatgatgcttccaaaagggcccctggcactcccaaccaggttcagtgccagtgggtctgggacagacttcactctacaccatcagcacgcctagactcctgaagtattttgctacttttagtactgtacaactacgtcgtaaccaacgtcggcggtacgttaccgggaccgtaaacgggaccgtaaagggtcgtaaggttaccgaaaacggtaacgttggtacggactacggacctaaccgacgtttccgttaggttccctttacaacgtttcccgttacccccgccctacttaccttacggaaacgtaaccgtaacggg

SEQ ID NO: 41051 - DNA, 585 bp, Homo sapiens
  misc_feature: GYAE6OF01D9SJF.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactagaacagtctgagctccgaggacacggccgtatattactgtgcgagagacaacgtattttggacttggtagaagtaacgtaaggggttccgtaccccggtggggccgacgggtaacccgtcggtccgaccgtcctccgtcacgcctaccaccgaacgggcccagtccgtccttccccgtgcccaccctcctccaagacgccacctcgtcggggccacgcgccggccgtcggcgtcgcctggtaccgaacggtacctaccgttaccagccgacgtccgttacgtcggacggccgggcgtgggcgaacggg

SEQ ID NO: 41052 - DNA, 569 bp, Homo sapiens
  misc_feature: GYAE6OF01CE3ME.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaacaaaagctggccaggctccaggctcctcatctatgatgcttaccaaaaggcccctggcatcccaaccaggttcagtgccaggtggtcgtggacagacttcactctcacctatcagcagcctagacgcctagaagtattttgactaactttattactgtacaactagccgtaaccaacgtgggacggtacgtttccgggaccaaagggaccgaaggtacgaacgggttacaaacgtaactggtacgggcttaggcctaaccgagttccgtgttaccttctacgttccttccccgctacgttctagaacgctacgg

SEQ ID NO: 41053 - DNA, 857 bp, Homo sapiens
  misc_feature: GYAE6OF01C9798.36.85.H08.1.454.CMB.1.raw
tcagtacgctgtctcacgaccggtgctcgatttagtatcactcagtcggcgggggaggaactgctcagttaggacccagagggaaccatggaacgccccagctcagcttctcttcctcctgctactctggcctcccagatacccgaccggaagaaattgtgttgacacagtctccagccaccctatctttgtctaccgaggggaagacgcccaccctctcctgcagggccagccagagtgttagtacaaaacttagccgtggtatacaaaacaaaaagcgtaggaccgaggcctcccgaggtcctcctacactctatgatcgacctttaaccgaaaaccggggtcccctcggaccacttaccccgaaaccgtacggtttaccaacggtcggacccgtaagggttcgggtacgtcggggtaacctaacggtaccttcctaacgttaccttacccaacctaaactcgaaacgtccaacgtaccctaaggacgtacccgttaaggtaaacgtttactttttacggtaccttaacgttttttaacttaaccgttacggttaaccctaaaccgtaacggtaaccccgtttaaaccccgaaacgggttccgggggtaacccggttaaccgggttttacccgggaacccggaaaaccgggggtaacccgtaaacggggttaccgggtaaaccgggttaaaccgaaaaccggttaacgttaggggttaccggtacccgttacggaccccgttaaacccgtacgtttacccgttacggtttcccttttaaccgacccgttttccccgttaaccccgtaccccgttaactttacccggttaacggaaacggtacccgttaaaccggg

SEQ ID NO: 41054 - DNA, 519 bp, Homo sapiens
  misc_feature: GYAE6OF01BKYEW.36.85.H08.1.454.CMB.1.raw
  modified_base (335)..(335): a, c, t, g, unknown or other
  misc_feature (335)..(335): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagccaccctctcctgcagggccagccagagtgttagtcaaaacttgcctggtatcaaacaaaaagctggccaggctcccaggctcctcatctatgatgcttccaaaagggcccctggcatcccaaccagttcagtnccagtgggtctggacagacttcactctcaccatcagcagcctagacgcctgaagtattttgctacttttatactgtacaacagcgtaaccaacgtgggacgtacgttcggaccaagggaccaaggtcgaggtacaaacgactgtagctgcacatctgtcttcattctcccgcatctgagctacg

SEQ ID NO: 41055 - DNA, 722 bp, Homo sapiens
  misc_feature: GYAE6OF01EFR4J.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagccaccctctcctgcagggccagccagagtgttagtacaaaacttgcctggtatcaaacaaaaagctggccaggctcccaggctcctcatctatgatgcttaccgaaaacggggcccctgggccactccccaaaccagggtttaccagttcgccgtaaggtcgggtcgtaggggacacggtaccttcacttcctaccaaccattaccacgtaccaacggccctaaggacgtacccgtagtaaagttatttttgaccttaactttttagttaaccttgtaaccaactacgtaccgttaaccccgtaaacgtcggggtaccgggtaacccggtttccgggaacccgaaacgggggtaacccaaaggggttaccggtaacgggttaaccaaaaccgggtaacgtacgggttacgggaccgttacggcccaaccgtaacgttccgttacggtttacccttaccgtacctttccccgttaccccccgtacctaaccttacccgtaaggtaaaccgtacgtaaacggg

SEQ ID NO: 41056 - DNA, 606 bp, Homo sapiens
  misc_feature: GYAE6OF01BMGT2.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaaacagctaccaataaacacagtttacatggaactgaacagtctgagctccgaggacacggccgtatattactgtgcgagagacaacgtattttggactggtagaagtacgtaacgggttccgacccgtggggaccgacgggaacccgtggtccaccgtctcctcgacgcctccgaccgaacggcccacgtccgtcccttcccccgtcggccctacccctcctacccgaacgacgccaccgtcgtcgggggccaccgacgccggcccgtcgggcctcggcccgtcggtaccgaacggtacctaccgttccaacgaccgacggtaccgtacgtcggacgggaccgggcgtcgggcgtaacggg

SEQ ID NO: 41057 - DNA, 572 bp, Homo sapiens
  misc_feature: GYAE6OF01EIHAV.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagccaccctctcctgcagggccagccagagtgttagtcaaaacttagcctggtatcaaacaaaaagctggccaggctcccaggctcctcatctatgatgcttccaaaagggccctggcatcccaacagttcagtcgccagtgggtctgggacagacttcactctcaccatcagcagcctagacgcctagaagtattttgcttagttttatacttgtcagctaagttataagtgacgaggccgttaccgggtaacgttttcgggccggtaggggggtaccaaggccgtagggaacggtactacgaaaacgtacgtggtggcttagacctacctattacgtcgttcctttacaatttcccgttccccgctaaccg

SEQ ID NO: 41058 - DNA, 535 bp, Homo sapiens
  misc_feature: GYAE6OF01ACLGZ.36.85.H08.1.454.CMB.1.raw
tcagtacgctgtctcacgaccggtgctcgatttagtatcactcagtcgcgggaggagcagtacaacagcacgtaccgtgtggtcagcgtcctcaccgtcctgcaccaggactggctgaatggcaaggagtacaagtgcaaggtctccaacaaagccctcccagccccccatcgagaaaaccatctccaaagccaaagggcagccccgagaaccacatctgtcctctagagaaaaccctgtgagcacagctcctcaccatggactggacctggaggatcctcttcttggtggcagcagctacaagtcgcccactcccaggtgcaactggtgcagtctggggctagaaatgaagaagccgtggggcctcgagtggaaggtgtcctgcaagacttcgagtactactaccttcactagtttatgtaatactaacgtggtgcgacgaggccaacgaggacgaagggcttaggagtgggagtgggagtgggtagtacccgttagtaggtggtgacgagagtattagtagctagagtaacgg

SEQ ID NO: 41059 - DNA, 526 bp, Homo sapiens
  misc_feature: GYAE6OF01CL9ZY.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccacctctcctgcagggccagccagagtgttagtcaaaacttgcctggtatcaaacaaaaagctggccaggctccaggctcctcatctatgatgcttaccgaaaacgggcccctggcactacccaacctaggttcagtcgccaggtgggtctggacagacttcactctcaccatcagcagcctagacgcctagaagtattttgactaacttttatactgtacaacagcgtaaccagtggcgtacgttcggaccaagggaccaaggtcgaggtacaaacgactggtgctgcacatctgtcttcactccttcccgctatcagagcacg

SEQ ID NO: 41060 - DNA, 590 bp, Homo sapiens
  misc_feature: GYAE6OF01DPK3Q.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagttttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagaacaacgtattttggacttggtagaataacgaaggggttccgacccgtggggacccacgggaaccctcggtccaccgtctcctctacgccctacccaaccgaacgggcccctacgtccggtccttccccctcggcctacccctccctaccaacgcgccgacctcgtcggggacacgacgcggcccgtgggctcgccgtcggtacgaacggtacctacgttacccagacgacggtacgtacaggtacggcggcgtggccgagggacccg

SEQ ID NO: 41061 - DNA, 547 bp, Homo sapiens
  misc_feature: GYAE6OF01A9206.36.85.H08.1.454.CMB.1.raw
  modified_base (521)..(521): a, c, t, g, unknown or other
  misc_feature (521)..(521): n is a, c, g, or t
  modified_base (538)..(538): a, c, t, g, unknown or other
  misc_feature (538)..(538): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgattttggactggtgaatacgaaggggttcgacccgtggggccagggaaccctggtcaccgtctcctcacgcctccaccaacgggccccagtccggtccttccccctggcctaccctccctccaacgcgccaccctcgtcggggccaccgacgccggccctgggcctcgcctggtccaggacctacgtccagacncgcgtactgacgcgggntggcaggcg

SEQ ID NO: 41062 - DNA, 611 bp, Homo sapiens
  misc_feature: GYAE6OF01CDNYR.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgtatttttggactggtagaatacgaaggggttccgacccgtggggccagggaaccctggtccaccgtctcctcacgcctccgaccaacgggccccagtccggtccttcccccgtggccctacccctcctccaacgacgccacctcgtcggggaccacgacgccggcccgtcgggccttcggcccgttcggtccgaaacgggtaccttaccgttcccgaggacctacggtacccggttaacttcgggaacggcccggggacgttacggggccgaaagggtccccgg

SEQ ID NO: 41063 - DNA, 679 bp, Homo sapiens
  misc_feature: GYAE6OF01C6BED.36.85.H08.1.454.CMB.1.raw
  modified_base (198)..(198): a, c, t, g, unknown or other
  misc_feature (198)..(198): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatcttgtctccaggggaagngccaccctctcctgccagggccagccagagtgttagtcaaacttgcctggtatcaacaaaagctggccaggctcccaggctcctcatctatgatgcttccgaaagggcccctggcactcccaacaggttcagtgccagtcgggtctgggacagacttcactctcaccatcagccagcctagacgcctagtaagtattttgactaactttttattaaccgtgttaccaaaccgtaggtacccgttaacccgaaacgttcggggaccgggtaccggtttccgggacccgaaacgggggtaaccccaaaggggttacccggaacgggtttaccgaaaaccggtaacgttgggttacgggccgttacggacctaacccgtaagtttcccgttacgggtttacccttttacccgtaaccgtttcccgttttacccccccgacccgttactttaccccggttaaggaaacccgtacgtaaacccggg

SEQ ID NO: 41064 - DNA, 567 bp, Homo sapiens
  misc_feature: GYAE6OF01D0D85.36.85.H08.1.454.CMB.1.raw
  modified_base (200)..(200): a, c, t, g, unknown or other
  misc_feature (200)..(200): n is a, c, g, or t
tcagtacgctgtctcacgaccggtgctcgatttagtatcactcagtcgcgggggaggaactgcttcagttaggacccagagggaaccatggaagccccagctcagcttctcttcctcctgctactctggctcccagataccaccggagaaattgtgttgacacagtctccagccaccctatctttgtctccaggggaagngccaccctctcctgcagggccagccagagtgttagtcaaaacttgcctggtatcaacaaaaagctggccaggctcccaggctcctcatctatgatgccttaccgaaaacgggcccctggccactccccaaacctaggttccaaggtcgaccgaggtcgggtctgggacagtacttcactctcaccatcagcacgcctagacgcctagaagtattttcgactacttttattactgtacaacagtaccgtaccaacgtcgggacggtacggttccggaccgaacgggaccaagggtcgaggtaccgaaacgaacgtggtggctgcacatctgtcttcacttccttccccgctactctagaacgctacgg

SEQ ID NO: 41065 - DNA, 606 bp, Homo sapiens
  misc_feature: GYAE6OF01CIKFQ.36.85.H08.1.454.CMB.1.raw
  modified_base (313)..(313): a, c, t, g, unknown or other
  misc_feature (313)..(313): n is a, c, g, or t
tcagtacgctgtctcacgaccggtgctcgatttagtatcactcagtcgggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaaatcaccatgaccagaacagctccataaacacagttacatagaactgaacagtctgagctccgaggacacggccgtatatactgtgngagagacaacgtatttttggactggtagtaatacgaaggggtttcgaccccgtggggacccgacgggaacccgtggtccgtaccgtccgtcctcacggccctcccgaaccgaacgggcccctacgtccggtcccttcccccgtcggcccaccccttccctacctaacgacgcctaccgtcgtcggggcacgacgccggtcccgtgggcctcgccgtggtaccgaaaggtacctaccgttacccgagaccgacgtaccgtacgtcggacggtacgggcgtcgggcgagggaccg

SEQ ID NO: 41066 - DNA, 608 bp, Homo sapiens
  misc_feature: GYAE6OF01EA3VP.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagccaccctctcctgcagggccagccagagtgttagtacaaaacttagcctggtatacaaacaaaaagctggccaggcctcccaggcctcctcatctatgatgacttaccgaaacgggccctggacactcccaacgtaggttcagtcgccgaggtcgggtcgtggactagtacttcactctacaccatcagcacgcctagacgccgtagtaagtattttgacttactttattactagtaccaactacgaccgtaacctaacgtcggcgggtacgttccggaccggtaaacgggaccgtaagggtacggaacggttacgaaacggtaacgtcggtaggcctgaccaacctacgttccgttgttccttcctacttccctaccccgtacctactccgtagaacgacgtacgg

SEQ ID NO: 41067 - DNA, 622 bp, Homo sapiens
  misc_feature: GYAE6OF01BRY2Q.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagcccaccctctcctgcagggccagccagagtgttagtacaaaacttgcctggtatacaaacaaaagctggccaggcctcccaggcctcctcatctatgatgccttaccgaaaacgggccccctgggaccactccccaacctaggttcaggtcgccaggtgggtctgggacagtacttcactctcacatcagcacgcctagacgtcctagaacgttattttcgacttacttttaattaccttagtccaacgtacgtaccgtaacccgaacgttcgggtaccgggtaaccggtttccgggaacccgtaacggggaacccgaagggtaccgaaggttaaccaaacgtacgtggtcggtcgtacgcctaacctagtccggttgtaccttcacgttcccttcccgctactaccgtagaacgcgtaacg

SEQ ID NO: 41068 - DNA, 603 bp, Homo sapiens
  misc_feature: GYAE6OF01DCD5O.36.85.H08.1.454.CMB.1.raw
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttagtagtggtgacacagattatgcacagaagttccagggcagaatcacatgaccagaaacagctcaataacactagttacatgaactgaacagtctgagctccgagacacgccgtatattacngtgcganagacaacgtattttggactggtagaatacgtaagggttccgacccgtggggaccgacgggtaacccgtcggtcacccgtctcctcacgccctccaccgacggcccacgtccgtccttcccccgtggccaccctcctaccacgacgccaccgtccgacggggccacgacggtccggacccgtcgggcctaccggtccgtcgggtaccgaaacggtacccgttaccttacccgacggtacccgaggtacccgtacgtcggaacgggccgggcggttcgggcgaacggg

SEQ ID NO: 41069 - DNA, 538 bp, Homo sapiens
  misc_feature: GYAE6OF01BHHT2.36.85.H08.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (327)..(327): a, c, t, g, unknown or other
  misc_feature (327)..(327): n is a, c, g, or t
  modified_base (501)..(501): a, c, t, g, unknown or other
  misc_feature (501)..(501): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctccagataccacggagaaattgtgttgacacagtctccagccaccctatctttgtctccaggggaagngccaccctctcctgcagggccagccagagtgttagtcaaaacttgcctggtatcaaanaaaagctggccaggctccaggctcctcatctatgatcgcttaccaaaacgggcccctggcactacccaaccnggttcaagtcgcctaggtgggtctgggacagtaccttcgactctcacatcagcagcctagcgcctaggaatattttcgacttacttttatacttgtacaacacgtacctacctaacgtggacggtacgttccggacgaacgggaccaagggtacgagtacaacgactggcgtcngccactgtctgtctcatctcccgcatnanagngtacg

SEQ ID NO: 41070 - DNA, 612 bp, Homo sapiens
  misc_feature: GYAE6OF01C8KTW.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccacctctcctgcagggccagccagagtgttagtacaaaactttgcctggtaactcaaacaaaaagctggaccaggctcccaggctcctcatctatgatgcttaccaaaagggccctggccactacccaaccgaggtttcagtgaccgtaggtcgggtctagggacaggtacttcactctcaccatcagctagcctagacgacctagtaagtattttagactacttttactacttacgtactaacagtaccgtaacctaacgtcgggaccggtacggttccgggaccgaaacgggtaccgtaaagggtaccgaggtaccgaaacgtaacgtggtcggactggcctaaccgtataccgttgttacttctaccgttcttcccccggtactacgttacctaggaagaccgtacgg

SEQ ID NO: 41071 - DNA, 777 bp, Homo sapiens
  misc_feature: GYAE6OF01CI5AD.36.85.H08.1.454.CMB.1.raw
  modified_base (224)..(224): a, c, t, g, unknown or other
  misc_feature (224)..(224): n is a, c, g, or t
  modified_base (283)..(283): a, c, t, g, unknown or other
  misc_feature (283)..(283): n is a, c, g, or t
tcagtacgctgtctcacgaccggtgctcgatttagtatcactcagtcgcgggggaggaactgctcagttaggacccagagggaaccatggaagcccagctcagcttctcttcctcctgctactctggctcccagataccaccggagaaattgtgttgacacagtctccagcccaccctatctttgctccgaggggagagccacctctcctgcaggccagccagngtgttagacaaaacttgcctgtatacaaacaaaagctggaccaggctccgaggctcctnatctatgatgccttacgaaaacggcccctaggcctactacccgaaccgtaggttacaggtcgaccgtagggtcgggtactcggggaactagtacctttccgacctcctaccacctaataccgacgtaccgaacggtccccttaaaggcggtaacccgttagggaaacgttttacgttttttacggaaccctttaaaggtttttaaacgttttaacctacgggttaaaccaaacgttaccgggtaaccgttaaacccaacgggtttaccgggacccggggttaacgtttacccggggaacccgtaaacgggggtaaaccccgtaggggtaacccgggtaacggtaaacccgtaaaaccggtaaccggtttcggtaccgggttacgaccggacctaaacccgttacgtttcccggttagtttacccttcccgttaaccttccccgttttaccccgcccttaacgttaccgttacggaaaacgtacccgtaaccggg

SEQ ID NO: 41072 - DNA, 631 bp, Homo sapiens
  misc_feature: GYAE6OF01D0C1J.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctaccaataaacactagtttacatagaactagaacagtctgagctccgaggacacggccgtatattactgtgcgagagacaacgtattttggacgtggtagtaatacgtaagggttccgacccgtggggaccgacgggaccgtcggtcaccgtctcctcacgccctccaccgaacgggcccaacgtccggttacccttccccccgtacggccctaccccgtccctacccaacgtaccgcccaccgtccggtcggggaccaccgaccgggtccggacccgtcgggccgttcggcccgtcgggtaccaacggtaccttacccgtttacccgagaccgtacggaccgtacgtacgggacggcgggacgtcgggacgaacgggtccgg

SEQ ID NO: 41073 - DNA, 875 bp, Homo sapiens
  misc_feature: GYAE6OF01DI9GJ.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctccagataccaccggagaaattgtgttgacacagtctccgacgccctacctattcgtttcgtcctacgggaaggggaaggaccgacccctacccttccgtccgtcgaccggaccgggaccacggaccgaaggtagttaggttacgtaaaccttaaaacgttcgtccggttaggtaactaaccaaaaacgaaaacgtcgtaccggaccgacggtccctacccggacggtcccttcctactacttactagtagtacgttccgttacccttaaaaccgggaaacccgggtcccgtacggtacctacctaaccccgaaacggttacggttaccgtacggtccgaccgtaggggttccggtacggtacgggaacgtaacgtttacctaccgtaccttactacccaacctactaccgacgacgaccgttaccgtaacggacccgtaccgttaaggtaacgtttttacgtttaccgaacctttttaacgtttttaacgtaccgttacgtaacctaacgtaccggttaaccccgttaaacccgtacgggtccggggtaacccgggttaccggttaacccgggaaccggggaaaccgggtaacccgggtaacgggttaccgggtaaccggtaaaccgtaaaccgttacggtcgggtacgtaccgtaccgaccctaaacgtcgttcgttaccgttaccttacgtacccttccccgtacccgtacttacgtacctaacggaaaccgcggttaaccgg

SEQ ID NO: 41074 - DNA, 590 bp, Homo sapiens
  misc_feature: GYAE6OF01B1AJ3.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgtattttggactggtgaatacgaagggttcgacccgtggggccagggaccctggtccaccgtctcctcacgccctaccaccaacgggcccagtccggtcccttccccctggcccacccctcctccaacgcgccacctcgtcggggccacgacggccggacccgtgggcctcggcccgttcggtaccgaacgggaccttaccgttcccgaacggaccacgggaccgttacgtcggacggaccgggctcgggcgtaaaccgggg

SEQ ID NO: 41075 - DNA, 615 bp, Homo sapiens
  misc_feature: GYAE6OF01C40LI.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcatagaagttccagggcagatcaccatcaaccagaaaacagctaccaataaacacaagtttacataggaactagaacagtctgacgctccgagacgacgcgtatattactgtgacgagagacaacgtagttttggacgtgtagaatacgtaacgggttccgacccgtggggccgacgggacccgtaggtcctaccgtctcctcacgcctaccgaccgaacggccccacgtccgtcccttccccgtcgaccctacccttcccctacgaacgcgcctacccgtcggtccggggcctaccgacgccggtcccgtcgggtcctcggtcccgtacggtaccaaccgggtacctacccgttccaagaccgacgccgtacgtacggtacgggcgggtccgtcgggcgagggcccg

SEQ ID NO: 41076 - DNA, 575 bp, Homo sapiens
  misc_feature: GYAE6OF01B0IEF.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagttacatggaactgaacagtctgagcgtccgaggacacggccgtatattactgtgcgagagacaacgtattttggactggtgaatacgaagggttccgacccgtggggccacgggaaccctggtcaccgtctcctcgacgcctaccgaccgacgggacccacgtccggtcccttcccccgtggccctaccccgtccctaccaacgacgtaccacctcgtcgggggccaccgacggccggcccgtgggcctcgccgtgtcgaacggtcctaccgttccgacgacgcgcgtacgtgacggccggctgggcacggg

SEQ ID NO: 41077 - DNA, 649 bp, Homo sapiens
  misc_feature: GYAE6OF01DKB3G.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaacagctcaataaacactagttacataggaactgaacagtctgagctaccgaggacacggccgtatattactgtgcgagacgacaacgtacgtttttggacgtggtagaatacgtaacggggttccgaccccggtcggggccgaacgggtaacccgtcggtccgaccgttcctccctcgacgccctccaacccgaacgggtccccaagttcccggtcccctttcccccgtcggtaccctacccccgtccctacccgaacgacgcccgtaccgtacggtcggggaccaccgtacggcccggtcccgtgggcctcggtcccgtagggtaccaacgggtacctacccgtacccgaacggaccgacggtccgttacgtcggacggccggggtcgtcgggcggtaaacggg

SEQ ID NO: 41078 - DNA, 560 bp, Homo sapiens
  misc_feature: GYAE6OF01BNR2Z.36.85.H08.1.454.CMB.1.raw
  modified_base (528)..(528): a, c, t, g, unknown or other
  misc_feature (528)..(528): n is a, c, g, or t
  modified_base (547)..(547): a, c, t, g, unknown or other
  misc_feature (547)..(547): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgtattttggactggtgaatacgaagggttcgacccgtggggccagggaaccctggtcaccgtctcctcacgcctccaccgaacgggccccatccggtccttcccccgtggccctaccctccctaccaacgacgccacccgtcgtgggggcctacgacggccggcccgtgggctcgccgtggtcaaggcctacgtccagacgngccgtacgtgacggcgggntcggcgagggccg

SEQ ID NO: 41079 - DNA, 544 bp, Homo sapiens
  misc_feature: GYAE6OF01C2SZP.36.85.H08.1.454.CMB.1.raw
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
  modified_base (512)..(512): a, c, t, g, unknown or other
  misc_feature (512)..(512): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatacaaacaaaaagctggccaggctcccaggcctcctcatctatgatgcttccaaagtcgggcccctggcactcccaaccaggttcagtcgccaggtgggtcgtgggacagtacttcactctaccaccatcagcagcctagngcctagaagtnttttgctacttttaattactcgtacaactagtaccgtaccaacgtggccggtacgttcggaccgaagggaccgaagggtcgacggtacaacgacgtgtgctgccacgtntctgtcttcactccttcccgcatctgagtacg

SEQ ID NO: 41080 - DNA, 742 bp, Homo sapiens
  misc_feature: GYAE6OF01CLSK6.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagtttatgaatcaactgggtgcgacaggccacaggacaagggcttggagtggagtgggatgggtagaacccttagtagtggtgacacagattatgcacagaacgtccgagggcagaatcacatacgaaccagaaacagacctacaataaacactagtttacagtaggaactagaacagtctagacgccgtaccgacggacgaccggtaccgtatacttacgtgtagacgagacgaacgtaacgttagttttacggacgtgggtaagtaacgtaacggtacggggtttacccgaccccggttacggggacccggtaaccgggtacccgtcggtaccctacccggttactcccgtacaccgcctacccgaaccgtaacgggcccctacgtcccggtacccctttaccccgcgggtacccctaccccgtacccgtacccgaacggtaccgtacctacccgtcgggtacccggggaccaccggtacccgggcccggtcccgtacgggcctccggtcccggttacggtaaccggaacggtacccgttaacccgttaccggaacggtacccgtacgggtaccggttaaccggtcggacggggtaccgggcgtacgggacggtaaccgggaccg

SEQ ID NO: 41081 - DNA, 745 bp, Homo sapiens
  misc_feature: GYAE6OF01CQQR3.36.85.H08.1.454.CMB.1.raw
tcagtacgctgtctcacgaccggtgctcgatttagtatcactcagtcggcggggctagaaatggaagaagccgtggggcctcagtgaaggtgtcctgcaagacttcaggatacaccttcactagttatgaaatcaactgggtgcgacaggccacaggacaagggcttgagtggatgggatgggtgaacccttagtagttggtgacgacaggattatcgacacagaagttccaagggccagaatctaacctattcgaaccagaaaccagacctaccaataaactactagtttacagtagaactagaaacagtactagacgtcctaccgaggaccgaccggcgttattattacgtggtcgaccggagacgtaccgaacgtagttttcggagtcggtagaagtaaccggtaagggggtttaccgacccggttacggggacccgtaacgggttaacccgttcgggttaccctaacccggtcctacccgtacgaccgcccgttaccccaaccggaacgggtccccaacggttccggttccccgttacccccggtggtcccccgtaccccgtccctacccgtaacgtacccgtacccgtaccgtcggtaccggggaacctaccgtcggtacccggtcccgttcgggcccgtacgtcccgtacgggtacccgaacggtacccgtaaccgtaccggaacgaccgaccgtaccgttacgtacggacggtccgggacgtccgggagtaacccggg

SEQ ID NO: 41082 - DNA, 706 bp, Homo sapiens
  misc_feature: GYAE6OF01A7K30.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccgaggggagagccaccctctcctgcagggccagccagagtgttagtacaaaacttgcctaggtactacaaacgaaaagctggccaggctcccaggctcctcatctatgatcgaccttaccaaaacgggcccctaggccactccccaacgtcggttcagtcgacctaggtcgggtcgtacgggactaggaccttcgacttcgtctaaccgactccgaagtccacggtccttaggacgtccgttaggtaaacgttattttcggacctttaacttttaacgtttaacgtcggttaaccaacgtacggtaccgttaaccgaaccggtcgggtaaccgggtaccgtttaccgggaaccgtaccggggtaaccgtaacgggtacggtaacgggtacctaaaacggtacggtacggtacggtacgtcgaccgaacctagttacccgttaggttcccttacgacgttttccccgttaccccggtacttacccgtttaccgacggtaaaccggtacgtaacccggg

SEQ ID NO: 41083 - DNA, 624 bp, Homo sapiens
  misc_feature: GYAE6OF01EXXPF.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatgaactgaacagtctgagctccgaggacacggccgtatattactgtgcgagagacaacgatttttggactggtgaagtacgtaagggttccgaccccgtgggcccgagggaacccgtggtccaccgtctccctcacgcctccaccgaacggccctaagtccggtcccttcccccgtggccctaccccgtccctacccaacgacgccaaccgtccgtcgggggccaccgacggccgggtccccgtggggaccctcggtcccgttcgggtaccgaaacgggtaccttacccgttacccgaacggtaccacgccggtaaccgttcgggacggcccggggtcttcgggccgaaacgggg

SEQ ID NO: 41084 - DNA, 564 bp, Homo sapiens
  misc_feature: GYAE6OF01D4IWO.36.85.H08.1.454.CMB.1.raw
  modified_base (514)..(514): a, c, t, g, unknown or other
  misc_feature (514)..(514): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagccaccctctcctgcagggccagccagagtgttagtacaaaacttagcctggtatcaaacaaaaagctaggccaggcctcccaggcctcctcatctatgatgcttaccgaaaacgggcccctggccactcccaactggttcagtcgccaggtgggtctggacagtactcactctcaccatcagcagcctagacgctagaagtattttgacttaacttttatactgtaccaacagtaccgtaaccaagtcggacggtacggttccgacgaacgggaccaggtacgaggtaaccaacgactggagcgtgccacctntcgttgtcttcacttcccgtaccccgtctactacgtacgaacgctaacgg

SEQ ID NO: 41085 - DNA, 746 bp, Homo sapiens
  misc_feature: GYAE6OF01DKR71.36.85.H08.1.454.CMB.1.raw
tcagtacgctgtctcacgaccggtgctcgatttagtatcactcagtcggggctgaaatgaagaagcctgggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccgagggcagatcaccatgacagaacagctacaataacactagttacataggaactagaaactagtctgacgcgtaccgaaggaccgaccggccgttaatagtttactggtgcgaagacgaactaacggttatttttacggacgttaggtagaaagttaccggtaacgggggtttaccgacccccgggtggggacccgtaccggggtaaaccccgttcggtacccaccggttcctcccgtacacccgtcccgtacccgaacccggaacgggccccctagtcccggttacccttccccccggtcggaccctacccccgttaccctaacccgtaacggacctacccgtaaccccgttcggggttaccgggggaccctaacccgtaccggggcccccgggttaccccggtccggggtccgttcggtccccggttacggtaccggtaaacggttacccttaaccgtacccgtaacgaccgacgggtacccgttacgcgggacggccgggttaccggtacggaccgagggacccg

SEQ ID NO: 41086 - DNA, 715 bp, Homo sapiens
  misc_feature: GYAE6OF01CJ4AR.36.85.H08.1.454.CMB.1.raw
  modified_base (141)..(141): a, c, t, g, unknown or other
  misc_feature (141)..(141): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (702)..(702): a, c, t, g, unknown or other
  misc_feature (702)..(702): n is a, c, g, or t
tcagtacgctgtctcacgaccggtgctcgatttagtatcactcagtcgcggggctagaaatgaagaagcctggggcctcagtgaaggtgtcctgcaagacttcaggatacaccttcactagtttatgaaatcaactgggtncgacaggccacaggacagggctgagtggatgggatgggtacaacccttagtaggtggtgaccaanagtattacgngacacagaacgttccgagggcaagtaacncaacatacgaacaagtaaacngcctaccaataaacatacgttacagtacggaactagacgagtactgacgctaccggaggaacgacgtaccgtaatacttacgtgagcgaagtacaaccgtaagtttacgttttaggaccgtgggtaacgtaaagtaccggtaaacggggtttcccaaccgggttcggggaaccctaacggggaccccgttggtacccctaccgtcctcccgtacgtaccgaccctacccgaaccgtaaccggtaccgtaaccgttccggtacccgttcccccgtacggaccctacccccgtccgtacccaaccgacgtccgtaacccggttcggaccggggcctaaccgtaccggcccggtacccgtcggaccgtcgtacccggttacgaccgtaacggacccgttacgtaccgacgacgtacgccgtacggtcgacgggaccggngtcggcgaacggg

SEQ ID NO: 41087 - DNA, 699 bp, Homo sapiens
  misc_feature: GYAE6OF01B79V7.36.85.H08.1.454.CMB.1.raw
  modified_base (247)..(247): a, c, t, g, unknown or other
  misc_feature (247)..(247): n is a, c, g, or t
tcagtacgctgtctcacgaccggtgctcgatttagtatcactcagtcgcggggctgaaatgaagaagcctggggcctcagtgaaggtgtcctgcaagacttcaggatacacctttcacagtttatgaaatcaactgggtgcgacaggccacaggacaagggcttgagtggatgggatgggtgaacccttatagtggtgacacagattatgcacagaagttccagggcagaatcacatgaccagaacngctaccaataacacagtttacatgaactgacagtctgagctaccgagacacggccgtatattactgtgcgagagacaacgtagttttggacgtggtagaacgtaacggtaacgggttccgaccccggtgggggacccaacggggtaacccgtcgggtacctacccggttccttcccgtacgaccgtccccttaccccgaacccgaaccgggtcccctaacgttcccgggttacccttccccccgtccgggtcccctacccccttaccccgttacccgaaacggtaccgacccgtaccgtccggtaccgggggacccaccgtaccgggccggtccccggtcggggtcctccggccgttcgggtaccgaacggtacccgttaccgttaccgaacggaccgtacggtaccgttaacggttcggaacgggccgggtcgtaccgggcggaaccgggg

SEQ ID NO: 41088 - DNA, 800 bp, Homo sapiens
  misc_feature: GYAE6OF01CBPN1.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccgaggcagaatcaccatacgaccagaacagactacaataaacactagttacatacggaactacgaactagtactagacgccgtaccggacggacgaccggtaccggtaattaacgttacgttagtacggacgaaggaacgaacgaaaccgttagtttttacggaacgttagggtaagtaaacgtaacggttaaaccggggttacccggtaacccggtacgggggtaccccgaaacggggtaacccgttacggtcccgtacccggttaccctccgtaccgacgtcccctaaccccgaacccggtaacccggtacccgtaacgttcccggtacccctttcccccgtacggtaccccctaccccttacccgtacccgaacggtaccgaccctaaccgttcccgggtacggggaacccgaccggtaccggtccccgggtacccggttcggggtacctcccgggaccgttacggggtaaccgaaccgggttacccgttaccgtttaaccccgaaggtcccgaaccggttaccggtttaacgtcggacggggacccgggtacccggtcgggtaacggaacccgggg

SEQ ID NO: 41089 - DNA, 893 bp, Homo sapiens
  misc_feature: GYAE6OF01DZNUU.36.85.H08.1.454.CMB.1.raw
  modified_base (747)..(747): a, c, t, g, unknown or other
  misc_feature (747)..(747): n is a, c, g, or t
tcagtacgctgtctcacgaccggtgctcgatttagtatcactcagtcgcggggctgaaatgaagaagcctggggcctcagtgaaggtgtcctgcaagacttcaggatacaccctttcacagtttatagaaatcaacgtgggtgcgacacggccaacgaggaacgaagggtcttggaggtggagtgggagtgggtacgtaaccttagtagtggtcgacacgagtattatgacaacgaagtaacgttccgagggacaagaactccaaccagtacgaaccaaagaaacacgtacctaacctaaataaacctaactaacgttttaaccgagtaacggtaaactagaaacgtacgtacgtggtaaccgtccgtaaccgggaacggtacccgtaaccgggtaccgtttaacgtttaacgtacgttggtaacggaccgaaaggtaacgtaaaccggtaacgttttaaggtttacggtaacgttagggtaacgtaaacggttaacgggtaccggggttacccgaacccggtacggggaacccgtaaccgggtaaccccgtccggtacccgtaccccggttccttacccccgacgtaacccccgtacccgtaacccccggtaaacggtaacccccggtacccgtttacccggttccccggtttacccccccttaccccgggtacccgtccccttaacccccgttaccccgtacccgaaacggcccgtaacccgtaccggtcgggggacccggtacncccgggtaccggtcccggggtcccctacggggtccttacccggtcccgggtaggttaacccggaccggtttaaccgttaccccgaccggtaaacgccctacccggggtatacgggcccgggagcccggtccggtagaccgggtacg

SEQ ID NO: 41090 - DNA, 582 bp, Homo sapiens
  misc_feature: GYAE6OF01EIKGR.36.85.H08.1.454.CMB.1.raw
  modified_base (453)..(453): a, c, t, g, unknown or other
  misc_feature (453)..(453): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgattttggactggtgaatacgaaggggttccgacccgtggggccagggaaccctggtcaccgtctcctcagcctccaccgaacggcccatccggtccttcccctggcccacccctctccaagacnccacctcgcggggccacgacgccggcccgtgggcctcgccgtgggtaccgaacggtacctaccgttccgaacggaccaacggtcccggtaacttcgggaacggcccggggtcgtcgggcgaaaccgggg

SEQ ID NO: 41091 - DNA, 623 bp, Homo sapiens
  misc_feature: GYAE6OF01D8GNR.36.85.H08.1.454.CMB.1.raw
  modified_base (300)..(300): a, c, t, g, unknown or other
  misc_feature (300)..(300): n is a, c, g, or t
  modified_base (555)..(555): a, c, t, g, unknown or other
  misc_feature (555)..(555): n is a, c, g, or t
  modified_base (559)..(559): a, c, t, g, unknown or other
  misc_feature (559)..(559): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtcctccagcccaccctatctttgtctccgaggggaaggacgccaccctctcctgcagggccagccagagtgttagtacaaaacttgcctaggtatacaaacaaaagctggaccaggcctcccgagtcctcctcatntatgatgtaccgttaccgaaaacgggcccctggacactacccaactggtcagtcgaccgaggtggtctgggacagtctcactctacaccatacgagcaacgctagagtacctaggaaacgtttacttttgaacctttaacttttaactacttacgtacctaacgtacgtaccgttaacccaacgggtcgggaccgggtaccgttaccgggaccgaagggaaccgtaaggacgtaggtacccaaaggaactggtancgtnccactacgttctaccttgttaccaccgttccgtaccccgtcctatcccgtaagacgactacggg

SEQ ID NO: 41092 - DNA, 592 bp, Homo sapiens
  misc_feature: GYAE6OF01DVATH.36.85.H08.1.454.CMB.1.raw
  modified_base (199)..(199): a, c, t, g, unknown or other
  misc_feature (199)..(199): n is a, c, g, or t
  modified_base (331)..(331): a, c, t, g, unknown or other
  misc_feature (331)..(331): n is a, c, g, or t
  modified_base (403)..(403): a, c, t, g, unknown or other
  misc_feature (403)..(403): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagngccaccctctcctgcagggccagccagagtgttagtacaaaacttgcctggtatcaaacaaaaagctaggccaggctcccaggcctcctcatctatgatgcttaccaaaagggcccctggcacgtcccaacnggttcaagtcgacctaggtcgggtctggacagacttcactctcaccatcagcagctaagctccgtagaagtntttgacttattttatactgtacaactagaccgtaaccaacgtggacggtacgttccggacgaaaggggacctaagggtcgaacggttacaaaaccggtaatcgggtaggtccgtcgacctaacctagttccgttcgttcctttacacctttccctaccccgtcctaacttcgtaacgagtaccgaaggg

SEQ ID NO: 41093 - DNA, 603 bp, Homo sapiens
  misc_feature: GYAE6OF01D0KU0.36.85.H08.1.454.CMB.1.raw
  modified_base (353)..(353): a, c, t, g, unknown or other
  misc_feature (353)..(353): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctaccaataaacactagtttaaccaataggaactagaacagtctgagctaccgaggacacggccgtatatactgtgcgagagacaacgtattttggactggtanagtacgaagggttcgacccgtcggggcacgggacctggtcacgtctctccacgccctacacccgaacggcccacgtccggtcccttcccccgtcggtcccaccccttccctacccaacgacgccgtaacccgtccgtcggggaccacgtaccgccgggcccgtcgggcctcggtcccgtggtaccgaacggtaccgtacccgttaccgacggtacacggtcgtaacgtggacggcgggcgtgcgtaacgg

SEQ ID NO: 41094 - DNA, 710 bp, Homo sapiens
  misc_feature: GYAE6OF01CADJP.36.85.H08.1.454.CMB.1.raw
  modified_base (122)..(122): a, c, t, g, unknown or other
  misc_feature (122)..(122): n is a, c, g, or t
  modified_base (211)..(211): a, c, t, g, unknown or other
  misc_feature (211)..(211): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttangaaatcaacgtgggtgcgacaggccacgaggacaagggcttgagtggagtgggatgggtacaacccttagtagtggtgacacagattangcacagaacgttccgagggcagaatcaccatacgaccaagaacacgcctacaactaaacactaagttacagtacggaactacgaactacgtctagacgccgtaccgacggaccgacggtaccgtattagttaccgtggtacgacggtaagaacgtaacgtaacgtttagttttacgggacgttaggtaacgtaacgtaaccggttaacggggtccccgtacccgggtacgggtaccggaaccgggtacccgtcggtacccgtaccgtcctccgtaccgaccgtcccgacccgtaaccgaacggtcccccttacgtcccgttccccgttccccgacgtacccctccctaccgacccgaacgaccgccgtaccgttcgggacggacccaccggccgcccgggtccgtacggctcccggtacgtccgtacgaaccgtactacccgtccgaagacgtacgtccgtaggtacgggccggtaccggagtacggacggcggtaccg

SEQ ID NO: 41095 - DNA, 665 bp, Homo sapiens
  misc_feature: GYAE6OF01B5R2O.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaacagcacaactaacacagttacatagaactagaacagtctgacgcgtccggacgacgaccggcgtatatactgtcgacgagagacgtaacgtagttttacggacgtgtagaacgttaacggtaacggggttaccggacccggtcggggacccggaaccgggtaacccgtcggtaccgtaccgtcctcccgtacaccgcccgtacccgaacccgaaccgggccctacgttcccggttccccttcccccgtcgggtcccctacccctcccgtacccaacgacccgaccctaccgtccggtacggggacccaccggcggccggtccccgtagggcctcggtccgtcggtacgacgtacccgttaccgtaccgacgtaccgacggtaccgtacgacggacgggtccgggcgtggaccggaacggg

SEQ ID NO: 41096 - DNA, 711 bp, Homo sapiens
  misc_feature: GYAE6OF01AGMTP.36.85.H08.1.454.CMB.1.raw
  modified_base (274)..(274): a, c, t, g, unknown or other
  misc_feature (274)..(274): n is a, c, g, or t
  modified_base (683)..(683): a, c, t, g, unknown or other
  misc_feature (683)..(683): n is a, c, g, or t
tcagtacgctgtctcacgaccggtgctcgatttagtatcactcagtcgcggggcgtgaaatgaagaagcctggggcctcagtgaaggtgtcctgcaagacttcaggatacaccttcacagtttatgaaatcaactgggtgcgacaggccacaggacgaagggcttgagtggatgggagtgggtgaacccgttagtagtggtgacacgagtattatgacacagaagttccagggcagaatccgaaccagtcgaccaagaaactacgcctaccaanaaaccactaacgtttaacagtcggaactagaacagtactgacgcgtaccgacgaccgaacggcctaatagttacctggtgacgagtacgacgtaacgtagtttttaggacgtggtaagtaacgtaacggtaacgggttccgtaacccggttggggacccgtaagggaaaccccggttggtcccacccggttctaccgtccgacgtcccctaccaacccgggaacggtccccacgtttacccgggtaccccttcccccggtagcccctaaccccgtccctaacgaacggcctaccgtacgtccggtacgggggaccaccgtacggccccggacccttggggcctaccgggtcctcgggtaaccgaggttacccttacgttcccgaaggtcctaccggtaccgttaaccgnggtacccgggcggccgtcgggactaggg

SEQ ID NO: 41097 - DNA, 854 bp, Homo sapiens
  misc_feature: GYAE6OF01EY4E9.36.85.H08.1.454.CMB.1.raw
  modified_base (196)..(196): a, c, t, g, unknown or other
  misc_feature (196)..(196): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctccagataccaccggagaaattgtgttgacacagtctccagccaccctatcttgtctcgaggggagngccaccctctctgcagggccagccagacgtgttaagtactaaaacttagccgtaggtactacaaacaaaaagcctaggaccaggcctcccgaggtcctacctacgattccgtataggacttcggtaccgttaacccgaaaaaccggggtccccctagggtaccctaaccgttacccccgaaaaccgtacgggtttaccgaagttaccggacccgtaagggttcgggtacgttacggggaactacggtaaccctttccgacttccgtaccaaccgtataccgacgtcaacgtacccgtaagtaccgtaccgttaaggtaaacggtttacttttaggacctttaaactttttaacgttaacttcggtaaaccctaaacgtaccggtaacccggttaaacccctaacgggttacgggtaaccgggttacccgggttaccgggtaacccgggtaaccggggaaaccggtaaccgggtaccgggtaaacgggtaaacccgtaaaaccggtaaccggtttacggtacgggttaccgtacccggaaaccgtaaccccgttacggtttaccgttacccggtttactttacccgttaccgtttaccccgttacccccggtacccgttaacgttacccgttaacgtaaaccggtaccgttaaaccggg

SEQ ID NO: 41098 - DNA, 739 bp, Homo sapiens
  misc_feature: GYAE6OF01ED6S7.36.85.H08.1.454.CMB.1.raw
  modified_base (614)..(614): a, c, t, g, unknown or other
  misc_feature (614)..(614): n is a, c, g, or t
tcagtacgctgtctcacgaccggtgctcgatttagtatcactcagtcggggctgaaatgaagaagcctggggcctcagtgaaggtgtcctgcaagacttcaggatacaccttcactagtttatgaaatcaacgtgggtgcgacaggccacaggacaagggcttgagtggagtgggagtgggtcgtaaaccctttagtaggttggtagaaccaacgagtaatttagtgaccaacgaaggtaacgttccgaaggggcaagtaactccaaccctagtaccgaaccaaacgaaaaccacgacctaaccaaataaaaccacgttaagtttaacagtaggaactagaactagtctagacgccgtaccggaaggaccgaccgggtaccttaataacgtttacgtggtacgacggaagtaacgtaactaacggtttagttttcgggaacgttgggtaagaacgttaacgggtacggggttacccgaacccggtggggacccggtaaccgggacccgttgggtaccctacccgttcctacctacgaccgtcccctaccgaaccgaaccggtcccctacgtcccgttcccttccccgcgccctacccctcccgtaccgaagccnccgtaccgtcggcgggaccacggacggtcccggtcccggtggtccgtacgtccggtcgtacgaccggtacctaccgtccaagtaccgaggccgttagcggtacggcggtacgcggacgcggaccg

SEQ ID NO: 41099 - DNA, 627 bp, Homo sapiens
  misc_feature: GYAE6OF01BR50T.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccgaggggaagacgccaccctctcctgcagggccagccagagtgttagtacaaaacttgcctggtactcaaacaaaagctaggccaggcctcccgaggcctcctcatctatgatcgtccttaccgaaacgggcccctaggccactaccccaaccgtaggttcagttcgaccgaggtcggtcgtggacagtacttcactcctaccacactacagcacgacctagacgtccttagaacgttatttcgactttactttaacttactacgtacaactacgtacctaccgaacgtcggacggtacgtcggaccgaacgggaaccgtaagggtaccgtaacggtaaccaaacggtacgttgggacggtctcgacctaccgtgtccgttcgttacttccgtaccttcccgttaccccgacttacttacggactaacgctaaccggg

SEQ ID NO: 41100 - DNA, 631 bp, Homo sapiens
  misc_feature: GYAE6OF01DDRAS.36.85.H08.1.454.CMB.1.raw
  modified_base (199)..(199): a, c, t, g, unknown or other
  misc_feature (199)..(199): n is a, c, g, or t
  modified_base (445)..(445): a, c, t, g, unknown or other
  misc_feature (445)..(445): n is a, c, g, or t
tcagtacgctgtctcacgaccggtgctcgatttagtatcactcagtcgcgggggaggaactgctcagttaggacccagagggaccatggaagccccagctcagcttctcttcctcctgctactctggctcccagataccaccggagaaattgtgttgacacagtctccagccaccctatctttgtctccgaggggaagngcccaccctctcctgcagggccagccagagtgttagtacaaaacttgccttggtatacaaacaaaagctggccaggctcccgaggcctcctcatctatgatgccttacgaaacggggtccctggaccacgtcccaacgtaggttccagtcgccgtaggtggtctgggacacgtaaccttcgacctctaccactactcagcagcctaagcgtacctagaattatttgacttattttatactgacaangtaccgtacaacgtcgggtacggtacggttccgggaccgaaacgggtaccgaacgggtacgtacgggttaaccaaacggtagttcgggtagaccgtgaccgtacgtaacgttcgttacgtttaccgttctacgttccccgttccccgtacctacgtttaccgtaaaccggacgtccggttaacggg

SEQ ID NO: 41101 - DNA, 621 bp, Homo sapiens
  misc_feature: GYAE6OF01C8I5E.36.85.H08.1.454.CMB.1.raw
  modified_base (267)..(267): a, c, t, g, unknown or other
  misc_feature (267)..(267): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgataggccacaggacaagggcttgagtggatgggatgggtgaacccttatagtggtgacacagattatgcacagaagttccagggcagaatcaccatgacagaaacagctccataaacactagttanactaggaactgaacagtctgagctaccgaggacacggccgtagtacttaactgtgcgagaagacaacgtatttttggactcggtagaatacgaaagggtttccgacccgtggggccacgggaacctggtcaccgtctcctcacgcctccaacgaacggaccctacgtaccggtccttccccccgtaggtcccacccctcctaccgaaacgacgcctaccgtcgtacggggccgaaccgtagccggacccgttcggggcctcggtcctcgggtcctaaacgggaccttaacccgtttaccgaacggactaccggtacgtactacgggacggtaccgggcgtcgggccgaaacggg

SEQ ID NO: 41102 - DNA, 702 bp, Homo sapiens
  misc_feature: GYAE6OF01C5KDY.36.85.H08.1.454.CMB.1.raw
  modified_base (183)..(183): a, c, t, g, unknown or other
  misc_feature (183)..(183): n is a, c, g, or t
  modified_base (541)..(541): a, c, t, g, unknown or other
  misc_feature (541)..(541): n is a, c, g, or t
tcagtacgctgtctcacgaccggtgctcgatttagtatcactcagtcgcgggaggagcagtacaacagcacgtaccgtgtggtcagcgtcctcaccgtcctgcaccaggactggctgaatggcaaggagtacaagtgcaaggtctaccaacaaacgccctccagcccccatcgaagaaaaccntctaccaaagccaaaagggcacgcccgaagaaccacatctcgtcctacgtagaacgaaaccctgtagacgcacacgctcctacacagtcggaactcggaccgtaggaacggtctccgttcttcggttcggtcggacacgcgtacgtacgtaacgaggtccgacccctaccgttacccgacggttacgaccgtaacgtcgggtacgtacgtaggttaccggtcggggtactaaggtaaaacgttacgggaaaacggtaacgggtcccgggtacggggtacctacggtaaggtacggtaacggttcgtaccgtacgacgtaacgtacgttacgacgtactacgtactactaactagttanaagtaactacgtaacgtggtacgacgacgtacggaccaacggaacggacggtacggtcgtaggagggtaggaacggttgggtaggtacgggttaacgtaccggttaggtacgttagggtacaacgtgtaattacgtagtacacgtaacgtaggtaaaccgg

SEQ ID NO: 41103 - DNA, 785 bp, Homo sapiens
  misc_feature: GYAE6OF01B0RA1.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggcctccaccccccgataccaccggagaaattgtgttgacacagtctccacgcccaccctattctttgtcctccgaggggaaggacgcccaccctctcctgccgagggccagccagagtgttagtactaaaacttcgctggtatacaaacaaaagctaggccaggcctcccaggcctcctcatctatgatgccgttaccgaaaacgggccccctggacctactaccccaacgtacggttcaggtcgaccgtagggttcgggtcggtgggaacacggtaccttccgaccttcgtaccaacctatccacgaccgacgaccctaaggaaccgtcccgttaggtaaacgtttatttttacgaccttttaactttttaactttaccgttacgtaacctaaccgtacgtaaccccggttaacccgtaaccggttcggggaccggttaaccgggttaccgggtaacccgggaaaccggggtaacccggaacggggttacccggtaacgggtaacccgtaaaaccggtaacgggttcggtacgggtaccgtacggaccccgtaacgtaccgttccgtttaccgttactttccgttaaccctttccccgttacccccggtacccttaacgttacccgtaacgggttaaaacgacccggttaaacgggg

SEQ ID NO: 41104 - DNA, 768 bp, Homo sapiens
  misc_feature: GYAE6OF01BHHTA.36.85.H08.1.454.CMB.1.raw
  modified_base (270)..(270): a, c, t, g, unknown or other
  misc_feature (270)..(270): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggcctcccagactaccgaccggagaaattgtgttgacacagtctccagcccaccctatctttgtctccgaggggaagacgcccaccctctcctcgcgagggccagccagagtgttagtactaaaacttgcctaggtatacaaanaaaagctcggaccaggcctccgaggcctcctcatactatgtatcgaccttaccgaaaacgggtccccctagggacctaaccgtaccccaacgtacggtttacaacggtccggaccgtagggttcggggtaccgtacgggaacacggttaccgttaccaaccgttcctacccgacctactcgaaccggccaacggcccttaaggaccgttaccgtaggtaaacgtttagttttaccggacttttaactttaacgttacgttaccgtaacctaacgtaccgtacccgttaaccgaacggttcgggaaccgggtaccggttaccgggaaccggtaacgggaaccgtaaggggtacccgtaacggttaaaccgaaacgtacggttacggtacggaccgttacgacccgttaacgtacgttccgttacgtttaccttaccgttaccctttccccgttaccccgtaccgttacttacccgttaaggaaccgtccccgtaacggg

SEQ ID NO: 41105 - DNA, 745 bp, Homo sapiens
  misc_feature: GYAE6OF01D8GO9.36.85.H08.1.454.CMB.1.raw
tcagtacgctgtctcacgaccggtgctcgatttagtatcactcagtcgcgggaggagcagtacaacagcacgtaccgtgtggtcagcgtcctcaccgtcctgcaccaggactggctgaatggcaaggagtacaagtgcaaggtctaccaacaaacgcccctcccacgcccccatacgaacgaaaaaccatcctaccaaacgaccgaaagggccacgccccgaagaaccacactctcgtcctactaacgaacgtaaaaccctgtagacgcacagcctcctacaccagtcggactcggacctggacgtactcctcttcgtggtcgcagcagtctaacgacgtcgaccctactcccgaggtcgacctaacgtggtacgcgtacggtcggtcgggactaaggaaaacgtgggaaaacggaacggtcccgggtacggggtacctacggtagggtacggtaacgggttcgtaccgtggaaccgtaacggtaccgtttacggaacggtaacttacccgtaacctttacgtaacgttaagtttaacgtaacgtaaactacgtaacggttgggtacgaccgtaacgacggaccgtaacggaacggacggtaacgggtacgttagggaacggtagggtagggtcggggtaacggttacggggtaaccgtaaccggtttaaggtagggttacgggtaacgtaaccgtaagtaacggttacgttaacggtacgtacgaaggtaaacgggtaaccggg

SEQ ID NO: 41106 - DNA, 584 bp, Homo sapiens
  misc_feature: GYAE6OF01CA7GD.36.85.H08.1.454.CMB.1.raw
  modified_base (199)..(199): a, c, t, g, unknown or other
  misc_feature (199)..(199): n is a, c, g, or t
  modified_base (404)..(404): a, c, t, g, unknown or other
  misc_feature (404)..(404): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagngccaccctctcctgcagggccagccagagtgttagtacaaaacttgcctggtatcaaacaaaaagctaggccaggcctcccgaggcctcctcatctatgatgcttaccgaaaacgggcccctggcactcccaacaggttcagtcgccagtcgggtctgggacagtacttcactctcaccatcagcagcctagacgcctagaagtnttttgacttactttattacgtgtacaactagtaccgtaaccaacgtcggacggtacgttccggacgtaacgggaccaagggtcgtaaggtacaaacgtacgtggtacggctggccaccgtagttccgttgttccttcgacttcccgttccccgactacttaccgtagaacgcgtaaccgg

SEQ ID NO: 41107 - DNA, 611 bp, Homo sapiens
  misc_feature: GYAE6OF01DMY2I.36.85.H08.1.454.CMB.1.raw
  modified_base (605)..(605): a, c, t, g, unknown or other
  misc_feature (605)..(605): n is a, c, g, or t
tcagtacgctgtctcacgaccggtgctcgatttagtatcactcagtcgcgggggaggaactgctcagttaggacccagagggaaccatggaagccccagctcagcttctcttcctcctgcctactctggctcccagatacccaccggagaaattgtgttgacacagtctccagcccaccctatctttgtctccaggggaaggcgccaccctctcctgcagggccagccagagtgttagacaaaacttgccttggtatcaacaaaagctgccaggcctcccgaggctcctcactctatgatgacttaccgaaaacgggccctggaccactcccaactaggttcagtcgccgtaggtcgggtctgggactaggtaccttctactctccacctactcagccagtacctaggacgccgtagtaacgtatttttcggaccttaacgttttaacttacgtacgtaccaacgtacgtaccgtaaccgaacgtcgggtacggtaccgtttcggacccgaagggacccgtaagggtcgacggtacctaaacgacggtgtcggctcgcactgtctgttcttactctcccgttcccgacctagtacctacggaacncgtacg

SEQ ID NO: 41108 - DNA, 744 bp, Homo sapiens
  misc_feature: GYAE6OF01CJT1Y.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagatcacatcgaccaagaacagctaccaataaacactagtttacatggaactgaacagtctagacgcgtaccgacggacgaccggtaccgtatacgttactggtcgacgagaacgtacgaacgttagtttttaggacgttggtagaacgtaccggtaaggggttcccgaccccggtggggacccgacgggtaacccgtcggtacctacccgttcctcccgtacctacgtcccctacccgaacccgaaccggggtcccctaacggttcccggttacccctttcccccgtacggtccccctaccccgtcccctaccgaaccggtaccgcccgtaacccgttcgggtcccggggacctaacccggaccggtccccgggtcccgtcggggtacctccggtacccggtcgggtaaccgaaccgggttacccttaaccgttcccgaacggtacccgtcgggtaacccggttaccgtacgggaccgggtcccggggtacggttccggggaccggtaaccgggaccgg

SEQ ID NO: 41109 - DNA, 753 bp, Homo sapiens
  misc_feature: GYAE6OF01CH4EN.36.85.H08.1.454.CMB.1.raw
tcagtacgctgtctcacgaccggtgctcgatttagtatcactcagtcgcgggggaggaactgctcagttaggacccagagggaaccatggaacgccccagctcagcttctcttcctcctgctactctggcctccagactaccgaccggagtaaattgtgttagacacagtctccacgccctacccttattctttcgacctccggaagggggacgacgccctaccctctcctgcgacggccacgccaggtagttagttaacgtactaaaacttcgtaccgttaggtaactacgaaaacaaagcgtacggacctacggccctaccgacgtccctctactagtactatacgtatcgtaccgttaaccggaaaccggtccccgtagaccctaacctacccgtaacgttagggtacacggtcgaccgtgggttaccgggtagtacggactaacgtcccttacgtacctctaccaacagtaccgaacgtccgtacgtaccgagacgtaccgttagtaactttactttcggtaacctttaagttttacctacgtacgtaaccgacgtaacgtaacccgttacgtaaccggttcgggtaccggtaccgggtttaccgaaccggtaaccggaacggtaacggtaaccgggtaggtaaccctaaaggtaccgtaggtaccggctacggacctaaacctgttacctacttaccgttctacccttcccgtaccctcgtaattccgaaacgtccggtactaccggg

SEQ ID NO: 41110 - DNA, 874 bp, Homo sapiens
  misc_feature: GYAE6OF01CKDKW.36.85.H08.1.454.CMB.1.raw
  modified_base (358)..(358): a, c, t, g, unknown or other
  misc_feature (358)..(358): n is a, c, g, or t
tcagtacgctgtctcacgaccggtgctcgatttagtatcactcagtcgcggggctgaaatgaagaagccgtggggcctcagtgaaggtgtcctgcaagacttcaggatacaccttcactagtttatagaaatcaacgtggggtgacgacgaggacccagagggaacgaagggtctttaggaggtggagtggggagtggggtaccgtaaccctttagtaggtggtagacaacgagtattatgacaactaaggtaacgttccgagggacaagaactccaaccagaccgaaccaaggaaacacgacctacaaactaaactactaagttaacacgtacggtaacaacgaacgtaggttacgnggacgaccgtaccggacggtaccgaccggtacgttacgttaacttacggtaggtacggacggtaacgtaacggtaacgtaacggtttagtttttacggacggttaagggtacggtaaacggttaacgggtacccgggggtacccggtacccgggtaccgggggaccggaacccggggttaacccggttcggtaccccgtacccggttcctaccctaccgtacccggtccccgtaacccgaaccgggtaaccccgggtccctaccggtttcccccgggttaccctttccccccggtacccggaccccttaaccccgttacccaaccggaaaccggcctaccccgaccgggttccgggacccgggggaccaacccggggcccggtacccgggtccggtacccggtcgttacccgggccggttaccggaaccggttaaccgtaccgttcccgtaaccggaacggtacgccggttacggtaccggcggacggggtacccggtcggcgggaaccgtacggg

SEQ ID NO: 41111 - DNA, 677 bp, Homo sapiens
  misc_feature: GYAE6OF01BB3NV.36.85.H08.1.454.CMB.1.raw
  modified_base (229)..(229): a, c, t, g, unknown or other
  misc_feature (229)..(229): n is a, c, g, or t
  modified_base (431)..(431): a, c, t, g, unknown or other
  misc_feature (431)..(431): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccgaggggaagagccaccctctcctgcagggccagccaggngtgttacgtacaaaaacctttagcccttaggtatacaaaacaaaaagctggcctaggcctcccagggcctcctcatctaatgatcgtcttaccgaaaacgggtcccctcggcacgtacccaaccgtaggttacaggtcgccgtagggtcgggtccgtagggaacgagtacttaccacctctacctaccacttcgaacgcacncccgtaagaccggcctagaactttagtttgacctttactttattacctaggtaccaactacggaccgtacctaaccgtgggtaccgtaccggttccgggaaccggaagggaacccgtaacgggtaccggaaggttaccgaaacgtacgtcggtcggcctaggtcaacccgttagttccccgttaggttccctttcgtaccttccccgtttaccccgctacccggtataccggaagtaacccgtagg

SEQ ID NO: 41112 - DNA, 522 bp, Homo sapiens
  misc_feature: GYAE6OF01D82V4.36.85.H08.1.454.CMB.1.raw
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
  modified_base (401)..(401): a, c, t, g, unknown or other
  misc_feature (401)..(401): n is a, c, g, or t
tcagtacgctgtctcacgaccggtgctcgatttagtatcactcagtcgcgggaggagcagtacaacagcacgtaccgtgtggtcagcgtcctcaccgtcctgcaccaggactggctgaatggcaaggagtacaagtgcaaggtctccaacaaagccctcccagccccccatcgagaaaaccatctccaaagccaaagggcagccccgagaaccacatctgtcctctagagaaaaccctgtagagcacagcctcctcaccatggactggacctggagactcctcgttctggtgcagcagctacgagtcgcccactccaggtcgacaacgtggtncgtagtcgngggctagaaatgaagagccgtgggctgagtgagtncgtgacagtctagagactacactnactagttatagaatcgagtggtgcgacagccagaggacgtaggtctgagtaggagtggagtgggtacgtaaccgttagtaggtaggtgacgtagagtattagagactaacgaggtaaccgg

SEQ ID NO: 41113 - DNA, 798 bp, Homo sapiens
  misc_feature: GYAE6OF01CCRLK.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctccagataccacggagtaaattgtgttgacacgagtctccagcccacccttattctttgtcctcggaggggaaggcgcccacccttctccgtgcgacgggccacgaccgaggtcgttgttaacgtaactaaaacgttgaccgttaggtaactaacgaaaacgaaaagtcgtacggaccgtacggcctacccgacggtccctccgtacagttcgtatgtacttcgtaacccgttaacccggaaaccgggtccccctaggccctaaaccgtaccccgaaccgtacggtcacggtcgaccggtagggtcggtcgtacgggactaacggtccttcgacttccctaccacgtactaccgacgtaccgtacgtacccgtaaggtaccgtccggttaaagttacggtttacgtttttacggtaacccttttaaaccggtttttattaaccttaacggtaactaaccgtacggttacccgttaaacccggtaccgttccgggtaacggttaccgggttacccgggaaccggtaaacgggtaacccgggtaacgggtaccgggaaacggtaaccggtaaaacgtacgggttgtacggactacggaccctacgtaccggttcttacgttccttaccgtacgttcccgtacccctgtactagtaccggaagtccgtacgg

SEQ ID NO: 41114 - DNA, 791 bp, Homo sapiens
  misc_feature: GYAE6OF01DE4QO.36.85.H08.1.454.CMB.1.raw
  modified_base (535)..(535): a, c, t, g, unknown or other
  misc_feature (535)..(535): n is a, c, g, or t
tcagtacgctgtctcacgaccggtgctcgatttagtatcactcagtcgcgggggaggaactgctcagttaggacccagagggaaccatggaacgccccagctcagtcttctcttcctcctgctactctgcctaccagactacccgacggaagtaaattgtgttagacacgtgtcctaccacgccctaaccttattcctttcgtcctaccggaaggggggaacgacgtcccctaccccttctcccgtaggccgacgggccaacggccaggtaggttacgtttaacgtaaacctaaaacgttttcgaccgtttaagggttaacctaaaccaaaacgaaaaacgtccgtacggacccgtacgggaccttaccccgaggtcccttcctactacttactagtacgtacgtccggtacccgttaaacccggaaacccgggttcccccgtaggaccctaacctacccgaacgtaggttacgacggttccgaaccgtggtccggtacggtacggactacggtacctcgtcctccgtcaactancacgcgaccgtactagaccgtataacggttattaacgtttcgaacttttaactttactacggtacttaccgaaacttcggtaaccgtaacccggacggttacgggtaccgttaccgggtaacgaacccgggaaacggtaacgtacgggtagtaacggtaaacgtaacggtacgtcgtaacgggtccaacgtccgtatcccgttagtccctacgtttctaccgtcccttaccggcttacagacccgtaagtccgtac

SEQ ID NO: 41115 - DNA, 748 bp, Homo sapiens
  misc_feature: GYAE6OF01CM65H.36.85.H08.1.454.CMB.1.raw
  modified_base (676)..(676): a, c, t, g, unknown or other
  misc_feature (676)..(676): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctccagactaccaccggagtaaattggtgttgacacagtctccacgcccaaccctattctttcgtcctaccgagggggaacggacgcccaccctctcctgccaggggcccagccaggacgttgttacgtactaaaacttgcctggtaactacaaactaaaaagctacggccaaggcctaccgacggtcctaccctcaattcctagtggtaactcgtacctttaacccggaaacggggtccccccttaggaccctacttaccccgaacgtacggtttccacggtcgacccgtagggttcgggtaccgttagggactacgtaccttctaacctcgtaccaccagtccagtccacgtaccgtacggacgtacccgttaggtaaacttcgttttacgaccttttaacgttttaattacgtactaaccgaactacggtccgtaaacctaacggttcggaccggtacgttaccgggaaccgtaacgggtaaccggtaacgggtaccgaaggttaacccgaaacgttacgtggttaacgggctacgccgtaaccncgtccgttcgttaccttccgtaacgttccccgtttccaacccgtagttacccgtaacgaagccggttaacgg

SEQ ID NO: 41116 - DNA, 792 bp, Homo sapiens
  misc_feature: GYAE6OF01EZLXU.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccgaggggaaggacgccaccctctcctgcagggccagccagagtgttagtacaaaacgttgcctaggtatacaaacaaaagctaggccacggcctccaggcctcctcatctatgtatcgacttaccgaaaacggggccccctggacccactaccccaacgtacggttacagtcgaccgagggttcgggtcgtgggaaccaggtacctttcgaccttctaccgacctactaccgaacgccgtacgacccgtaaggacgtacccgttaaggtaaacgttacgtttttacgacctttaaactttttaacgttaccgttacgtaacctaaacgttacgggtacccgttaaacccgtaacggttccggggtacccgggttaacccgggtttaccgggaacccgggtaaacgggggaacccggtaaaccggggttacggggtaaacccggttaacgaaaaccgggttaccgttacgggtaccgggtaccgttacggaaccctaaccggttaccgttccgttaccggtttaccttacccgttaccgtttacccccgtttacccccgaaccgtttacttacccgtaacgggtaaaccgacccggttaacggg

SEQ ID NO: 41117 - DNA, 1136 bp, Homo sapiens
  misc_feature: GYAE6OF01CJO8F.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacacctttcacagtttatgaatcaacgtgggtgcgacaggccacaggacaagggcttgagtggatgggatgggtacaacccttagtaggtggtagacacgagtattagtgaccgtaactaaggtaacgttcccgaaggggaccaggtaaacttaccaacccgtaatacggaaccaaacgaacgaaccgtacctaacccgtaaacttaaaaccctaacgttaacgtttaacgtaaccggtaacgggtaaaccgtagtaaaaccgttacgggttaccgtaaggtaacggtaccccgttaccgggaaaccggggtaccgtaacccgggttacccgttaaatttaacgtttaccggttacgggttaccggaaacggtaacggtaaaccggtaaaccccttaaaagggttttaccgttttttaacgggggaaccggttttaacggggttaaagttaaaacccgggtttaaacggggtaaacccgggggttttaacccccgggtaccccggggttaaccgggggggtaaccccggtaaacccgggggtttaaaaccccggttcggtttaaaccccggtaaccccggtttcccgttaacccccggttaacccgtaccccggttaaccccgtaacccccggtaaaccccgggtaaaccccggggtaacccccgtttaacccggttacccccgggttttacccccccgtttaccccccggttacccgggtaaaccccccttaccccccgtttaaacccccgtacccgtaaaccccgggtaaccgttaacccccgtaacccgggtaccggggtttaccccgggggaacccggtaacccggtaacccgggggtccccggggttacccggttacccgggttccgggttaccccgggtccggtttaaccgggtacccgtaaacccggttaccgtttaacccggtttaaccccgaacggtaacccggtccgtaccggtttaaaccgggaccggggtaacgggttcccgggtaaacgggttcccgggaacgggtacccggaacggg

SEQ ID NO: 41118 - DNA, 823 bp, Homo sapiens
  misc_feature: GYAE6OF01EG12R.36.85.H08.1.454.CMB.1.raw
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
  modified_base (804)..(804): a, c, t, g, unknown or other
  misc_feature (804)..(804): n is a, c, g, or t
tcagtacgctgtctcacgaccggtgctcgatttagtatcactcagtcgcgggaggagcagtacaacagcacgtaccgtgtggtcagcgtcctcaccgtcctgcaccaggactggctgaatggacaaggagtacaagtgacaaggtctaccaaacaaacgcccctacccacgcccccatacgaacgaaaaccnctaccaccaaacgccgaaaacggccaccgaccccgaanaaccgacactcgtacgttcctactaacgaaacgtaaacccgtggtacgacaccaaccgcgtaccctccctaccaccgtagacggaccgtacggacctagggaacggttacttcccttacgttttacggttcgggtacggaccgtacggacgtaacgtaaccgttaacgtaaccggtccccgtaaccccgtacccgtacccggtaggttccaaccgggggttaatcgggtacgacggtacggtcggtagggtaacctaaggtaaacgtaggaaacgggtccggaccgggttacggggtaccttacgggaggttaacgggtacggttcgtacccgtaaggaacgtaacgtttaccgtaggtacgtacctaacccgttaaccttacgtaagttaacgtttacgaagtaaaccttacgggtacggtacgggtacgacgtaaccgacgaaccggaacggtaacggaccgggtaaccggttgtaaggtacggggtaggtaacgggttggtaaccggttacgggtaaaccgttaacggttgttagggtaacgcgtaaccgtagttacgttataggtaccgntaaacggcggttaaaccgg

SEQ ID NO: 41119 - DNA, 758 bp, Homo sapiens
  misc_feature: GYAE6OF01DI9J4.36.85.H08.1.454.CMB.1.raw
  modified_base (750)..(750): a, c, t, g, unknown or other
  misc_feature (750)..(750): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctgctccagataccaccggagaaattgtgttgacacagtctccagccaccttatctttgtcctcggaggggagacgcccacctctctgcgacggccacgccagtacgtgttaacgtactaaaacgttgtccttaggtaactacgaaaacgaaaaagtccgtacggacctacggccttacccgacggtcctcctaccattaccttagtagtacttacggttaccgttaacccggaaaaccggggtcccctaggtaccctaacgtacccccgtaaacgtaacggttcgacgtcgaccgtagggttcggtcggtaacggggaacctaacggttacccttacctacttacccgtccaacccgtactacgaccggactaaccggtaccgtaacggtacgtacccgtaacgttaagtttacgttttacgactttaaacgtttttactaaccgttgttaccaaacgtcgtaaccgtaaccgtacggtacgggtccggttaccggttaccggaacggtaaaccgggccggtaaaggtccgggtaacgaaccgtaacgtacgtggtcggacctacgcctaacctcgtcttacgttctctaaccgttccctacccgtaccttagtacgtacgacgnggtaaccg

SEQ ID NO: 41120 - DNA, 891 bp, Homo sapiens
  misc_feature: GYAE6OF01B0HYT.36.85.H08.1.454.CMB.1.raw
tcagtacgctgtctcacgaccggtgctcgatttagtatcactcagtcgcggggaggagcagtacaacagcacgtaccgtgtggtcagcgtcctcaccgtcctgcaccaggactggctgaatgggacaaggagtaacaagtgacaaggtctaccaaacaaacgccctcccacgccccccataccgaacgaaaaaccatacctaccaaaggaccgaaacgggcacgaccccgaagaaacccacactctcgtccctacgtaacgaaacgtaaaaccctggtacgaacgaccaaccacggtccctacccgtaccaaccgtaacgtcgggtaccgtacgggtacccttaggggaacggtaccttacccgtttatttccggtttagggtccgggtaccacgggtccgtaacggtacccttaacgaacggtcccggtacccaacccgtcccggaacgggttacacccgttaaacggtcgggtacgaccggttacggtcggggtacgggtacgtaaaggtaaacggtacgggtaaaacggtaaccggtcccgggtacggggtacccgttacggtaacgggtaggggtaacgggtttcgtaccgtaggtaaccgaacgttaccggttacgtaacggtaacttaaccgttaacccgtttaacgtaacgtttaacgtttaactaacgttaaaccgttaccggttaaacgggttcgggtaaccgtaccggaaccgtaccggaacccggaaccggtaaccggtaaaccgggtaagggttacggttaacgggtagggtacgggtagggtaacgggttagggtaaccgggttaacgtaaccggttagtacgggtaggtacggaacgtagtaacggttatacggtagactaaggtaacgtaaccggg

SEQ ID NO: 41121 - DNA, 701 bp, Homo sapiens
  misc_feature: GYAE6OF01DL89A.36.85.H08.1.454.CMB.1.raw
  modified_base (125)..(125): a, c, t, g, unknown or other
  misc_feature (125)..(125): n is a, c, g, or t
  modified_base (191)..(191): a, c, t, g, unknown or other
  misc_feature (191)..(191): n is a, c, g, or t
  modified_base (212)..(212): a, c, t, g, unknown or other
  misc_feature (212)..(212): n is a, c, g, or t
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
  modified_base (642)..(642): a, c, t, g, unknown or other
  misc_feature (642)..(642): n is a, c, g, or t
  modified_base (669)..(669): a, c, t, g, unknown or other
  misc_feature (669)..(669): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcactagtttanagaaatcaacgtggggtgcgacaggccagaggacgaagggcttggagtaggagtgggattgggtanaaccttagtagtggtgaccanagatatgacacgaggtaacgttcgaggacaagactcgaccatacgaacaagaacagtacctacaaactaacaattagttacagtacggaactagaacagtctagactacgtaccggaaggaccgtacggaccgttaattacgtacgtgtacgaggtaanaacggtaacaagtttgtttacggnttaagggtacgaagtaacgtacgggttacccgaccggtcgggacgaacgtacccgtggtacctccgtctacccacgtaccgaccctacggaacccgacggtacccgtacgttccgtcccccgttaccgaccgtcccgtaccctacctaaccgacgcgtaccgtccgtacgggtccgggaccagacccgggtccaccccggtgggcctcgggtaccgtacgggactaaccggttcccttaaccggtanaccgttaacgccggttacgtaaccggngggtaacgccggggttacaacgggctaacggg

SEQ ID NO: 41122 - DNA, 768 bp, Homo sapiens
  misc_feature: GYAE6OF01EMSBT.36.85.H08.1.454.CMB.1.raw
  modified_base (193)..(193): a, c, t, g, unknown or other
  misc_feature (193)..(193): n is a, c, g, or t
tcagtacgctgtctcacgaccggtgctcgatttagtatcactcagtcgcgggaggagcagtacaacagcacgtaccgtgtggtcagcgtcctcaccgtcctgcaccaggactggctgaatggcaaggagtacaagtgacaaggtcctaccaaacaaacgcccctcccacgccccccataccgaacgaaaaccntacctaccgaaacgccaaaagggccacggaccccgaagaacccacatctcgtcctactaagaacaaaccctgtacgacgcactacgcctccacaccgagtcggacgtcggactaggacgtctccttcgttcgtggtagcagcacgtactaacacggtccgacccacctaccggaggtcgactaacggtggtcaccgtacggtcggtacgggtactaaggaaagtaggaacgtacggtccccggggtaggggcccttagagggtacggtaacgggttccgtacgtagtaaccgaacgttaccgttaacgtaacggtacttaaccccgtacgttaccgtaaacgtttagtttaacggtaacgttaacgttaccggtaacggttcggggtaacgtaccggaaccggtaccggaacccggtaacggtaaccgggggaaacgtacgggggttaccttagggaacgggttaacgggtagggttacggggtacggtttaccgggtaaccgttaacggtttaggtagggttacgtaacgaccgtaagtaggtactagtaccgacggtaaacgttggtaaccgg

SEQ ID NO: 41123 - DNA, 711 bp, Homo sapiens
  misc_feature: GYAE6OF01CNUQY.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggcctccagataccgaccggagaaattgtgttagacacaggtcctccagcccaccctatctttgctaccgaggggaagacgcccaccctctcctgcagggccagccagtgtgttagactaaaactttggcctggtactacaaaacgtaaaagctacggccacgggcctacccgaggtccctcctcatctatcgattcgaccttaaccgaaaccgggtccctggaccaccgtacccaacgtacggttcacggttacgccggtacgggttcgggtacgtagggacctaaggtacccttaccgaaccttctacccaacctagtcccaaggtccgaaccgtaccgtaggaccgtaccgttaggtaaccttgttttacgacttacgttttaattaccgtacggtaccaacgtacggtaaccgtaaccgtaggtccgggtaaccggtcgttacccgggaaacggtacggaaccggtacggtacggaacgtaacgaaacggtcgtggtaccgacgtcgtaccacgttacgtctaccgtttctccttaccgttaccccgtcccgtacttaccgacgttagacgtaccgtacgg

SEQ ID NO: 41124 - DNA, 890 bp, Homo sapiens
  misc_feature: GYAE6OF01AU65L.36.85.H08.1.454.CMB.1.raw
  modified_base (217)..(217): a, c, t, g, unknown or other
  misc_feature (217)..(217): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggcctccagataccaccggagaaattcgtgttgacacgagtctccagcccacctatctttgcctccgaggggacgcgcccacctctccgtncgcgggccagccaggtagttgttagacctaaacgttcgcctaggtactacgaaaacgaaaagcgtacggaccgaggtcctaccgacggtcctcctacgattactagtagtacctaacctaccgtaaccgaaccggtaccgggtaacccgtacggttaccgggtacccggtaaccccgtaagggtaacccgttacgggttaccgaacggggtttaccggaaccggttacgggtttaccgggggtaccggttaccggggtaaacctaccggttacccgtttacccgaaacccgtttaccgttaacccgaaaccctttacggtacccgtaacggaccccgtaacgggttcccggtaaccgggtaaccgttacccggtaacggttaaacgttacccggtttacgtacggttaacccgttttaacgttttaccgtaccgtttcgggtaaccgtcgtaaccggttaacgttacccggtttaagtaccgggtttccgaacccgttcccggttaaccgtccgttaaccggttccggggtacgggtaaccgggttacccggtagggtaaccggtacgtaacccggttaaactaaacccggggtacttaacgggtcggttaaccgccgtaaccccgtactacggtttaccgacggtttacccttcgttaaaccgttccccccg

SEQ ID NO: 41125 - DNA, 689 bp, Homo sapiens
  misc_feature: GYAE6OF01BRTYQ.36.85.H08.1.454.CMB.1.raw
  modified_base (210)..(210): a, c, t, g, unknown or other
  misc_feature (210)..(210): n is a, c, g, or t
  modified_base (296)..(296): a, c, t, g, unknown or other
  misc_feature (296)..(296): n is a, c, g, or t
  modified_base (454)..(454): a, c, t, g, unknown or other
  misc_feature (454)..(454): n is a, c, g, or t
  modified_base (604)..(604): a, c, t, g, unknown or other
  misc_feature (604)..(604): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggcctcccagactaccaccggagaaattgtgttagactacagtctccagccacctatcttgtctccgagggagcgccaccttcncctgcgacggccagccagagtattagtactaaacgttgccttggtactacaaacaaagctacggccaggcctaccgacgcctcctntatctatgatcgtaccttaaccggaaacgggccctggacctaacctacccgaactacggttcacgtcgccgaggttcggtcgtacgggactacgtaccttcaaccttcctaccaacgactccgagccacgtacgtaacggcgtacctagttaacgttnttttacggactttaaacgtttacttaaccgttgtacctaacgagttaccgtaaccctaacggttccgggaacgttacccggtaaccgggaaccgggaacggaacccggtaagggtaccgtaacggtaaccggaaactacgggtacgtcgngtccgtaaccgtactcgttacgttaccgtcctttccgtaccctttcccgtacccgacttacgtacctaggtaacccgcgtaccgg

SEQ ID NO: 41126 - DNA, 821 bp, Homo sapiens
  misc_feature: GYAE6OF01APCNT.36.85.H08.1.454.CMB.1.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (811)..(811): a, c, t, g, unknown or other
  misc_feature (811)..(811): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggcctcccagactacccaccggagaaattgtgttagacactagtctccagccaccctatctttgcctccgaggggaacgcgcccaccctctccngcgacgggccagccagngtnttagacaaaacttcgcctaggataccaaaacgaaaagcgtacggccaaggtccctacccgaggtccctcctctatctactagctacgtaccgttacccgaaaccggggtccccctaggacctaaccgttacccccgaaaccgttacgggtaccgtaacgtccggtaccgtaaggggttccggggtaccgttacgggaacgtacggttaccctttacccgacctttaccgtaccctaaaccctacgtaccgaacgtacccgtaaccggcccgttaaacgaccgggtaccttaaggttaaaacgtttcgtttttacaaccgttttactttttaacgtacgttaccgtaacctaaccgacgttaacccgtaacccgtaacgggtcgggtacccggttaccgggtaccggaaccgggaacgggtaacccggtagggtaaccggttaaaccggaaccgtaaaacgtccgggttacggacggtcgttaaccgaccctaccggttaacttccggttacccggtttactcccgttaccgttcccctcccggtaccttacggtatacccgggtaaacgtnttacccgggg

SEQ ID NO: 41127 - DNA, 853 bp, Homo sapiens
  misc_feature: GYAE6OF01ERIKT.36.85.H08.1.454.CMB.1.raw
tcagtacgctgtctcacgaccggtgctcgatttagtatcactcagtcgcggggctgaaatgaagagcctgggcctcagtgaaggtgtcctgcaagacttcaggatacacctttcactagtttatcgaaattcaactgggtgcgacaggccacacggacgaagggcttgagtggagtgggatgggtcaacccttagtagtggtgacagacgattatgcaacgtagtacgttaccgagggtacaagtaactaccaccgaatacgaccgaaagaaaccgacgtacctaccctaaactaaaaccctacgttaacgtttaacgaacgttacggtaaccgtaagtaaacctaggttaccgttacggaccggtaccgtacccggggtaacggaccggtaccgggtacccgttaacgtttacgttttaccggtagtcggacggtaacggtaacgtaaccgtaaaccggttttgttttaacgggacgtttaggggtaacgtaaacggttacgggtacccggggttacccgacccgggtaacggggaccggtaccgggtacccggttacgtaccgtaccgtacccgttccaccgtacccgtcccgtacccgaacccggtacccggtaccctacggttcccgttacccccgtttcccccgtcggtacccccttcccgttaccctaacgtaacccggtccacccgtcggtccgggtccgggaccgtaccggaccggtccgggtcccggtcgggtaccgttcccgccgttaccggggtaccgtaacgtacccggttcccttacggacctaccggtcgtacccgttaacggtcggaccgggtccgggaacgtcgggaacggtaccgg

SEQ ID NO: 41128 - DNA, 947 bp, Homo sapiens
  misc_feature: GYAE6OF01CZOR4.36.85.H08.1.454.CMB.1.raw
  modified_base (146)..(146): a, c, t, g, unknown or other
  misc_feature (146)..(146): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcactagttatagaaatcaacgtgggtgcgacncggaccacgaggaccgaagggtcttggagtggagtggggagtcgggtactaacccgttagtaggttggtacgacaacgatagttactcgacaacgtaaggtacggttacccgagggacaacgtaactacccgacctagtacgaaaccgaacggaaccaacggtaccctaacaaaactaaaccgtaacgtttaaacgttaaccgtaagtaacggtaacgttacggaaaccgtacggttacgtaccggtacggtacccggtaacccggaacgggtacctaacccgggttccgttaaacgtttacgttacggttaggtaccggaacgggtacgaaacgtaaccggtaaccggttttagttttacgggtacggttaacgggttaaaggtaaaccgtttacggggttaaaacccgggggttcccgtaaccccggggtaccggggtaacccgggaaaccgggttaaccccggtcggttaacccgtacccgggtacccttacccggtacccgacccgttaccccgaaccccggtaacccggtaccggtaccccgttaccggtttacccccggttaccccggttacccccgtaccgggtacccccgttacccccggtaccccgtaaccgtaacccggtacccgtacccgttaccgggttaccggtaccggggtaccctaaccgggtcccgggtaccccgggtacggtccggtaccggtaccggtccgggttaacgacgtaaccggttacctaccgtacgaccggacgtactacggacggtacggaacggtggacgttcggcggtaaccg

SEQ ID NO: 41129 - DNA, 774 bp, Homo sapiens
  misc_feature: GYAE6OF01D7XP0.36.85.H08.1.454.CMB.1.raw
  modified_base (190)..(190): a, c, t, g, unknown or other
  misc_feature (190)..(190): n is a, c, g, or t
  modified_base (481)..(481): a, c, t, g, unknown or other
  misc_feature (481)..(481): n is a, c, g, or t
  modified_base (746)..(746): a, c, t, g, unknown or other
  misc_feature (746)..(746): n is a, c, g, or t
tcagtacgctgtctcacgaccggtgctcgatttagtatcactcagtcgcgggaggagcagtacaacagcacgtaccgtgtggtcagcgtcctcaccgtcctgcaccgaggactggctgaatggcaaggagtacaaggtgcgaaggtctaccaaacaaacgccctcccacgcccccatacgaagaaaaccntactaccaaacgccgaaaacggcacggccccgaagaacccacactctcgtcctactaaggaacgaaaacccgtgacgacgcaacgactcctacctcgaccgacgtcggtacgtcggacgtaggacgtacttccttcgttcgttcgggtggctacgccgtaagtccgtaagacggtccgaccctaccgtcccgtaggtcgcgtaacggttcggtcgtaccgtaggtacggaccggtacgtagtaaacggtacggtaacggtaacggtcccggtcgggtacctacggtacggnggtaacgggttctccggtacgtaaccgtaacgtaccgtacgtaacgtaccgtaccgttacccgttagtaaccgttagtttacgtaaccgttaaacgtaccgttaaggtcggtaccgaacggtacgggaccgaacccgtaagggacccgggtaaggtacgggttaggtagtaacgggttacggtacggtacggggtgtaaccggggttactaaacccgggttaaggtacggtacggttcgaaacggttcgaaaggtttcgttaaanaccggagttaaaccgtaggtaaacccgg

SEQ ID NO: 41130 - DNA, 773 bp, Homo sapiens
  misc_feature: GYAE6OF01DF7BU.36.85.H08.1.454.CMB.1.raw
  modified_base (765)..(765): a, c, t, g, unknown or other
  misc_feature (765)..(765): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcactagtttatcgaaatcaactcgggtgcgacaggccacaggacaaggcttgaggtgatgggatgggtacgtaacccttagtaggttggtagacaacgagtattatgacaacgaaggtaacgttaccgacgggtacaacgaacttccaccgtagtacgaaccgaacgtaaacgacactaccaacgtaaaccaacttacgtttaacaacgtacgtaacgtactaaaccgtagtacgtagtacggtccgtacggacggtaccgaccgggttacctattacttacgtacgtacggacgaacgaacgtaaccgtaacggtttacgttttcggaacggttaggtaacggtaaacgttaacggggtaacgggttacccgtacccgggtacggggacccgtaaccgggtaaccggtcgttaccgtacccgttacgtacccgtaccgtaccgtccccgtaccgaacccgtaccggccctaccggttccgttaccccctcccggtcggtcccctacccgtccctacgtaaccgccgtacgtccgtcggccgggactacccggcggcccgggtccgtcggtaccgtcgtccggtacgaccgtaggtaccctacgtcgaacggaccgtcgaccgttagcggtacgggccgttaacgccgggntaaccggg

SEQ ID NO: 41131 - DNA, 1016 bp, Homo sapiens
  misc_feature: GYAE6OF01BZUK3.36.85.H08.1.454.CMB.1.raw
  modified_base (704)..(704): a, c, t, g, unknown or other
  misc_feature (704)..(704): n is a, c, g, or t
  modified_base (1001)..(1001): a, c, t, g, unknown or other
  misc_feature (1001)..(1001): n is a, c, g, or t
tcagtacgctgtctcacgaccggtgctcgatttagtatcactcagtcgcgggggaggaactgctcagttaggacccagagggaaccatggaacgccccagctcagcttctcttcctcctgctactctcggcctcccagactaccgaccggaagtaaagttcggtgttacgaacacgtacggttccctaccaaccgtcccctaccctttacgttccgtttttccgtaccgtaccgggtaaaggggggaacgtaccggaccccctacccccgttccgttacccggtgacccggtaccgggtacccgaccggtaccaggttaacggtttacggttttaaaccgtaaaaccgtttaaaaccgtttaccggtaccgttagggttaaacctaaaccgttaaaaaacggaaaaaccggttccgggtaccggtaacccggtaaccggtaccccgttaccccgggacggtaacccctttcccgttaacttaaccgtttacgttacgttaacggtaccgtttaaccggtaaccccgtttaaacccggggtaaaccccggggttcccccggttaaccgggtaaccctaaccccgtttaaacccggtaaacccggtttacgggttaacccgtacggttaccggaccgggttacgggtccgggtacggtaacgggaacctacggttacctaccgtttacctacgtaaccctaaccgntaacccgggatacccggacggtaacgtacgtaccgtaacgtacgttaacggtttctttacgttaccttttaacggtttactacgttaacgtaaccgtaaccggtacctaacccgggttaaccgacggttaccgggtacccgggtacgttacccgggaagtaacccgggtaaccgtaacggtaacggggtaaccgtaaaccttaacgggcgttaccggacgtaccgttacccgtacgtaacctcgtttacgtcccgttaccgttctacccgttcgtaccccgtattacgacgttaacnccgggtaacctcggg

SEQ ID NO: 41132 - DNA, 509 bp, Homo sapiens
  misc_feature: GYAE6OF02ISWVQ.36.85.H08.1.454.CMB.1.raw
  modified_base (413)..(413): a, c, t, g, unknown or other
  misc_feature (413)..(413): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaggagccacctctcctgcagggccagccagagtgttagtcaaaacttagcctggtatcaacaaaaagctggccaggctcccaggctcctcatctatgatgcttccaaaagggcccctggcatcccaacaggttcagtgccagtgggtctggacagacttcactctcaccatcagcagcctagacgcctgaagattttgctactttattactgtcaacngccgtacactggcgtacgttcggcaaggaccgaggtcgaggcaaacgatgtgctgcacatctgtcttcattctcccgcctatcctagacgacacgg

SEQ ID NO: 41133 - DNA, 570 bp, Homo sapiens
  misc_feature: GYAE6OF02I5MRW.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgattttggactggtgaatacgagggttcgaccctggggccagggaaccctggtcaccgtctcctcacgcctccaccaacgggcccactccggtccttcccccgtggccaccctccctaccaacgacgcaccctcgtcgggggcacgacgccggcccgtcgggcctcgccgtcgggtcaacgggaccttaccgttacccacggtacacgccgtaacgtcggacggcgggcgtgggacaacggg

SEQ ID NO: 41134 - DNA, 721 bp, Homo sapiens
  misc_feature: GYAE6OF02JSR1L.36.85.H08.1.454.CMB.1.raw
tcagtacgctgtctcacgaccggtgctcgatttagtatcactcagtcgggcgtgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgacacagaagttccagggcagaatcaccatgaccagaaacagctccataaacacagtttacatggaactgaacagtctagagctccgaggacacggccgtatacttactcgtagcgaggacgacgaacgtagtttttaggacttgggttagaaacttacgaaacgggggttttaccgaaccccggttgggggacccgtaacggggaaaccccttggggtacccaaccggtttccgtccctacgtacgtccctacccgaacccgaacggggtcccctaacgttcccgggttacccttcccccgttaccggacccgtacccccgttacccgtaccccgaaacgtaccggaccctacccgttccggttcgggggacccaccgtaccggcccgggcccgttcgggggccttcggcccgttcgggtacccgtaacggtacccgttacccgtcccgtaacggaccgtaacggacccgttacgtacggaccggacggggtccctacgggaccgaacgggccg

SEQ ID NO: 41135 - DNA, 548 bp, Homo sapiens
  misc_feature: GYAE6OF02HHANR.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgtattttggactggtgaatacaaggggttcgacccgtggggccagggaaccctggcaccgtctcctcagcctccaccgaacggcccatccggtccttcccccgtggcccacccctcctcccaagacgccacctcgtcggggccacgacgccggccctgggctcgcctggtccaaggtcctacttccagacacgcgtacgtcgagccgggctggacacggg

SEQ ID NO: 41136 - DNA, 511 bp, Homo sapiens
  misc_feature: GYAE6OF02GA4H7.36.85.H08.1.454.CMB.1.raw
  modified_base (208)..(208): a, c, t, g, unknown or other
  misc_feature (208)..(208): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctntcctgcagggccagccagagtgttagtcaaaacttagcctggtatcaacaaaaagctggccaggctcccaggctcctcatctatgatgcttccaaaagggcccctggcatcccaaccaggttcagtgccagtgggtctgggacagacttcactctcaccatcagcagcctagagcctgaagtattttgctactttatactgtcaacagcgtaccaactggcgacgttcggccaagggaccaaggtcgaggtcaaacgaactgtgctgcaccatctgtcttcatcttcccgctatctgagcacg

SEQ ID NO: 41137 - DNA, 561 bp, Homo sapiens
  misc_feature: GYAE6OF02FLEYF.36.85.H08.1.454.CMB.1.raw
  modified_base (548)..(548): a, c, t, g, unknown or other
  misc_feature (548)..(548): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgatttttggactggtgaatacaaggggttcgaccctggggccagggaccctggtcaccgtctcctcacgcctccaccaagggcccagtccggtcttccccctggccaccctcctcccaagcgccacctcgtcggggccacgagccggccctggggcctcggcccgtgggtccaacgggacctaccgttccaaggaccaggccgtactcggacggccgggtcncgggacagggccg

SEQ ID NO: 41138 - DNA, 516 bp, Homo sapiens
  misc_feature: GYAE6OF02GJZFN.36.85.H08.1.454.CMB.1.raw
  modified_base (208)..(208): a, c, t, g, unknown or other
  misc_feature (208)..(208): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctntcctgcagggccagccagagtgttagtcaaaacttgcctggtatcaaacaaaaagctggccaggctcccaggctcctcatctatgatgcttccaaaagggcccctggcatcccaaccaggttcagtgccagtgggtctggacagacttcactctcacatcagcagcctagacgcctgaagtattttgctactttattactgtcaacagctaccaactggacgtacgttcggcaagggaccaaggtcgaggtacaaacgaactgngcngcacatctgtcttcatccgttcccgcctatctgacgatacg

SEQ ID NO: 41139 - DNA, 559 bp, Homo sapiens
  misc_feature: GYAE6OF02HGZD5.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgatttttggactggtgaatacgaagggttcgacccgtggggccagggaaccctggtcaccgtctcctcagcctccaccaacgggcccagtccggtccttccccctggccacccctccctccaagacgccaccctcgtcgggggccaccgacgccggccctgggcctcgcccgtggtccaagggacctacttcccgagaccacgccgtactcggagccgggctggcaacggg

SEQ ID NO: 41140 - DNA, 510 bp, Homo sapiens
  misc_feature: GYAE6OF02G0R4T.36.85.H08.1.454.CMB.1.raw
  modified_base (421)..(421): a, c, t, g, unknown or other
  misc_feature (421)..(421): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaaacaaaagctggccaggctcccaggctcctcatctatgatacatcctacagggccactggcatcccagccaggttcagtggcagtgggtctgggacagacttcactctcaccatcagcagcctagaacctgaagtattttgctagtttattactgtcagcagcgagngtctttcggcctgggaccaaggtgatatcgaaacgaacgtgtggctgacaccatctgtccttcacttccttcccgctactcgtagaacg

SEQ ID NO: 41141 - DNA, 649 bp, Homo sapiens
  misc_feature: GYAE6OF02FUXLG.36.85.H08.1.454.CMB.1.raw
tcagtacgctgtctcacgaccggtgctcgatttagtatcactcagtcggcggggctgaaatggaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacgacagattactgcacagaagttccagggcagaatcacctatgaccagaaaccagactccataaacactagttacatggaactgaaacagtctgagcctccgaggacacggccgtatattactgtgcgagagacaacgtattttcggactggtgaatacgaagggttccgacccgtggggaccagggtaccctggtaccaccgtctacctcacgcctccaccacgggcccacgtccggtccttacccccgtggccctacccgtcccgtacctaacgtacgtcctacccgtccgtgggggacctaacgtacggtcccggtcccgttcgggccgttcggcccgttgggtacccgtaaacgggacccgttacccgttaacccggaacggaacccgtaacggtaccggttaccgtcgggaaccgggtccgggccgtacgggaccgtaaccggg

SEQ ID NO: 41142 - DNA, 511 bp, Homo sapiens
  misc_feature: GYAE6OF02HKPV9.36.85.H08.1.454.CMB.1.raw
  modified_base (416)..(416): a, c, t, g, unknown or other
  misc_feature (416)..(416): n is a, c, g, or t
  modified_base (472)..(472): a, c, t, g, unknown or other
  misc_feature (472)..(472): n is a, c, g, or t
  modified_base (505)..(505): a, c, t, g, unknown or other
  misc_feature (505)..(505): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagccaccctctcctgcagggccagccagagtgttagtcaaaacttgcctggtatcaaacaaaagctggccaggctcccaggctcctcatctatgatgcttccaaaagggcccctggcatcccaaccaggttcagtgccaggtgggtctgggacagacttcactctcaccatcagcagcctagagcctgaagtattttgctactttattactgtcaanagctaccatggcgacgttcgacgagggaccaaggtcgagtacaaacgacgtgagcngcacatctgtcttcacttctcccgcatctaganacacgg

SEQ ID NO: 41143 - DNA, 646 bp, Homo sapiens
  misc_feature: GYAE6OF02JY6U7.36.85.H08.1.454.CMB.1.raw
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
tcagtacgctgtctcacgaccggtgctcgatttagtatcactcagtcgcggggaggaacgtgctcagttaggacccagagggaaccatggaagccccagctcagcttctcttcctcctgctactcgtggctccagataccaccggagaaattgtgttgacacagtctccagccaccctatctttgtcctccaggggaagacgccctaccctctcctgacacgggcctagcccaggagtgttagcaaaacttgcctggtatcaacaaaagctgcagntccagcttcnatctatgatcncttaccaaaagggcccctggccatccccaactcggttcagtcgaccagtcgggtcacgggtacagacctttnaccttcgtcaaccatcacggctaaggccctaagggccgacgtagtaagtttacttttagcccttaattttataaccgtcttaccgaaacttcggactaacccctaagtcggtacgaacgtttccggacgtaacggacctaggtacgtacggttaacaaacgtaaacgtcggtacgggtactacgcaaccgttacgtccgttaacgtttccttaaccggtacgtttaccggttaccccggtacctacgtttacccagggttaaccgacccgttaacgg

SEQ ID NO: 41144 - DNA, 527 bp, Homo sapiens
  misc_feature: GYAE6OF02HQJEE.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaaacaaaagctggccaggctcccaggctcctcatctatgatgcttccaaaagggcccctggcatccccaacaggttcagtgccagtgggtctgggacagacttcactctcaccatcagcagcctagacgcctagaagtattttgctactttattactgtacaacagcgtaccactggacgacgttccggaccgaagggaccaaggtcgaggtacaaacgactgaggctgcacagtctgtcttcacttccttcccgcctatcctagacgactacg

SEQ ID NO: 41145 - DNA, 566 bp, Homo sapiens
  misc_feature: GYAE6OF02HSYXA.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagcccaccctctcctgcagggccagccagagtgttagtcaaaacttgcctggtatcaaacaaaaagctaggccaggctcccaggctcctcatctatgatgcttaccgaaaacgggcccctggcactcccaacctaggttcagtcgccgaggtcgggtcgtgggacagacttcactctcaccatcagcagcctagacgcctagaagtattttcgacttactttatactgtacaacagacctaaccaacgtggacggtacgttcggaccgaacgggaccgaagggtacgaggtaccaaacgtacgtgtgactgcactagtctcgttcttcacttcccgttcccgacctacttccgtagacgacgtacgg

SEQ ID NO: 41146 - DNA, 528 bp, Homo sapiens
  misc_feature: GYAE6OF02GR6PO.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaaacaaaaagctggccaggctcccaggctcctcatctatgatgcttaccaaaagggcccctggcactccccaaccaggttcagtcgccaggtgggtctgggacagacttcactctcaccatcagcagcctgcagtctagaagtattttgctagttttattactgtacaactagtacaatgactggcctctctacgtttcggcggtacgggaccagggtgagaacgtacgaaacgtactggtggctgcactatctgtcttctatccttcccgctac

SEQ ID NO: 41147 - DNA, 532 bp, Homo sapiens
  misc_feature: GYAE6OF02GT96E.36.85.H08.1.454.CMB.1.raw
tcagtacgctgtctcacgaccggtgctcgatttagtatcactcagtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaccatctccaaagccaaagggcagccccgagaaccacatctgtcctctagagaaaacccctgtgagcacagctcctcaccatggactggacctggaggatcctcttcttggtggcagcagctacaagtgcccactcccaggtgcaactggtgcagtctgggctgaaatgaagagcctggggcctcgagtgaaggtgtccgtgcaagacttcgaggatacaccttcactagtttatgtaaatcaacgttgggtagcgacgacggccagaggacaacgggcttagaggtggatggggattgggtacgaacccgttagttaggtggtgacgagtagtattagtggactacgagtaacgg

SEQ ID NO: 41148 - DNA, 524 bp, Homo sapiens
  misc_feature: GYAE6OF02F1OD3.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggagagccaccctctcctgcagggccagccagagtgttagtcaaaacttgcctggtatcaaacaaaagctggccaggctccaggctcctcatctatgatgcttccaaaagggcccctggcatcccaaccaggttcagtcgccaggtgggtctgggacagacttcactctcacatcagcagcctagagcctagaagtattttgctactttattactgtacaacagactaccaacgtggcggtacgttcggaccgaagggaccaggtcgaggtacaaacgactgtgctgcaccatcgtcgtcttcattcctcccgctactctagacactacgg

SEQ ID NO: 41149 - DNA, 659 bp, Homo sapiens
  misc_feature: GYAE6OF02G04KI.36.85.H08.1.454.CMB.1.raw
  modified_base (410)..(410): a, c, t, g, unknown or other
  misc_feature (410)..(410): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagcccaccctctcctgcagggccagccagagtgttagtacaaaacttgcctggtatacaaacaaaaagctggaccaggctcccgaggctcctcatctatgatgcttaccgaaaacgggcccctaggcactcccaacgtagttcagtcgcctaggtcgggtctggacagtacttcactctacacatcagcacgcctagacgcctagaagttnttttcgacttaactttattacttacgtaccaacgtacgtaccgtaacctaacgtcgggaccggttaccggttccgggaccgtaaacggggaaccgtaacggggtaccgtaacgggtaacccgtaaacggtaacgttgggtaacggtcgttacggaccctaaccgtacgttccgttcgttaccgtttaccgaacgtttccccgttaccccgtaccgtaccttaccggttacggaaccggtactaaccggg

SEQ ID NO: 41150 - DNA, 613 bp, Homo sapiens
  misc_feature: GYAE6OF02FWFWT.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgatttttggactggtgaatacaaggggttcgacccgtgggccagggatccgtggtcaccgtctcctcacgcctcccaccgaacgggcccaacgttccggtcccttccccgtggccgccccttcggcctccgacggtacgcccacccgtccgaggacgaccgaccgacgcccgggacccgtcggggccgttccggcccgttcggtaccgaaacgggtacctttaacccgtacccgtaacgaaccgtacggtccggttaaccgtcgggtacggtccggggtcgtacggg

SEQ ID NO: 41151 - DNA, 778 bp, Homo sapiens
  misc_feature: GYAE6OF02IS1UK.36.85.H08.1.454.CMB.1.raw
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
tcagtacgctgtctcacgaccggtgctcgatttagtatcactcagttcggtcgggggagaactgctcgagttacggtacccacgagggaaccactagggaacgtccccagtcgtcagccttctcttcctcctgctactctggctccacgataccgaccggtaggaattgtgttcgacgactacgtcttccagtcccttaacccgtagttctttcgtcttccgaggggaaggtagcccacccttcgtccgtgccgagggggccagtccgacgagtcgttaggactaaaccttgcctggtacttccaaanaaaagctcgccaggcttcccacggtctccncactctgtgatgcttaccgaaacgggccccgtggccgactcccaacgtacggttacggacgtcggccgtagggttcgggtcgtacgggtaacagtaccgttacgaccttcgtaccaaccgtaagtttcgacggacgtaacgtaccttaggaccgtacgtacgtaacggttagttttacgggctttacgttttacttaccgttacgttacctaaacgtagtaccgttaacctaaccgttacggaaccgggtaaccggtttccggaaccgttaacggggaacccgtaacgggtaccgaacggttaacgaaaaccggaaccgttacggtaccggtacgtaccggaccgaaccgtacgttaccgttcggttcctttaaccgtacgtttacccgtttaccccgtccttaaccgttaccgtaacggtaacgggtaccgtaaccggg

SEQ ID NO: 41152 - DNA, 571 bp, Homo sapiens
  misc_feature: GYAE6OF02JWMIZ.36.85.H08.1.454.CMB.1.raw
  modified_base (228)..(228): a, c, t, g, unknown or other
  misc_feature (228)..(228): n is a, c, g, or t
  modified_base (389)..(389): a, c, t, g, unknown or other
  misc_feature (389)..(389): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgctccaggggaagagccacctctcctgcagggccagccagagtntagtcaaaacttgcctggtatcaacaaaagctggccaggctcccaggctcctcatctatgatgcttccaaaagggcccctaggcatcccaacaggttcagtgcctagtgggtctgggacagacttcactctcacatcagcagcctagacgcctagaacgtnttttagactactttatactgtacaacagtacgttaaccagttcggcgtacgttcggacccgaagggaccaaaggttcggaacggttacgaaaaccgaacgttcggacgggtactacggaccaacacgtcttcgtcttaccgaactttcccttcccggacctaatccttacggaactacacgg

SEQ ID NO: 41153 - DNA, 534 bp, Homo sapiens
  misc_feature: GYAE6OF02GB7CM.36.85.H08.1.454.CMB.1.raw
  modified_base (397)..(397): a, c, t, g, unknown or other
  misc_feature (397)..(397): n is a, c, g, or t
  modified_base (530)..(531): a, c, t, g, unknown or other
  misc_feature (530)..(531): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaaacttgcctggtatcaacaaaaagctggccaggctcccaggctcctcatctatgatgcttaccaaaagggcccctggccatcccaaccaggttcagtgccagtgggtctgggacagacttcactctcaccatcagcagcctaagacgccctagaagtnttttagcctaacttttattactgttacaactagccgtaccaacgttggcggtaccgttcggaccaagggaccaaggtcgagtacgaaacgactaggtgctgcacatctgtctcacttcttcccgctatcagannacg

SEQ ID NO: 41154 - DNA, 555 bp, Homo sapiens
  misc_feature: GYAE6OF02F9Y2H.36.85.H08.1.454.CMB.1.raw
  modified_base (536)..(536): a, c, t, g, unknown or other
  misc_feature (536)..(536): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgtatttttggactggtgaatacgaaggggttcgacccgtgggccagggaccctggtcaccgtctcctcacgccctccaccacgggcccagtccggtccttcccccgtcggcctaccctccctccaacgcgccaccctcgtcggggcacgacgccggcccgtcgggctcgccgttggtccagggtactaccgtccacgaccagccgtacgngacggcggctggcgaggcg

SEQ ID NO: 41155 - DNA, 532 bp, Homo sapiens
  misc_feature: GYAE6OF02HKERM.36.85.H08.1.454.CMB.1.raw
  modified_base (484)..(484): a, c, t, g, unknown or other
  misc_feature (484)..(484): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagccaccctctcctgcagggccagccagagtgttagtcaaaacttgcctggtatcaaacaaaaagctggccaggctccaggctcctcatctatgatgcttaccaaaacgggcccctggccactcccaaccaggttcagtgccaggtcgggtctggacagacttcactctcaccatcagcagcctagacgcctagaagtattttgactactttattactgtacaacagctaccaacgtggacgtacgttcggacaacgggaccaaggtcgaggtcaaacgacgtgngctgccacatctgtcttcacttccttcccgcctatctcgagactacgg

SEQ ID NO: 41156 - DNA, 576 bp, Homo sapiens
  misc_feature: GYAE6OF02JDRAG.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctgtgtctccaggagaaagacgccaccctctcctgtagggccagtcagagtgttagcagcaacttagcctggtaccagcagaaacctggccaggttcccaggctcgatcatcctatggtgcatccaccagggccacgtggtactcccaggcctacctttagcggcagtcgggtctcgggacaggagttcacgtctacacatctagcagcctgctgtctgaagtatttgactagtttattacgtagtcaacgagttacaagttcgactcggccttacgcttaccgtttcggacgggtacggtaaccgtaagggttcggagtaataccggaaaccggtaacgttcgggtacggtaccgtggaccgtacctagttaccgttcgttaccgttctaacccg

SEQ ID NO: 41157 - DNA, 734 bp, Homo sapiens
  misc_feature: GYAE6OF02IX7N6.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctccagataccaccggagaaattgtgttgacacagtctccagccaccctatctttgtctccgaggggaagacgccctacctctcctgcagggccagccagagttgttagtacaaaacttcgcctaggtatacaaaacaaaaagctcggacaacggcctacccgaggtcctcctcactctatagtatcgtaccttaaccgaaaacggggcccctaggaccaaccgtaccccaacgtacggttacaacgtcgaccgtagggttcgggtacgtagggtaaccacggtaccttcaacgttctacacctagtaccacgacacgtacctaggaccgtccgtaggtaaagttacttttcgactttaacttttagtaacgttcgtaacctaaaccgtggtacccgttaaaccaacggttacggggacggtaaccgttcccggaaacggtaaaccgggaaaccgtaaagggtacccggtaaacggttaaccgaaaacgtaacgttacggtacgggcttaccgaaccgaccgtaaccgttcgttcgttaccgttaacctacctttacccgttacccgtacccgtaattcccggtaaggtaaaccgtacgtaaccgg

SEQ ID NO: 41158 - DNA, 560 bp, Homo sapiens
  misc_feature: GYAE6OF02IYL2Y.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccacctctcctgcagggccagccagagtgttagtcaaaacttgcctggtatcaacaaaaagctggccaggctccaggctcctcatctatgatcgcttaccgaaaagggtcccctggcactcccaaccaggttcagtgccaggtggtctggacagtactcactctcaccatcacgcacgcctagacgacctagaagtatttcgctactttattactgtacaacagtaccgtaaccaacgtcggacggtacgttccggaccgaagggaccgaaggtcgaaggtacgaaacggtaactgtacggctcgacactacgtctacgtccttctacttccgttacccgctactctacgacgactacgg

SEQ ID NO: 41159 - DNA, 578 bp, Homo sapiens
  misc_feature: GYAE6OF02F2GML.36.85.H08.1.454.CMB.1.raw
  modified_base (244)..(244): a, c, t, g, unknown or other
  misc_feature (244)..(244): n is a, c, g, or t
  modified_base (304)..(304): a, c, t, g, unknown or other
  misc_feature (304)..(304): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagatcacatgaccagaaacngctccataaacacagtttacatggaactgaacagtctgagctccgaggacacggccgtanattactgtgcgagagacaacgtatttttggactggtagaatacgaaggggttcgacccgtggggaccagggaccctggtcaccgtctcctcacgcctccaccgaacgggcccatccggtccttcccccgtggcccacccctcctacccaacgacgccacctccgtcgggggaccaccgacgcccggcccgtgggcctcggccgtcggtaccacggaccttaccgttcccgaagtaccacgtccgtacgtcgacggccggctcgggacaggaccg

SEQ ID NO: 41160 - DNA, 619 bp, Homo sapiens
  misc_feature: GYAE6OF02H3G6J.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaaacaaaagctggccaggctcccaggctcctcatctatgatgcttaccaaaagggcccctggcactccccaacaggttcagtgccaggtggtctgggacagacttcactctcacctatcagcagccctaggacgtcctagtaaagtcttttgaccttacttttaattactgttaccaaacgtacgtaccgttaaccaaacggttcgggaccggtacggtttccggaccgaacggggaaccctaacgggtacgaaggtaccgaaaacgtaacgttggacgggtactcgaccacccgtaagttccgttaggttccttacgacttccgttccccggacctacgttccgtaacggtaacgcgtaaccggg

SEQ ID NO: 41161 - DNA, 532 bp, Homo sapiens
  misc_feature: GYAE6OF02G5EBF.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaacaaaaagctggccaggctcccaggctcctcatctatgatgcttccaaaagggcccctggcatcccaacaggttcagtgccagtgggtctggacagacttcactctcaccatcagcagcctagacgcctgaagtattttgcttactttattactgtacaacagccgtaccaagtggcgacgttcggaccgaagggaccaagggtcgaacggtcaaacgactggtagcctgacaccgagttctgtcttcattccgttcccgctatcctgacgtactacg

SEQ ID NO: 41162 - DNA, 580 bp, Homo sapiens
  misc_feature: GYAE6OF02GGVYS.36.85.H08.1.454.CMB.1.raw
  modified_base (392)..(392): a, c, t, g, unknown or other
  misc_feature (392)..(392): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaaacaaaaagctggccaggctcccaggctcctcatctatgatgcttaccaaaagggcccctggcatcccaaccagttcagtcgccagtggtctgggacagacttcactctcaccatcagcagcctagacgcctgaagtnttttgctactttatactcgtacaacgagtccgtaaccaacgttcgggaccggtacgtttccgggaccctaaaggggacccaagggtccgaagggtaccaaacgtaacgtggtacggctgaccaccacgttcgtacgttccttactacttccgttaccccgcctacttccgtagtaacgacgtaaccgg

SEQ ID NO: 41163 - DNA, 550 bp, Homo sapiens
  misc_feature: GYAE6OF02G0A66.36.85.H08.1.454.CMB.1.raw
  modified_base (199)..(199): a, c, t, g, unknown or other
  misc_feature (199)..(199): n is a, c, g, or t
  modified_base (392)..(392): a, c, t, g, unknown or other
  misc_feature (392)..(392): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (513)..(513): a, c, t, g, unknown or other
  misc_feature (513)..(513): n is a, c, g, or t
  modified_base (539)..(539): a, c, t, g, unknown or other
  misc_feature (539)..(539): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagngccacctctcctgcagggccagccagagtgttagacaaaacttgcctggtatcaaacaaaaagctggccaggcctcccaggcctcctcatctatgatgccttaccgaaaacgggcccctggtaccactaccccaacctacggttcagtcgccgtaggtcgggtcgtgggacagtacttcactctcaccatcancagcctagagcctagaagtattttgcttactttatactgtacaacagtactaccgaactggacgacgttccgacgaacgggaccaggtcgaggtacaaacgactggngncgcactatcgtnttctcctatcctacccgctataccgngactactacgg

SEQ ID NO: 41164 - DNA, 567 bp, Homo sapiens
  misc_feature: GYAE6OF02HLY2N.36.85.H08.1.454.CMB.1.raw
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggagagccaccctctcctgcagggccagccagagtgttagtacaaaacttgcctggtatacaaacaaaagctggccaggctcccaggctcctcatctatgatcgcttaccgaaaacgggtcccctaggccactaccccaacctaggttccagtcgcctaggtgggtcgtgggacagtacttcactctacaccatcagcacgcctagacgcctagaatattttgacttactttattactntacaacntccgtaccacgtggacggtacgttcgggccaaagggaccaaggtcgagtacgaaacgaacgtgcgcgtagcaccgtattcgtcgttcttactacttcccttacccgcctactctaggacgacgtacgg

SEQ ID NO: 41165 - DNA, 552 bp, Homo sapiens
  misc_feature: GYAE6OF02H6I0I.36.85.H08.1.454.CMB.1.raw
  modified_base (322)..(322): a, c, t, g, unknown or other
  misc_feature (322)..(322): n is a, c, g, or t
  modified_base (377)..(377): a, c, t, g, unknown or other
  misc_feature (377)..(377): n is a, c, g, or t
  modified_base (498)..(498): a, c, t, g, unknown or other
  misc_feature (498)..(498): n is a, c, g, or t
  modified_base (515)..(515): a, c, t, g, unknown or other
  misc_feature (515)..(515): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagcccaccctctcctgcagggccagccagagtgttagtcaaaaacttgcctggtatcaacaaaaagctggccaggctcccaggctcctcatctatgatgcttaccaaaagggcccctggcacncccaaccaggttcagtcgccaggtggtctgggacagtcttcactctcaccatcancacgcctagacgcctgaagtattttgacttactttattactgtacaacagtacgtaccaatcgggtccgtacgttaccggacgaacgggaaccgaaggtcgaacggtacaaacgacgtcgngctcgcacctagtcctntcttcacttccttcccgctacctcgtacacgactacg

SEQ ID NO: 41166 - DNA, 606 bp, Homo sapiens
  misc_feature: GYAE6OF02IAPVP.36.85.H08.1.454.CMB.1.raw
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
tcagtacgctgtctcacgaccggtgctcgatttagtatcactcagtcgcgggaggagcagtacaacagcacgtaccgtgtggtcagcgtcctcaccgtcctgcaccaggactggctgaatggcaaggagtacaagtgcaaggtctccaacaaagccctcccagccccccatcgaagaaaccatctccaaagccaaagggcacgccccgagaaccacatctcgtcctctaagagaaaaccctgtgagccacagctcctcaccatggactggacctggagatcctcttcgttggtgcagcagctacagtcgcccactccaggtcncaactggtgcagtcgngggctagaatgaagagccgtgggcctagaggtgtaaggtcgtaccgtagacaaggtactacgaaggtactaaccgtactcgtaactagtttaacgtagtaaactccgtaaacgttgggtacgacgtaacgacggacccaacggacgaacggacgggtacgttaggacggtaggaagttcggggaagtcgggtaacgttaaccgttaaggtacggtagggtacgtaacgacggtaagtactttagtacggactacggtaggtaaccgg

SEQ ID NO: 41167 - DNA, 574 bp, Homo sapiens
  misc_feature: GYAE6OF02IAUYI.36.85.H08.1.454.CMB.1.raw
  modified_base (214)..(214): a, c, t, g, unknown or other
  misc_feature (214)..(214): n is a, c, g, or t
  modified_base (326)..(326): a, c, t, g, unknown or other
  misc_feature (326)..(326): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (410)..(410): a, c, t, g, unknown or other
  misc_feature (410)..(410): n is a, c, g, or t
  modified_base (465)..(465): a, c, t, g, unknown or other
  misc_feature (465)..(465): n is a, c, g, or t
  modified_base (551)..(551): a, c, t, g, unknown or other
  misc_feature (551)..(551): n is a, c, g, or t
tcagtacgctgtctcacgaccggtgctcgatttagtatcactcagtcgcgggcgtgaaatgaagaagcctgggcctcagtgaaggtgtcctgcaagacttcaggatacaccttcacagtttatgaaatcaactgggtgcgacaggccacaggacaagggcttgagtggatgggatgggtcgaaacccttatagtggtgacacagtattatgcanagaagttccagggcagaatcaccatgaccagaaacagtctaccataaaccagagtttaacatggaaatgaacagtctgagctccgaggacacgcgtaatacttatgcgaganagacaaacgtatttttaggactggngtaanacgaaagggttccgaacccgtggggcaagggaaccctggtaccacgtctccgtnacgcctcgaccaagggccatccggtcttccccgtagcctaccctctccaaggacncactcggtgggcacgacgcgacccgtggctcgcgtacggtacaacggtacctaacgttcccaagacccacggtcgttaacgacggnggtaccgggctacggacgaacgg

SEQ ID NO: 41168 - DNA, 621 bp, Homo sapiens
  misc_feature: GYAE6OF02G3G26.36.85.H08.1.454.CMB.1.raw
  modified_base (401)..(401): a, c, t, g, unknown or other
  misc_feature (401)..(401): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaaacaaaagctggccaggctcccaggctcctcatctatgatgcttaccgaaaacgggcccctggccactccccaaccaggttcagtcgccaggtggtctgggacagtacttcactctcaccatcagcagcctagacgtcctagaagtnttttagcttactttattactgtaccaacgagtccgtaacctaacgtcgggtaccgggtaccggttccgggaccgtaaaggggaacccgtaagggtacggtaacgggttaaccaaaaccggtaacgtaggtacgggtcgtacgacctaaccgtacttccgttcgttaccttcgaactttcccgttccccgactacgttacctacggtaacgtaccgtacgg

SEQ ID NO: 41169 - DNA, 580 bp, Homo sapiens
  misc_feature: GYAE6OF02JC9AN.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaacaaaaagctggccaggctccaggctcctcatctatgatgcttccaaaagggcccctggcactcccaaccaggttcagtgcctaggtgggtctgggacacgacttcactctcaccatcagcagccctagacgcctgaagtagttttgctaacttttattacttgtaccaacgtagtaccgtaacctaacgtcgggaccggtaccgttcggcccgaaagggacccaagggtccggaacggtacgaaaaccggtaactggtacggcgttgcaaccgagttctagttcttcaacttcccttacccgctactcgtacgaacgtctaacgg

SEQ ID NO: 41170 - DNA, 561 bp, Homo sapiens
  misc_feature: GYAE6OF02FVVNM.36.85.H08.1.454.CMB.1.raw
  modified_base (519)..(519): a, c, t, g, unknown or other
  misc_feature (519)..(519): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaggagccaccctctcctgcagggccagccagagtgttagtacaaaacttgcctggtatacaaacaaaaagctggccaggctcccaggctcctcatctatgatgcttccaaagtcgggcccctggccactcccaacaggttcagtcgccgagtgggtctgggacagacttcactctcaccatcagcacgcctagacgtcctagaatattttgacttacttttatactgtacaactacgaccgtaccaacgtcggccggtacggttccggaccgaacgggaccgtaagggtcggaaggtacaaacgacgtggtcgctagccacgtntcttgtcctctattcccgttcccgacctatctaggaagtacg

SEQ ID NO: 41171 - DNA, 610 bp, Homo sapiens
  misc_feature: GYAE6OF02HG9DC.36.85.H08.1.454.CMB.1.raw
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (438)..(438): a, c, t, g, unknown or other
  misc_feature (438)..(438): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagcccaccctctcctgcagggccagccagagtgttagtacaaaacttgcctggtatacaaacaaaagctggaccaggcctacccgaggtcctcctacatctatgatcgacttaccgaaaacgggtcccctggcacgtcccaaccgtaggttcagtcgccgtaggtgggtctgggacagcttcactctcacatcancagctagacnctagaatatttgacttatttatactcgtacaacncgtacctactaacgtcggacggtacgtccggaccgaaaggggacccgtaagggtcggaacggttaacgaaaccggttacgtacggtcggacttacggacctacctagttctacggtttaccttactacgttcccttcccggacctacgttccgacggtaaccgtctaaccgg

SEQ ID NO: 41172 - DNA, 722 bp, Homo sapiens
  misc_feature: GYAE6OF02GN7NB.36.85.H08.1.454.CMB.1.raw
  modified_base (221)..(221): a, c, t, g, unknown or other
  misc_feature (221)..(221): n is a, c, g, or t
  modified_base (378)..(378): a, c, t, g, unknown or other
  misc_feature (378)..(378): n is a, c, g, or t
tcagtacgctgtctcacgaccggtgctcgatttagtatcactcagtcgcgggggaggaactgctcagttaggacccagagggaaccatggaagcccagctcagcttctctcctcctgctactctggctccagataccaccggagaaattgtgtttgacacagtctccagccacctatcttgctccaggggagagcacctctcctgcagggccaggcctagngtgttacgacaaaacttgcctaggactcaaacaaaagctggaccaggctccaggcctactcactctatgactgaccgtttaccgaaaagggtcccctaggccctataccccgaactacgtttcgaacggttcaaccgagttcgggtatcgggaaccnggaacctttcaccgtccctacaaccgacgttacacgtacctaagcccctttaaaggagtacccgttaagtaaccggtattttttacggaccttaacggttttaactttaccgtaggtttacccaacgtagttaccggtaactaacggtcggtacggtaacgttccgaaccgaacggtaaccgggtaagtacgggtaacggaaccctaaacgggtaacccgtagggttaccggtacgtaaccgggtcgaacccgtacgttacccggtagtttaccgttacgtaactttaacccgttccccgggtaacttaaccgtccggtttaaccaacggggtaacccttcggg

SEQ ID NO: 41173 - DNA, 604 bp, Homo sapiens
  misc_feature: GYAE6OF02I5WAD.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaggagccaccctctcctgcagggccagccagagtgttagtcaaaacttagcctggtatacaaacaaaaagctggccaggctcccaggctcctcatctatgatgcttaccaaaagggcccctggccatcccaaccagttcagtgccagtgggtctggacagacttcactctcacctatcacgcacgcctaagacgcctaggaaagtattttcgacttactttaattacgtgttaccaactacggacgttaacctaacgtcggtccggtaccggttcggacccgaaagggacctaacgggtcgaacggtaccgaaacggtaacgtggtacgggctaggtcaaccctagtacttcggttccttaccacttcccgttcccgtaccctacgttcctaggtaaccgactaaccgg

SEQ ID NO: 41174 - DNA, 815 bp, Homo sapiens
  misc_feature: GYAE6OF02GLMF2.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagcgccaccctctcctgcagggccagccagagtgttagtacaaaacttgcctaggtatacaaaacaaaagctggccaggctcccaggcctcctcatctatgatcgtcttaccgaaaacgggtccccctagggccactccccaaaccgtacggttaccaggtcgccgtaggttcggggtcttaggggacacggtacttccacttcctcaccatcagcagcctagacgtccctaggtaaacgttagtttttcgaccgtttaaactttttaacgtttaaccttagttaaccctaaaaccgtaaggttaaccccgttaaacccgtaaaccggtttccggggacccggggttaaaccccgggtttttacccggggaaaccccggtaaaaccggggggtaaaccccggttaaaacggggttaccgggtaaaccgggttaaacccggtaaaaaacccggttaaccggttacgggttacggggttacccgtacgggtacccgtaaacccgtacggtttaacccttaccggtttacccgttttaccgtaaccgttttcccccgtttaccccccggtaccttaaaccgtttacccgttacgggtaaaaccggtacccgttaaaccgggg

SEQ ID NO: 41175 - DNA, 628 bp, Homo sapiens
  misc_feature: GYAE6OF02F4WIZ.36.85.H08.1.454.CMB.1.raw
  modified_base (286)..(286): a, c, t, g, unknown or other
  misc_feature (286)..(286): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcacatgaccagaaacagctaccataaacacagtttacatggaactgaacagtctganctccggaggacacggccgtatacttactgtagcagacgactaacgtagtttttaggactaggtagaagtacgtaaggggttccgaacccgtggggaccaggggtaaccctggacctaccgtctacctcagccctccgaccacggcccagtccggtaccttaccccgtggccaccctccctaccgaacgtacgcctacctcgtacggggaccaccgacgcccggtccgtacgggcctacggcccttagggtaccgtaacggtacctaaccgttccgaacggacccgtaacgtaccggttaccgtggtaaccggccgggtacgtcggggaccaacggggtaccg

SEQ ID NO: 41176 - DNA, 581 bp, Homo sapiens
  misc_feature: GYAE6OF02FIWXP.36.85.H08.1.454.CMB.1.raw
  modified_base (401)..(401): a, c, t, g, unknown or other
  misc_feature (401)..(401): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttagcctggtatcaaacaaaaagctggccaggctccaggctcctcatctatgatgcttaccaaaacgggcccctggccactacccaaccaggttcacgtgccagtcgggtctgggacagacttcactctcaccatcacgcagcctagacgcctagaagtnttttgcttaactttattactgtacaacgagccgtaccaacgtgggcggtaccgttcggaccgaagggaccgaaggtacggaggtacgaaacgaactggaggtcgtcgacgaacccagttctgttacccgtttctacttcccgttaccccgacctacttccgtacggtaacgactaaccgg

SEQ ID NO: 41177 - DNA, 629 bp, Homo sapiens
  misc_feature: GYAE6OF02GLX09.36.85.H08.1.454.CMB.1.raw
  modified_base (488)..(488): a, c, t, g, unknown or other
  misc_feature (488)..(488): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctaccgagtaccacggccgtatattactgtgcgagagacaacgtattttcggacttgtgaataacgaaggggttcgacccgtggggccaacggggaaccctgggtcctaaccgtccgtcccttacacggtccctaccaacccgaagggccctagtccgggttcccttccccccgtggccctacccttcctaccctaagcnccgaccctcgtacggggcacgcggccgcccgtcgggctccgcgtcggtacgtaacggacccttaacgtcccgtaacgacccgtaacggtcccggttaccgtagggaaccgcccggggtacgttccgggacggtaaaccggg

SEQ ID NO: 41178 - DNA, 689 bp, Homo sapiens
  misc_feature: GYAE6OF02GF12S.36.85.H08.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (288)..(288): a, c, t, g, unknown or other
  misc_feature (288)..(288): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccacctatctttgtctccaggggaagngccacctntcctgcagggccagccagagtcgttagtaccaaaacttgcctggtactacaaacaaaagctaggccaggctccaggctcctnactctatgatgccttacgaaacggtccctggaccactcccgaacacggttacagtcgccgtaggtgggtctgggacaggtaccttcgacttccgtacaccatcacggcacggtcctaagacgtccgtagtaacgttcttttcggacctttacgttttacgtactgtaaccgtaactcggtaccgttacccaacggttcgggtacgggtaaaccggtttccgggaacccgaacgggggtaaccctaacgggtaccggtaacggtaaccgtaaaaccgggaccgttagtaccgggtactacggtacctaacccgtaagtttcccgtacgtttaccttaccgtaaccgtttcccgttacccgtaccttaaccggtaccgtaacggttaaccgtaccgtaaccgg

SEQ ID NO: 41179 - DNA, 631 bp, Homo sapiens
  misc_feature: GYAE6OF02H9D6S.36.85.H08.1.454.CMB.1.raw
  modified_base (410)..(410): a, c, t, g, unknown or other
  misc_feature (410)..(410): n is a, c, g, or t
  modified_base (546)..(546): a, c, t, g, unknown or other
  misc_feature (546)..(546): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagcccaccctatctttgctccgaggggaagagccaccctctcctgcagggccagccagagtgttagtacaaaacttgcctaggtataccaaactaaaaacgcgtacggaccacggcctacccgaggcctcctcatctatgatcgaccttaccgaaacgggcccctaggccacctaccccaacgtaggttacagtacgccgtaggtcgggtcgtagggactagtacttcactcctacacctntcagcacgctagactctagtaattattttgacttacttttatacttgtacaagtacgtaccgtaaccaacggtcggacggtaccgttacggaccggaaacgggaccgtagtacggaggtaaccgaaacgtgtaggngtactcgaccgtactacgttctacgttcttacccgttacttcccgttaccccgacttacgttaccgtacggtaacgactaacggg

SEQ ID NO: 41180 - DNA, 788 bp, Homo sapiens
  misc_feature: GYAE6OF02HHCCT.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaactcaccatcgaccagaaacacgctaccaataaacactagtttacagtagaactgaacagtctgagctccgaggacgacggccgtatattactgtgcgagagacgaacgtagttttacggacttggtagtaacttacggtaaacggggttccgacccggtcgggggaccgaacgggtacccgtcggtaccgacccgttccgtacccgttccgacgtaccccgttacccgaaacccgtaacggggtcccaaccggtttcccggttccccgtttaccccccggttcggaccccgttaacccccgttaccccttacccgaaaccggtaccgtaccccgtacccgtttaccgggtacccgggggaccctaacccgaccggggtccccgggtccccgggttacgggggttacccctccgggttaccccgggttcggttaacccggtaaacggggttacccgtttaacccgttaccccggtaaacggtacccggtaacggtacccgggttaaccgtcgggtaccgggacccggggtttaccggtacccgggtacggaacccgggg

SEQ ID NO: 41181 - DNA, 616 bp, Homo sapiens
  misc_feature: GYAE6OF02HS13X.36.85.H08.1.454.CMB.1.raw
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (453)..(453): a, c, t, g, unknown or other
  misc_feature (453)..(453): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctccagataccaccggagaaattgtgttgacacagtctccagccaccctatctttgtctccgaggggaaggagcccaccctctcctgcagggccagccagagtgttaagacaaaacttgcctaggtatacaaacaaaaagctaggccaggcctcccaggctcctcatctatgatcgtaccttaccgaaaacgggccccctggaccactaccccgaaactacggttacaggtcgcccgaggtcgggtacgtggacagtaccttcactctacaccntacancgacacctagactcgtagaagttactttgacttacttttatacgtntactaacacgtaccggtaccaacgtacggtcgtaacggtccggaacgaacgggtaaccgaaggtaccgaaggtaaccgaaacgtacgtacggtgactacgaccaccgtatcgtcgtaccttacgaccttctccccgctacgttaccgtagaacgacgtaacgg

SEQ ID NO: 41182 - DNA, 614 bp, Homo sapiens
  misc_feature: GYAE6OF02FZTMZ.36.85.H08.1.454.CMB.1.raw
tcagtacgctgtctcacgaccggtgctcgatttagtatcactcagtcggggcgtgaaatgaagaagcctggggcctcagtgaaggtgtcctgcaagacttcaggatacacctttcacagtttatgaaatcaactgggtgcgacaggccacaggacaagggcttgagtggatgggatgggtgaacccttagtagtggtgacacagattatgcacagagttccaggcagatcacatgacagaacagctcataacactagttacatagaactagaactagtctagagcctaccgagaccacggcctatattactgtgtacgagagactaacgtagttttaggacttggtagtatacgtaagggttaccgtacccgtgggaccgacggacccgtcggtaccgtaccgtcctcctccgtacgtccctaccaccgaacggccacgtccggtccttccccgtcggccctaccctccctaccgaacgacgaccgtacctcggtcgggacacgtacggccgcccggtaggccgtcggtccgttacggaccgtaacggtccgttaaccgttccgaacgtacgaccggtcgtacgtcgacggcgggcggtacggacgaggtaccg

SEQ ID NO: 41183 - DNA, 625 bp, Homo sapiens
  misc_feature: GYAE6OF02JT9KB.36.85.H08.1.454.CMB.1.raw
  modified_base (198)..(198): a, c, t, g, unknown or other
  misc_feature (198)..(198): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccacctatctttgtctccaggggaagngccaccctctcctgcagggccagccagagtgttagacaaaacttgcctggtaatcaaacaaaagctgaccaggctccaggcctcctcatctatgatgcttaccgaaacggcccctggcactccaaccgtagttcagtcgacaggtcgggtctggacagtacttcactctacacctatcgatccagcctagacgtccgtagtaagtacttttgactaacttttagtacttntacctaaacncgtaccgttaaccaacgtacggtacgtaaccgttccggacgaaacgggacctaaacgggtaccgaacggtaaccgaaacgtaaacgtcggttacggaccgttacggaccaaccgtacggttcttaggttacctttcgtaacttcccgttcccgtacccgtattaccggtaacgtaacgtacctacgg

SEQ ID NO: 41184 - DNA, 934 bp, Homo sapiens
  misc_feature: GYAE6OF02ITH2M.36.85.H08.1.454.CMB.1.raw
tcagtacgctgtctcacgaccggtgctcgatttagtatcactcagtcgcgggggagaactgctcagttaggacccaggagggaaccagtggaagccccagctcagcttctcttcctcctgctactctggctcccagactaccaccggagaaattgtgttgacacagtctcagccacctatctttgctcgagggagagccacctctcctgcagggccagccagagtgttagacaaacttgaccgtaggtatacaaactaaaagcgtacggacacggaccttacccgaggccttaccgtactaactcttaagtgtaacttcgacctttaacccggaaaacgggtccccgttagggaaccctaacttacccccgaaaaccgttacggttacgtaacggttacgacccggttaagggttcgggttaccggtacggggtaacgtaacggttaaccctttacccggtaacctttacccgttaacccaaacccgtaaccgttaccgaaaccggtaaccgtaacccgtaccggttaaaccgggtaccgtaacccggtttaaagtaaaccggttttaacttttttacgggtaaacccttttaaaccgtttttaaacgtttaccgtttaacggttaacctaaaaccgggtaaccgttaacccggtttaaacccgtaaacgggttcccgggttaacccggggttaaccggtttacccggggaaaccggttaaaccggggtaaccgtaaaccggggtaccggttaaacgggtaaccgttaaaacccggtaacggttacggttacggtaacccgtaggtaccctaaccggtaccgtttaccgttaccggtttacccgttaacccgttaacccgttttccccgtttaccccggtaacccgttttaacgttaccggtttaaaccggtaaccggtaaccgttaacccggg

SEQ ID NO: 41185 - DNA, 630 bp, Homo sapiens
  misc_feature: GYAE6OF02JZ100.36.85.H08.1.454.CMB.1.raw
  modified_base (180)..(180): a, c, t, g, unknown or other
  misc_feature (180)..(180): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttagagtggatgggatgggtnaacccttagtagtggtgacacagattatcgcacagagttcaggcagatcacatgaccagaacagcncataacanagttacatagaactagaactagtacgttagacgtcgtaccggaggaaccgacggtaccgtaattacgttactgtacggacgaaggacgtacgtaaccgtagtttttacggacgttaggtagtaacgtaacgtaacggggtttaccgacccgtacggggtaccgacggggtaacctcggtacgaccgtacctccgtacacgtacctccgaccgaaccgggcctacgtcggtcccttacccgcggacctacccgtccacacgactacacccgtgacgggcaccgacggccgtccgtaggcctcggtaccctaggtacctacgacttaccgtcctagaccagtaccgtacgtacggcggccggcacggtacgacgtacg

SEQ ID NO: 41186 - DNA, 664 bp, Homo sapiens
  misc_feature: GYAE6OF02IM2IX.36.85.H08.1.454.CMB.1.raw
  modified_base (329)..(329): a, c, t, g, unknown or other
  misc_feature (329)..(329): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccgagggcagaatcaccatcgaccagaaacagcctaccaataaaaccactaacgtttacataggaactagaacagtctagagctccgaggacgacggcgtatattactgngacgagagacaacgttattttacggacgtggtagaagtacgtacgggttcgacccgtcggggaccgacgggtaacccgtggtaccaccgtcctacccgtcgaccgtcccctacccgaacccgtaccgggacccacgttcccggtcccttccccgtccggtaccctaccccgttcccgtacccgaacgtacgcccgtacccgtccggcggggactaccgacggtcccggtcccgtcgggccttacggtcgttcggtacgaacggtaccgtaccgttaccgagtacccgtaggtaccgttacgtacggacggtccgggacgttcggacgtaaccggg

SEQ ID NO: 41187 - DNA, 662 bp, Homo sapiens
  misc_feature: GYAE6OF02G6FU9.36.85.H08.1.454.CMB.1.raw
  modified_base (206)..(206): a, c, t, g, unknown or other
  misc_feature (206)..(206): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattangcacagaattccagggcagaatcaccatgaaccagaaacagctacaataacacagttacatacgaatgaacagtctgacgctccggaggacgaccggccgttatacttacgtgtgcgagagacgaacgttattttcggacttaggtagtaatacggtaacggggtttacccgacccggtggggacccgaacggggtaacccgtcgggtacccgtacccgttcctaccctccgacgtccctacccgaaccgaaccgggccctacgtcccggttacccttcccccgtcggtccctaccccgtccctaccaaccgcgtccctaccgtcggtcggggaccaccggtacgcccggtaccgtcggtcgtcgccgtacggtacgacggtaccttacgttaccacggtaaccgacgtaccggttacgtacggacgggtccgggtacgtacgggaccgaggaccg

SEQ ID NO: 41188 - DNA, 728 bp, Homo sapiens
  misc_feature: GYAE6OF02IKUK0.36.85.H08.1.454.CMB.1.raw
  modified_base (306)..(306): a, c, t, g, unknown or other
  misc_feature (306)..(306): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctattctttgtctccgaggggaaggacgccaccctctcctgcagggccagccaggtagttgttacgtactaaacttgccgtaggtatacaaacaaaacgctcggaccaggcctacccgaggcctaccgtnatctatgtatcgaccttaccgaagtccgggccccgtggaccacctacccgaaccgtcggttacacggttcgccgtagggttcggtacgtggggaactacgtaccttaccgaccttcctacaccgtaactaccgacgaccgaccgtaccgtagggtaccctcgttaaggtaacgtttagttttacggacttttaaaccttttacttaccgttacggtacctaacggtaaccgtacccggttaaacccgacgggttacgggtacccgggttaaccgttaccgggaacccgtaaacggggaccgtaaccgggcggtaaacggtaaccgaaacgtagtcgggtagtccttacgacaccgtcttccggttacttcctacgttaccgttccccttaccgcccggtaatttcggaaccggtaataccgg

SEQ ID NO: 41189 - DNA, 573 bp, Homo sapiens
  misc_feature: GYAE6OF02FX7PU.36.85.H08.1.454.CMB.1.raw
  modified_base (246)..(246): a, c, t, g, unknown or other
  misc_feature (246)..(246): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatcgacagaaacngctccataaacacagttacataggaactgaacagtctgagctaccgaggacacggaccgtatattactgtgcgagagactaagattttaggactaggtcgaatacgaaggggttcgacccgtgggccgaagggaccctggtacaccgtctcctcacgcctccaccgaacggcccagtccggtaccttcccctcggacctaccctccctccgaacgacgacaccgtcgtcggggcacgacgccggcccttgggcctacgccgtggtccaacggaccttacgtccagaccgtagccgttacgtcgaggccgggtctacggtcgaggacg

SEQ ID NO: 41190 - DNA, 843 bp, Homo sapiens
  misc_feature: GYAE6OF02IZT94.36.85.H08.1.454.CMB.1.raw
tcagtacgctgtctcacgaccggtgctcgatttagtatcactcagtcgcgggctgaaatgaagaagcctggggcctcagtgaaggtgtcctgcaagacttcaggatacaccttcacagtttatgaaatcaactgggtgcgacaggccacaggaacaagggcttgagtggatgggatgggtgaacccttataggtggtgacacagtattatcgacacgaaggtaacgttccgagggtcaagaaacgtccaaccagtacgaacccgaagaaaaccacgacctaccaaactaaaacctaacctaacgttttaacaagtacggtaactacgtaaacgagtccgttagacgtcgtacccggaaggaccgaaccgggtaccgtaacttacgttaccgttggtcggacgaacggtaagtaaccgtaaacggttagtttttacggaccgttagggttaagtaaacgttaaccgggttaacgggttaccggtaccccggtacgggggtacccggtaaccggggtacccgttacgggtacccgtacccggttcccgttccccgttaccgtacccgtccccgtacccgaaacccgggtacccgggtaccccgttaccgttcccggttccccgttacccccggttacgggtacccccttaccccgttacccccgtaaccggtaaacccggtacccgtacccgtacccgttccgggtacccggggtacccaaccggtaccgggtcccgtcccgggtaccgggtccctcgggtacccgttcgggtacgtaacggttaccgtaaccgtaccgacgtaccgacgtacgtacgacggtcggcgggctacgggacgaacgg

SEQ ID NO: 41191 - DNA, 766 bp, Homo sapiens
  misc_feature: GYAE6OF02JK4XI.36.85.H08.1.454.CMB.1.raw
  modified_base (229)..(229): a, c, t, g, unknown or other
  misc_feature (229)..(229): n is a, c, g, or t
  modified_base (590)..(590): a, c, t, g, unknown or other
  misc_feature (590)..(590): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaagacgccaccctctcctgccagggccagccagngttgtacgtcaaaacttagccctaggtatacaaaacaaaagctaggacccaggcctcccgaggtcctaccctcgtaactccttaatggaacgtcgtacccgtttaccgaaaaaccggggtcccccctagggtaccctaaccttacccccgtaaaccgtaaccgggttttcccaacgggttaccggtaccccggtaagggttcggggttaccgttacggggaacctaacggtacccttaccgtaccttaccctaaccgtaccgtaacttccaaacggacctacggtaccctaacggacgtacccgtaaggtaacgtttagtttttaccgacctttaacgtttattacctaggtacctaacgngtacccgtactaacgtcggacgtacgtccggaccgaacgggacctaacgggtacgacgggtaacctaaccggtacgtacggtacgcgtacgacctacgtacgttccgttacgttaccgtttcacctttccgttacccctccggtttaccaacgttaacggacccgaccgttaacgg

SEQ ID NO: 41192 - DNA, 641 bp, Homo sapiens
  misc_feature: GYAE6OF02FMI65.36.85.H08.1.454.CMB.1.raw
  modified_base (632)..(632): a, c, t, g, unknown or other
  misc_feature (632)..(632): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccaataaacactagtttacatggaactgaacagtctgagctccgaggacacggccgtatattactgtgcgagacgacaacgtattttcggacgttggtagtaaagtacgtaaggggttccggaccccgtggggaccgacgggtaacccgtggtaccaccgtcctcccgtcgacgccctcccgaaccgaacgggccctacgtccggttcccttccccgtcggccctacccctccctaccgacgacgccgacctccggtgggggaccaccgcggcccgggtcccgtcgggtacccgtcggtcccgtacgggttaccgaaccgggtaacctttccgtaccgtacgaccgaacgtccgtacgtcggacgggtccgggcgtacggngtaaccggg

SEQ ID NO: 41193 - DNA, 748 bp, Homo sapiens
  misc_feature: GYAE6OF02HF50J.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccgaggggaagcgccaccctctcctgcagggccagccagagtgttagtactaaaacgttgcctggtatacaaacaaaagctaggccaggcctcccgaggcctcctcatctatgatgccttaccgaaaacggcccctaggccacgtaccccaaccgtacggttcaaggtcgaccgaggttcgggtcgtacggggactacggtaccttccgaccttctacccaacctactacgacgaccacgtacccgtaaggaccgtccgtaaggtaaacgtttacgtttttcggacctttaacgttttactttaacgttaggttaacccaaaccgtcggtaacccgttaacccgtaaaccggttcgggaacccgggtaccgggtttccgggaacccggtaaacggggtaacccgtaaggggttacccggaaacggtaaccgaaaaccggtaaccggttgggtaacggccgttacgacccgtaacgtaccgttccttacggttccttaacctaccgtttaccccgtaccccggttacctaccgttaccggtacgaacgtacccgtaacggg

SEQ ID NO: 41194 - DNA, 680 bp, Homo sapiens
  misc_feature: GYAE6OF02GQJRO.36.85.H08.1.454.CMB.1.raw
  modified_base (244)..(244): a, c, t, g, unknown or other
  misc_feature (244)..(244): n is a, c, g, or t
tcagtacgctgtctcacgaccggtgctcgatttagtatcactcagtcggcggaggagcgagtacaacagcacgtaccgtgtggtcagcgtcctcaccgtcctgcaccaggactggctgaatggcaaggagtacaagtgcaaggtctccaacaaagccctccagtcccccatcgagaaaccatctccaaagccaaaggcagcccgagaaccacatctgtcctctaagagaaaaccctgtgagacncagctcctacaccagttggacctggaccctagggacgtactcctactcgtttcgggtcgctacgcagtacctaacgaaggttcgccccacgtccccgagggtcgacctaacgtggtacgctacgtccgttcgggcttagaaacttcggaagtaacgccggtacgggtcctacgtaggtacgaaaggttcacccgtagaccaacgtaccttacgaacggtaacgttaaccgacctttacgaccgttaagtttacgtaacgtaaattaccgaacgtcggggttacaccggtaaccgagggaccaacggtacggtaacgtaacgggtcgttaggtaggtacgtaagtacgggacgttagggtacgtaaccccggtttatacgggttacgtaaggtacccgaagtaaccggattacgtaagccgtaagtaacgtaaccgg

SEQ ID NO: 41195 - DNA, 814 bp, Homo sapiens
  misc_feature: GYAE6OF02H26AN.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggcctcccagataccaccggaagaaattgtgttgacacagtctccagccaccctatctttgtctccgaggggaagacgcccaccctctccgtgcgagggccagccagagttgttagtacaaaacttgcctaggtatacaaacaaaagctaggccgacggcctcccgaggcctcctcatctagtgatcgtaccgttaaccgaaaacgggtcccctaggacctaacctacccctaaaccgtacggtttaccgaacggttccgaccggtacgggttcgggtaccggtacggggaacccgtaacggtaccgttacaccgtttctacccgaacctacgtaccgaacgtaccgacgtaccgttaacggaccgtaccgtaaggtaaacgtttcgttttacgaaccttttaacctttttaagttaccgttacgtaaccgtaaaccgtacggttaacccggtaaccgtaacgggttccggggtaaccggttacccgggtttacccggggaacccgggtaaaaccggggtaacccgtaaacgggggttacccggaacgggttaaacccgtaaaacggttccggttacggtacgggtcccgttaacgaccctaaccgttaacgtttcccggttccgttaccgttacctacccgttcccttacccggtacctaccgttacgtacggaccgtacctaacgg

SEQ ID NO: 41196 - DNA, 685 bp, Homo sapiens
  misc_feature: GYAE6OF02H7O4F.36.85.H08.1.454.CMB.1.raw
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
tcagtacgctgtctcacgaccggtgctcgatttagtatcactcagtcgcgggaggagcagtacaacagcacgtaccgtgtggtcagcgtcctcaccgtcctgcaccaggactggctgaatggcaaggagtacaagtgacaaggtctaccaacaaacgccctcccagcccccatcgaagaaaaccatcctaccaaagccgaaaagggcacgaccccgaagaaccacactctcgtcctctaagaagaaaatcctagtagagcacatctcctcaccagtcggactggacctggagactccttcttcgttggngtcagcagactacaaggtccaccctacgtacccgaggtacncgtaacgtggtgctaggtcgtacggggcttagaaagtagaaagtaaggccgtcggggacctacggtaggtacggtaacgggtccgtcgttaaggacgtaaacggtacttaccggaaagtacgttaacctccttaacggtaacgttacgttaagtaagtaaactacgtaacgtcggtcgaaccggacaaccgggtaaccaagaaccgggaacgtaacgggttcgtacggttaggaacgggtaggtaggtacgggtacggttaaccgtaacggttacgtaggtaccgggttacacggttaacagggtaatttacgtaggtacccgtaggtaaaccgg

SEQ ID NO: 41197 - DNA, 759 bp, Homo sapiens
  misc_feature: GYAE6OF02GKTQN.36.85.H08.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccgaaggggaanacgcccaccctntcttggtacggccagtcacagtattagcactaattagcttggtccagcagaacctgccagctccagctctcatctacagtcgcactccaccgagggcccagtcggtctcccgagcccgtaggttccaggtgcgtaggttcgggtctaggggactagtacgtttcgaacggtcctaccgaacctacgtcgaacggtccgaacggtcccgtacgggtccgggttaccttaacgggtaaacggtttacgttttttacggaccgttaaaacgtttcggtttaaacgttttaccgtttcggtttaaccgtttcggtaactttaacgttttaaaacgttaaacgtttaaaccggttccggttacccggtttacccggttaccggggtttaaccggtttcccgggtaaaccggtaacggggtaaacccggttaaggggtttaaccgaaaaccgttaccgaaaccggtaacgttacgggtacggtacgtacggtaccctaaccgtacgttccgtttacgttacccgtttacgtacgtttacccgtacccgtaccg

SEQ ID NO: 41198 - DNA, 703 bp, Homo sapiens
  misc_feature: GYAE6OF02GOBCN.36.85.H08.1.454.CMB.1.raw
  modified_base (179)..(179): a, c, t, g, unknown or other
  misc_feature (179)..(179): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtnaacccttatagtggtgacacagattatgcacagtaagttccagggcagaatcaaccatcgaaccagaaacacgctaccaataaaaccactacgtttacattacggaactagaaacagtctgagaccgtccggacggacgaccggccgtattacttacgtggtgacggagtaacgaactaacgttagtttttcggacgttagggtagtaagtacgtaacggggttccgtaccccgtcggggacccgaacgggtacccgtcgggtccctacccgtcctcccgtacgaccgtcccctcccgaacccgacgggacccctacgttcccggttcccctcccccgtcggtcccctaccccttccctacccgaagaccgtccctacccgttcgggcggggtacccaccggtaccggtcccggcccgttcgggccttccgggccctgggtaccgaccggtacctttaccgtccgtaaccgtaccgcggtaccgttccgacggtccggtccgggacgtcgggaccgacggtccg

SEQ ID NO: 41199 - DNA, 710 bp, Homo sapiens
  misc_feature: GYAE6OF02FWWY8.36.85.H08.1.454.CMB.1.raw
  modified_base (207)..(207): a, c, t, g, unknown or other
  misc_feature (207)..(207): n is a, c, g, or t
tcagtacgctgtctcacgaccggtgctcgatttagtatcactcagtcggcgggggaggaactgctcagttaggacccagagggaaccatggaagccccagctcagcttctcttcctcctgctactctggctccagataccaccggagaattgtgttgacacagtctccagccacctatctttgctccaggggaaggagcccaccctntccgtgccgagggccagcctaggagttgtacgtacaaaaacgttcgccttggtaactccaaaacgtaaaaagtcctagggaccctaagggccttcccgaacggtcctaccctcattacctatcgatcggtccttacccgaaaacgggtcccctagggacctaccgtaccccgaaaccgtggttaccacggttcgaccggtaggtacgggtccgtagggaaccgtaggtacctaccgtacttccgtaccaacctatcgacggtacacgtccgtacgacgccgtttaggaacgttacgtttagccctttaatttacgttacctagtaccctaaacgacgtaccgtaacccaacggtgggacccggttacgtttacgggaccgtaacgggacaacgggttcggaaccggtaagtaaaccgaattggacgtaccgagtaccgacctagtccgttacggttacttaccgcgttaccgtcccgtactactcgtacgtaacggctaccgg

SEQ ID NO: 41200 - DNA, 644 bp, Homo sapiens
  misc_feature: GYAE6OF02IJ7HZ.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagttttatgaaatcaactgggtgcgacaggccacaggacaagggcttgagtggatgggatgggtgaacccttatagtggtgacacagattatgcacagaagttccagggcagaatcaccatgaccagaaacagctccaataaacactacgtttacagtaggaactagaactagtctgagcgtaccggacggacacggtaccgtatactttacgtgtcgacgagagactaacgtagttttggacgtggtagaatacggtaagggttaccgacccggtgggaccgaacgggtaacccgtggtacccgaccgtccttccctcgaccgccctaccgaaccgaacggccctagtccgtcccttccccgaggccctaccctcctaccgaacgccgtaccaccgtccggtcggggaccaccggacggtcccggacccgtcgggcctcggtccgtgggtaccgaaggtcccgtaacttcccgacgtaccgaccgtacggttcgtaggtaccggccgggtcgtcggaccgaacggg

SEQ ID NO: 41201 - DNA, 714 bp, Homo sapiens
  misc_feature: GYAE6OF02GAMC2.36.85.H08.1.454.CMB.1.raw
  modified_base (179)..(179): a, c, t, g, unknown or other
  misc_feature (179)..(179): n is a, c, g, or t
  modified_base (259)..(259): a, c, t, g, unknown or other
  misc_feature (259)..(259): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtnaacccttagtaggtggtgacacagtattatgcacgagtaacgttccgagggcaagaactccaccatacgaccaagaaacncgctaccaataaacactacgttacatacggaactagaactagtctaggacgtaccgtaccggaacggaccgaccggtaccgttaattacgttacgtggtacgacggaagacgaaccgtaaggttacgttttacggacgttaggtagtaacgtaccggtaacggggttacccgacccggtgggaccgaacggtacccgtcggtacgtacccgtctccgtacgacgtaccctacccgaaccgaccggtccctaacgtcccggttacccctccccggccgtaccctacccctccgtaaccgacgtaccgccgtcccgtcggaccgggtaccaccggtaccgtcccgggtcccgtcggccgtccggccgttacgggtacgaccggttaccttaccggtaccgacgaccggtaccgtaccggtacgcggacggtccggacggtaccggacgacggtaccg

SEQ ID NO: 41202 - DNA, 722 bp, Homo sapiens
  misc_feature: GYAE6OF02FGO6V.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttggagtggatgggagtgggtagaacccttagtagtggtgacacagtattatgcacagtaagttccgagggcagaatcaccatcgaccaagaaacagacctacaataaacactagttactagtacggtaactagaactagtcgtagacgtccgtaccgacggacgtaccggtaccgtatattacgtgtcgacgagaacgaacgtaacgttagttttacggacgttaggtagtaacgtaacggtaacgggttacccgacccggtacggggacccgtaacgggtacccgtcggtaccgtacccgtccgttaccctacgtaccgtcctaccccgaccgaaccggcctacggttcccgtccccgttcccccgtcggtacccctaccccgtaccctaccggaacgaccgtacccgtacccgtccgggtaccggggaccaaccggaccggtcccggtcccgggtacggaccggtcgtcccgttacggtaccgaacggtaccttaaccgtacccgaacgtacgacggtaccgttacgcggtaaccggccggtacggccgtacgtacgg

SEQ ID NO: 41203 - DNA, 781 bp, Homo sapiens
  misc_feature: GYAE6OF02GIKM1.36.85.H08.1.454.CMB.1.raw
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaaggcttgagtggatgggatgggtgaacccttatagtggtgacacagattatgcacagaacgttccgagggacagaactacaccatacgaaccaagaaacagacctaccaataaacactagtttacagtaggaactagaactagtctagacgcgtaccggaggaccgtaccggtaccgttattaacttacgtgtcggtacggaagaggaacctaacggttagttttacggtacgttagggtaacgtaacggttaacgggtaacgggttacccggaccccgggtacggggacccggtaacgggaaccccggttcggtacccgtacccggttccctacccgtaccgaccgtcccctacccgaaacccggtaccggtccctacggttcccggtttccccttccccccggtacggtacccccgttacccccgttacccgtaaccgaaccgaccgtacccgtacccggttccgggtacgggggtacccctacggcccgggtacccggtccccggtcggtcgtcggtacccgtacggtaccgtaaccggtacccgttcgttaccgaacggtaccgtacggtacccgttacgaccggggtacgggtcccgggtcggtacgggacccggaacgg

SEQ ID NO: 41204 - DNA, 1050 bp, Homo sapiens
  misc_feature: GYAE6OF02G3J8A.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctacttctggcctcccagataccaccggagaaattgtgttgacacagtctccagcccacctatctttgtctccgaggggaagagccaccctctcctgctaggccagccagagtagttagtactaaaacgttacggacccttgggttaactaccgtaaaaccgtaaaaaacgtccttacgggacccttaacgggcccttaacccccggacggggacccttccccgttccaaccttacgtactcggtaatcggtaccctttaacccggaaaaaacggggtccccccgtacgggtacccaaccggttaccccccgaaaacccgtaacgggtttacccgaacgggttccgggacccgtaaggggttccggggttaccggttacggggtaaacccgtaacggttaaccttttacccgtaaacccggtttcccgttaaccctaaccccgtaacttacccgaacggtacccgtaaccggttaccccgttaaacgggtaaccgggtcccccgtttaaaggggtaaaacggttttaacgtttttttaccgggaacccgttttaaacccgtttttttaaattttaaccccgtttacgggtttaaaccccaaaccgttaaacgggttaccccgtttaaaccccgtaaaccgggttaccgggggtacccgggttaacccggggtttttacccgggaaaccccgggtaaaccgggggttaaaccccgggtaaacgggggtttacccgggaaaccggggttaaaacccgtaaaaacccgggtaaacggttaccggggtaaccgggttaccgttaccggacccgtaacccgtaacgttttccgttacccggttttacccgtttaccgtaccgttttacccccgtttaccccgggtaccctttaccgttacccggttaacggtaaaccggtaacccggtaacccggg

SEQ ID NO: 41205 - DNA, 827 bp, Homo sapiens
  misc_feature: GYAE6OF02HCSS6.36.85.H08.1.454.CMB.1.raw
  modified_base (202)..(202): a, c, t, g, unknown or other
  misc_feature (202)..(202): n is a, c, g, or t
  modified_base (817)..(817): a, c, t, g, unknown or other
  misc_feature (817)..(817): n is a, c, g, or t
tcagtacgctgtctcacgaccggtgctcgatttagtatcactcagtcgcgggaggagcagtacaacagcacgtaccgtgtggtcagcgtcctcaccgtctcgcaccaggactggctgaagtggcaaggacgtacgaagtgaccaagggtcctaccaaacaaacgcccctcccgacgcccccctataccgaacgaaaaacccnttccctaccaaagccgaaaagggcaccgaccccggaagaaacccatacttcgtcgtaccctactaacgaaccgtaaaaccctggtacgaacgtaccgacacgtcccttccgtaccaaccgaaggttacggtaccgtcgggtaaacctgggtacggacttccccttcgtttacgtcgggttcgacctaagggaccaacgtgttaaccgagtaccgtaccctaacccgttcccggaagggttcggaacctaaccgggtcggtgttacccggaagttttccgggcgggtaacgtaacggtttaaacaacggaaggttaaaacggtccgggtttccggggaaccttacccgggaggttttaaggggaacgggttttacgtaccccggtaggaaccggtaacgttacccggttaagaacggttaactaacccgtaaccgtttacgtaaaccgttaagttaacgttaacgttaaacgtaaccgttacgtacggtcgaccggacgaccggtaccgacgtaaggggaaccctaggtaccttaggtacgtagggactgggtagtgtaaccgggttaactaggtaccggttagaccgagtaacgagttctaggtacgcgtaacgngttaaccggg

SEQ ID NO: 41206 - DNA, 558 bp, Homo sapiens
  misc_feature: GYAE6OF02FL5B7.36.85.H08.1.454.CMB.1.raw
  modified_base (450)..(450): a, c, t, g, unknown or other
  misc_feature (450)..(450): n is a, c, g, or t
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
tcagtacgctgtctcacgaccggtgctcgatttagtatcactcagtcgcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaaccaagaaacacgctaccaataaacactaagtttacataggaactagaacagtactgagctccgaggacgacggccgtatattactgtgcgagacgacaacgtgttttcgacgtggtgaatacgaacgggttcgacccgtcgggccgagggtacccgtggtccacgtctcctcacgcctccacgaccggccacgtcgtcctccccgtgccnccctcctaccaancgccaccgtccgnggggccacgacgccggacccgtcgggctcgccgtggtccaaggtcctacgtcacgcagcgtacgcgagcggcgcggacacgg

SEQ ID NO: 41207 - DNA, 773 bp, Homo sapiens
  misc_feature: GYAE6OF02HUCE4.36.85.H08.1.454.CMB.1.raw
  modified_base (182)..(182): a, c, t, g, unknown or other
  misc_feature (182)..(182): n is a, c, g, or t
  modified_base (299)..(299): a, c, t, g, unknown or other
  misc_feature (299)..(299): n is a, c, g, or t
tcagtacgctgtctcacgaccggtgctcgatttagtatcactcagtcgcgggggaggaactgctcagttaggacccagagggaaccatggaagcccccagctcagcttctcttcctcctgctactctggctcccagataccaccggagaaattgtgttgacacagtctccagccaccctatntttgtctccgaggggaaggacgcccaccctctcctgacgacgggccagccagagtgttagtacaaaacttgcctaggtatacaaacaaaaagctaggccaaggcctccgagcctccncatctagtgatcgacttaccgaaaacggcccgtaggacctactaccccaaacgtacggttacagttcggaccagggttgggtccgtagggaactacggtaccttcaccttacctaccgaaacctacgtacaagaccgaaccgacccgttaaggaccgtacccgtaaaggtaaccgtttaacgttttttacggaccttttaaacgttttactttaaaccgttacggtaaccgtaaaaccgtaacggttaacccgtaaaacccgtaaccggttcggggtaaacccggggttaaccgggtttacccgggaaccggtaaaacgggggaaacccttaaacggggtacccgtaaagggttaacccgaaaaaccggttaacgtcgggttaacggacgttaggaccctacccgtagttccctttacggtacctttctaaccctccttacccgactaccgttactacggaacgaccgtaacgg

SEQ ID NO: 41208 - DNA, 709 bp, Homo sapiens
  misc_feature: GYAE6OF02F790R.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaaggcttgagtggatgggatgggtgaacccttatagtggtgacacagattatgcacagaagttccagggcagaatcaccatagaccaacgaaacagcctaccaactaaaacactaacgtttacagtaggaactagaacagtctagacgcgtaccggacggacgaccggaccgttatacttacgtgtgacgagagacgtaacgttagttttaggtacgttaggtagaacgtaacggtaacggggttaccgacccggtacgggaccgtaacgggtacccggtaggtacccgtacccgtccgtccgtacgaccgtccctacccaacccggaacgggtcccctacgttcccggttacccgttcccccgtcggaccctaccccgttcccgtaacccgaacggaccgtaccctacccgttcgggaccggggtaccaaccggtacggtcccggtcccggtgggtccctcggaccgttcggtaaccgacggtaccctaccgttaccggacgtaccgacgtaccgttacgacggacgggtccggtcgtacgggaccgaggtccgg

SEQ ID NO: 41209 - DNA, 661 bp, Homo sapiens
  misc_feature: GYAE6OF02IT8MI.36.85.H08.1.454.CMB.1.raw
  modified_base (109)..(109): a, c, t, g, unknown or other
  misc_feature (109)..(109): n is a, c, g, or t
tcagtacgctgtctcacgaccggtgctcgatttagtatcactcagtcgcgggggaggaactgctcagttaggacccagagggaaccatggaagccccagctcagcttcncttcctcctgctactctggctcccgagataccaccggaagaattgtgttgacacagtctccagccacctatctttgctccgaggggaagacgcccacctctaccgtgcgacgggccacgccgagtagttcgttagtacctaaaacgttgcccttaggtactacaaacgaaaagtctacggaccgaggcctacccgagggcctcccgactatcgtatcggtatcgcgttaccgaaaaggtcccctggcctacgtacccaacggtacgttaccgagtacgccgtacggttcggtacgtcggaagtcgtacgttaccacttcgtccgaacctatccaggccacgtcctagaccgtcttacggaagttctttcggaccttacttttagtacctagtaccaagtacgacgtacgacttcggggacgtaccgttcgggaccaacgggacgtacggcgtaaggtacaaacgtatggtacgcttacgccgtctagttccgttcggtacttcgttaccgtccgtttaccgtacgtactacggaacgttacgtacggaccgg

SEQ ID NO: 41210 - DNA, 793 bp, Homo sapiens
  misc_feature: GYAE6OF02JLXR9.36.85.H08.1.454.CMB.1.raw
  modified_base (208)..(208): a, c, t, g, unknown or other
  misc_feature (208)..(208): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgnaacagaagttaccgagggaccaagtaactccaccaacgtacgaaccgaagaaacctacggaccacctaaacgtaaaaccaacgttaacgtttaaccgtaagtacggtaaacgttacggaaaacctaacgttacgtaacggaccgtaccgtacccggaacgggtacccggaaccgggtcccgttaacgttaacgttaacgtggtcggaacggacggaaacgtaacgaacgttagttttacggaacgttggtaacgtaagtaacggtaacggggtttccgacccggtacgggtaccggacggttaacccgtcggtaccgtacccgttcccgtacctacgtaccgtaccctaccgaacccggtaaaccgggccccgtaccggttcccggttaccccttacccccgtccgggtacccttaaccccgcccccttaaccggaccgaccggtccctaaccccggtcgggttaaccgggaccgaccggtaccggcccgggtacccgcggtcgtacggtccgtaccggtacgtacgtacctacgtcgacgaccgtcggtacgtacgcggtccggacggtcgacgcggacgccgg

SEQ ID NO: 41211 - DNA, 529 bp, Homo sapiens
  misc_feature: GYAE6OF02FSTTN.36.85.H08.1.454.CMB.1.raw
  modified_base (380)..(380): a, c, t, g, unknown or other
  misc_feature (380)..(380): n is a, c, g, or t
  modified_base (483)..(483): a, c, t, g, unknown or other
  misc_feature (483)..(483): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccaggggaaggagccaccctctcctgcagggccagccagagtgttagtcaaaacttgcctggtatcaaacaaaaagctggccaggctcccaggctcctcatctatgatgcttaccaaagggcccctggcactcccaaccaggttcagtcgcagtggtctgggacagcttcactctcacatcagcagcctagngcctgtaagtattttgctatttattactgtacaactgaccgtacaactcgggcgacgttcggaccgaagggaccaggtcgaggtacaaacgtacgtgtcgtcngcaccgatcgtgtcttcatcccgttccgcattctagtacgatacgg

SEQ ID NO: 41212 - DNA, 688 bp, Homo sapiens
  misc_feature: GYAE6OF02FJ3E6.36.85.H08.1.454.CMB.1.raw
  modified_base (302)..(302): a, c, t, g, unknown or other
  misc_feature (302)..(302): n is a, c, g, or t
tcagtacgctgtctcacgaccggtgctcgatttagtatcactcagtcgcggggctgaaatgaagaagcctggggcctcagtgaaggtgtcctgcaagacttcaggatacacctttcacagtttatgaaatcaactgggtgcgacaggccacaggacaagggcttgagtggatgggatggggtgaacccttatagtggtgacacagattatgcacagtaagttccagggcagaactcaaccagtacgaaccaagaaaccagcctaccaataaacaactagtttacataggaactgaacagtcngagctccgaggacgacggaccgtatattacgtgtgacgagacgacgaacgtagtttttcggacttggtagaagttaacgaagggggtttcccgacccggtagggggacccgaacggggtaaccctgggtacccaccgtcctcctacgtacgtccctacccaccgaacggccctaacgtccggttcccttacccccgtggtacccaccccttcccgtaccgaacgccgaccaacccgttcggacggggtccaccggtaccggacccggtcccgggtcgggtaccctcgggtcccgtcgggtaccaacggtacccttaccgttaccacggtaacccgtacggtaccgtacgtacggacgggtaccgggtccgacgggacgtaaccggg

SEQ ID NO: 41213 - DNA, 711 bp, Homo sapiens
  misc_feature: GYAE6OF02I1OKZ.36.85.H08.1.454.CMB.1.raw
  modified_base (465)..(465): a, c, t, g, unknown or other
  misc_feature (465)..(465): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctccagataccaccggagaaattgtgttgacacagtctccagccacctatcttgctcgaggggagagccacctctccgtgcgacgggccaggccagacgtgttagactaaaacgttgcctggtatacaaacaaaacgctcggacctaacggccttacccgaggtcctccgtacattctagtgtagtcgtacctttaaccggaaaacgggtccccctaggacctacgttaccccaacgtacgggttacacgtcgaccgtaggttcgggtcgtacggactacgtaccttcactcgtacactatcaggcacgtccgtagacgtacgtaggtaaacggttnttttacggactttaacgttttaagtttacctggtacctaaacggtcgtaaccgttaaccgacggttgggaccggtaccggttccggaaccggaaacgggtaaccgacgggtaacgaaccgggtaacgtaaaccggtacggtacggtacgaccgttacgacccgtaccgtagtccgtttaccggtacttccgttaccgttcccgttaccccgacgtttaccttacgacggtaaccgtaggtacccgg

SEQ ID NO: 41214 - DNA, 704 bp, Homo sapiens
  misc_feature: GYAE6OF02HTGWI.36.85.H08.1.454.CMB.1.raw
  modified_base (181)..(181): a, c, t, g, unknown or other
  misc_feature (181)..(181): n is a, c, g, or t
  modified_base (261)..(261): a, c, t, g, unknown or other
  misc_feature (261)..(261): n is a, c, g, or t
  modified_base (314)..(314): a, c, t, g, unknown or other
  misc_feature (314)..(314): n is a, c, g, or t
  modified_base (675)..(675): a, c, t, g, unknown or other
  misc_feature (675)..(675): n is a, c, g, or t
tcagtacgctgtctcacgaccggtgctcgatttagtatcactcagtcggggctgaaatgaagaagcctggggcctcagtgaaggtgtcctgcaagacttcaggatacaccttcacagttttatgaaatcaactgggtgcgacaggccacaggacaagggcttgagtggatgggagtgggtnaccttataggtggtgacacagtaattatgcaacgagtaagttccgagggcaagaactcaaccatacgaaccaaagaaacncgtacctacaaaacgtaaacctaacttaagtttacagtacggtaactagaacncgttactagacggtccgtaccggtaggaccgacggtacgttattaacttcgtcggtagacgagataacgtagtttagttttacggagtaggtagtaacgtacggtaccgggttacccgacccggtacggggaccgaacgggtacccgtcggtccgtaccgtcctccgtaccgtaccgtcccgtaacccgaaccggtaccggtcctaccgttcccggttaccccgttcccgacgtccccttacccgttccgtaaccgaacgccgtacccgtaccggtcgggtaccggccgaacggcccgggtccgccgttcgccgtcgtccgtacgtacgacgtcctacgcgtaacgcgtccgtacgtcggnggaccggtcggtccggtagaccggtgacg

SEQ ID NO: 41215 - DNA, 773 bp, Homo sapiens
  misc_feature: GYAE6OF02GJTSY.36.85.H08.1.454.CMB.1.raw
  modified_base (136)..(136): a, c, t, g, unknown or other
  misc_feature (136)..(136): n is a, c, g, or t
  modified_base (199)..(199): a, c, t, g, unknown or other
  misc_feature (199)..(199): n is a, c, g, or t
  modified_base (478)..(478): a, c, t, g, unknown or other
  misc_feature (478)..(478): n is a, c, g, or t
  modified_base (746)..(746): a, c, t, g, unknown or other
  misc_feature (746)..(746): n is a, c, g, or t
  modified_base (754)..(754): a, c, t, g, unknown or other
  misc_feature (754)..(754): n is a, c, g, or t
  modified_base (766)..(766): a, c, t, g, unknown or other
  misc_feature (766)..(766): n is a, c, g, or t
tcagtacgctgtctcacgaccggtgctcgatttagtatcactcagtcggcgggggaggaactgctcagttaggacccagagggaaccatggaagccccagctcagcttctcttcctcctgctactctggctccagntaccacggagaattgtgttgacacagtcctcagccacctattcctttgctccgaaggggatancccgtacctcgtcctggcgtaacgggccagcctaagtagtcgtttaagaccaaaacgttggccttggttaacacgaaaacctaaaaagtccgttacgggacctagggtacccttccggaacggccttaccccgtataaacgttcctaaactgtaacgtcgtaccgttaacccggaaaacggtcccccgttaggacctaaccgtaacccgtaacctaagggtttccgaagttccgacgtagtcgggcgtaggacagtactcgtactctaccactatcganccgaacgtaccgagtacgtcctaagtacgttacttttacggtcccttaaattttaccgtaagttacgttaccgaaaccgtccgttaaaccgttacccgtaaacggttacccgggtcgggttaaacggtttccgggaaaccgtttaacccggggaaagtaccgggtttaacccgaggtaacccggttaaacgaacccgttaagttccgggttacgctttaacggacctacgggtccttacggttccgtagttacccttccgacccggtntaccggtntaaggttacccngtaaccg

SEQ ID NO: 41216 - DNA, 673 bp, Homo sapiens
  misc_feature: GYAE6OF02FNYVD.36.85.H08.1.454.CMB.1.raw
  modified_base (364)..(364): a, c, t, g, unknown or other
  misc_feature (364)..(364): n is a, c, g, or t
  modified_base (395)..(395): a, c, t, g, unknown or other
  misc_feature (395)..(395): n is a, c, g, or t
tcagtacgctgtctcacgaccggtgctcgatttagtatcactcagtcgcggggggaggaactgctcagttaggacccagagggaaccatggaagccccagctcagcttctcttcctcctgctactctggctcccagataccaccggagaaattgtgttgacacagtctccagccacctatcttgtctccaggggaaggagccacctctcctgcgagggccagccagagtgttagtactaaaacttagccttaggtactcaaacaaaagtctggccaggctccaggcctctcatctatgatcgcttaccgaaaagggcccctggccactcccgaacctaggttcgagtcgccgaggtcggggtcngggtacagtacttcacgtctacacactcgancgaactccgtaagacgtcctacggtaagttcttttagccttaacttttagttacttagaccaactaggttaccgtacctaacggtcggtaccgggtacggttaccgggaccgaaacggggtaacctaaacggggttccggaaacgggttaaccgaaaacgggtaaccggttacggtacggggaccttacggacccaccgtagttccgtagttttcccgtaacttaccgttcccgtttaccccgaccttacttccggtaacgtacgaacccgttaccgg

SEQ ID NO: 41217 - DNA, 830 bp, Homo sapiens
  misc_feature: GYAE6OF02G434F.36.85.H08.1.454.CMB.1.raw
  modified_base (204)..(204): a, c, t, g, unknown or other
  misc_feature (204)..(204): n is a, c, g, or t
  modified_base (322)..(322): a, c, t, g, unknown or other
  misc_feature (322)..(322): n is a, c, g, or t
tcagtacgctgtctcacgaccggtgctcgatttagtatcactcagtcgcgggggaggaactgctcagttaggacccagagggaaccatggaagccccagctcagccttctcttcctcctgctactctggctccagactaccgacggagaattgtgttgacacagtctccagccacctattctttgtcctacgaggggaaggacnccctaccctctcctgccgacgggccacgccaggtagttgttaacgtaacctaaacttcgaccttagtaatacaaaacaaaagcgtacggaccacggcctaccgacggtcctccgtacncttactagtacgacgttcgtacttaacgaacggttccgggtaccccgtggtaccctaaccgtaccccgtaaccgtaggttaccacgggttccgtaccggttaagggttcgggttaacggacggggtaaccgtaacggttacccttacgttacctacccttacgaaccctaacgtccgtaacgaccgtaacgtaccgtaacggcgttaaccgtaacgggtttaaacgtttactttacggtacgttttaaacgtttactttaaccgtaccgtttaaccgaaacgttcggtaaccccttaacggtaacggttcgggtacccgggttaaccggttcccgggaaaccgggttaacccggggaacgtaccgggtaacggtaacggttaacgtaaaccgttaacggtacgtcgggtacctacgtacccgtaacgttctccggtttacgttaccctacgtttacccgtttcccttaacccggtaccttaccggttaacggtaccggacctaaccgg

SEQ ID NO: 41218 - DNA, 709 bp, Homo sapiens
  misc_feature: GYAE6OF02IPGWS.36.85.H08.1.454.CMB.1.raw
tcagtacgctgtctcacgaccggtgctcgatttagtatcactcagtcgcgggaggagcagtacaacagcacgtaccgtgtggtcagcgtcctcaccgtcctgcaccaggactggctgaatggcaaggagtacaagtgcaaggtctaccaacaaagccctcccagcccccatcgaagaaaaccatctaccaaagccaaagggcagccccgaagaaccacatctcgtcctactaagaacgaaaaccctggtagacgcaacgagcctccgtaccaccagttcggaactcggacccgtagggacggtacttccgttcgtttcgttgggtcggacctaggctaggaccttaacaaggtccgaccctacgtcccgagggtcacgtaacgtggtacgacgtagtcggtcgggactaaggaaacgtaggaacgacggtccggtacggggcctagtaggtacggaacggttcgtacgtaggacgtaaacgtacgttcgaaggtactaacctacctttacgaacgtttagttaagtaacgtaaacttcggtaacggttcgggacgaaccggacgacggacctaagggaacggtaacgaagggtcgttaggaggtacggtaggtacgggtaggtacgggtacttaaccggttaggtacggtaggtaacgtaacctaggtacgttaacgttacggacggtaacgtacggtaacggttaacg

SEQ ID NO: 41219 - DNA, 946 bp, Homo sapiens
  misc_feature: GYAE6OF02IBS94.36.85.H08.1.454.CMB.1.raw
tcagtacgctgtctcacgaccggtgctcgatttagtatcactcagtcggcgggaggagcagtacaacagcacgtaccgtgtggtcagcgtcctcaccgtcctgcaccaggactggctgaatggcaaggatacaagtgacaaggtctccaaacaaacgccctacccgagcccccatacgaagaaaaccatactaccaaacgccaaaagggccagccccggaagaaaccactactactgtacctctaaacgaacgaaaaccctgtacgaagcaccacgtcgccctaccaccgacgtcggtactcggaccgttacgggaacggtacttccgttacgttcgttacgggttcggaccgtagtccaacgggtacctaacgaaacggtccgtaccccctaacgtaccccgtaagggtaccgtaccgtaaaccgttcggggtcgtaaccgtaccggttaccgggtagggggggtacccttaaagggtaaaaacggttaccggggaaaaacggttaaaccgggttcccgggttaccggggggtaccctttaaccgggtaaaggtttacggggtaaaccgggtttcccgttaaccggttacggaaccgttaaaacggttaccgttaaccggaacgggttaactaaacccgtttaacccggttaaccgttaaccggttaaacgtttttaaaccgtaaacggttaaacgtttaaaccgggtaacggtttacggggttacgggtaaccggtaaaccgggaaccggggtacccgtaaaacgtagggggaacccgttaaagggggttaccgtttaacggtaagggtaaccgggtaaacggtttaggggaacgggttcggtaaccgggttaccggtttaaacgggttaacgggttaacggttacggaaccgtaaaggtacgttaacggttaacgttacggtaactaaccggagttaaccggg

SEQ ID NO: 41220 - DNA, 870 bp, Homo sapiens
  misc_feature: GYAE6OF02HOGKG.36.85.H08.1.454.CMB.1.raw
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagccaccctatctttgtctccgagggaaggagcccaccctctcctgcgacggccagccagagtgttagtacaaaacgttgaccgttggtatacgaaaacgaaaaagctaggaccaggacctaccccgaaggcctacctacctaacgtcttaactgtactcgaccgtttacccgtaaaaaacggggccccctagggaccctactaccccgaaaccgtacggttacctaaggttcggacccgtaggttacggggtccgttacgggggtacctaagtaaccgtttaccgacgttaccgttaccgtaaacccgtagttaccgaaacgttacgaacgtaccgtagaaccgtaccgtagtaaacgtagtttttacgaccgtttaaacctttttaacgtttaaccgttagttaaccgtaaaccggtaacgtaccccggtttaaaacccgaaaccggtttacggggacccgggttaaccggttttacccggggaaccggtaaacccggggaaccggttaaaacggggtccggtaaaccggtaaccgtaaaacccgggttaaacgtcgggtaaccggttacggtaccggaccgtaacccggtaaccgtttacgttacggtttaccctaaccgtttaacccgttaccgttttaccccccggaccgttaacctttaaccgttaaccgggaaccgtaaaccggttaacccggg

SEQ ID NO: 41221 - DNA, 764 bp, Homo sapiens
  misc_feature: GYAE6OF02IOIFU.36.85.H08.1.454.CMB.1.raw
tcagtacgctgtctcacgaccggtgctcgatttagtatcactcagtcgcgggaggagacagtacaacagcacgtaccgtgtggtcagcgtcctcaccgtcctgcaccaggactggctgaatggcaaggagtacaagtgcaaggtctccaacaaagccctcccagccccccatcgagaaaaccatctaccaaagccaaagggcacgccccgagaaccacactctcgtcctactagaacgaaaacccctggtagacgccaacacgcctcctccaaccagtcggacgtcggaccgtagggaggtacttcccttcgttcgttggtggcagccagtctaacgaagtccgacccacgtcccgaggtcgactacgtcggtcgcgtacgtcgtgggactaggtaaagcggaaaggtaacggccggttcggggtccctagtaacggtagggtaacgggttcgtaccgtaggacgtaacgtacgttacgtaacgggtactaccgttaccgttacgaacgtttaacggtttaagtaacgttaaacttaaccgtaacgttggggtacgaccggtaacggacggacccgaaggaccgggtaaacggaacgggttaccgttagggaacgggttagggtaaggttaggggtaagttacgggggttaacgttaacccggtttaaggttaacgggttacgggttaacggtaaccgtaaacggttaacggttaacgtttaacggtaccgggtaaaccgtaacggtaacgggttaaacccggg

SEQ ID NO: 41222 - DNA, 957 bp, Homo sapiens
  misc_feature: GYAE6OF02JHJCM.36.85.H08.1.454.CMB.1.raw
  modified_base (201)..(201): a, c, t, g, unknown or other
  misc_feature (201)..(201): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggcctcccagataccaccggagaaattgtagttgacacagtctccagccacctatctttgtctccgaggggaagngcccacctctcctgcacgggccagccgagtcgtgttaacgtacaaacttacgccgtaggtaactccaaaacaaaagtcctacggaccaggtccctaccgaggccttcctcacttcgtaactcgtaatccgtaccgttaaccgaaaaccgggtccccctaggtccaccttaccccgaaccggtacgttccaagggtcctaccggtacggttcggggttccgtacgggaccgtaacggtaccttacctaccgttaccgtacctaaccgtacgttaccgacgaaccggtacgtacccctaacgggtacgttacccgtaagggtaaacgttttacgttttacggtaaccgttttaaccttttaaacgtttaaccggttacgttaaaccccgtaaacggttaaccggttaaccccggttaaaacccccgttaacggggttaacccgggggttaccccgggttaaacccgggttttaccccggggggaaaccccgtaaaaaccggggggttaaccccccggttaaacgggggttaacccggggtaaaacccggggtttaaaccccgggtaaaaaacccgggttaacggggttttaaccgggtacccgggggtttaaccgtaacccgggtaccccgttaaacccgtttaaccggttacccgggtttacttttaaccccggttccccgttaaccggttccccccgtttaccggaaccccctttggttaaacccggtaacggtaacggtaacccccggttaaggg

SEQ ID NO: 41223 - DNA, 719 bp, Homo sapiens
  misc_feature: GYAE6OF02F1747.36.85.H08.1.454.CMB.1.raw
  modified_base (162)..(162): a, c, t, g, unknown or other
  misc_feature (162)..(162): n is a, c, g, or t
tcagtacgctgtctcacgaccggtgctcgatttagtatcactcagtcgcgggggaggaactgctcagttaggacccagagggaaccatggaagccccagctcagcttctcttcctcctgctactctggctcccagataccaccggagaaattgtgttgacanagtctccagccaccctatcttgtctccgaggggaaggcgccaccctctcctgcagggccagccagagtgtagtcaaaacttgcctggtatacaaacaaaagctacggaccaggcctccgaggctcctcatctatgactcgtccttaaccgaaacgggtcccctaggacctaccgtaccccgaactacggtttacacgtcggaccgtacggtgggtcgtgggaacctaggtaccttcgaccgttcctcgaacctatcgacgcgacgtacctagacgtcctaggaaacgtttgttttcgactttacgtttacttacttacgtaccaaccgtacgtaacccgtaaccgaacgttcggggtaccggtaccggtttaccggggacccgtaaacgggggaacccttacggggtaccgtaaacggtaccgaaaacgtaccggtagggttacgacgtacgtaccgacctaacggttccgttaccggttaccttaccgtaccgttttacccccgtaccccgacctttaccggttaccggtaacggtaacccttaacgggtaacccg

SEQ ID NO: 41224 - DNA, 741 bp, Homo sapiens
  misc_feature: GYAE6OF02JOX6L.36.85.H08.1.454.CMB.1.raw
  modified_base (695)..(695): a, c, t, g, unknown or other
  misc_feature (695)..(695): n is a, c, g, or t
  modified_base (729)..(729): a, c, t, g, unknown or other
  misc_feature (729)..(729): n is a, c, g, or t
tcagtacgctgtctcacgaccggtgctcgatttagtatcactcagtcggggctggaaatgaagaagcctggggcctcagtgaaggtgtcctgcaagacttcaggatacaccttcactagtttatgaaatcaactgggtgcgacaggccacaggacaagggtcttgagtgggatgggatcgggtagaacccttagtaggtaggtgacgacaggtatttatggaccacgaagtaacgttcccgaggggacagtaaactccaaccagtcgacccaaaggaaaccttagcctacctaacaaaccgtactagtttacaacgtacggaaactgaaaccgtagtagacggtacgtaccgtaccgaggtaaccggaccggtccgtaatttacgtacgtcggtagacggaagaacggtaaccttaacggttacgttttcgggaacgttcgggtaagttaaacgttaaccgggtacggggtttaccggacccggtgggaaccggacgggttacccgtcggtacccgtacgtttcccgaccgtaccacggtaccctaccgaacccgtaccgggaccgttaaccggtccgttacccgtaccccgtccgtacccgtacccgtacccttaccggaacgacccgtccgtaccgtccggtacggtccgacacgggtccgacccggttgccgtcgcgtcgtacgacggtacnccggtacacgtacgcgactacgcgacggcggtcnggtacgcgtacg

SEQ ID NO: 41225 - DNA, 770 bp, Homo sapiens
  misc_feature: GYAE6OF02JAQAG.36.85.H08.1.454.CMB.1.raw
tcagtacgctgtctcacgaccggtgctcgatttagtatcactcagtcggggctgaaatgaagaagcctggggcctcagtgaaggtgtcctgcaagacttcaggatacaccttcacagtttatgaaatcaactgggtgcgacaggccacaggacaagggcttgagtggatgggatgggtgaaccttatagtggtgacacagattatgcacagaagttccagggcagatcaccatcgaccagaacagctaccataaacactaagtttacataggaactagtaacagtacgtagacgtaccgtaccggacggaccgtaccggtaccgttaacgttaactttaaccgttaggttcggaaccggtaagaacggaaccgtaaacggttacgtttttaggaaccgttagggttaagaaacgtaaccggtaaacgggggtttcccgtaaccccggttaggggacccgtaacggggtaaaccccgttgggtacccgacccgttacccgttacccgtacgacccgtaccccgtacccgaaacccgaaacgggtcccctaacgtcccggttacccttacccccgtacgggtacccctaccccgtaccctacccaaccgacgtcccaccgttaccggtaccggggaccaacccggtaccgcccgggtacccgttacggggccttaccggtacccgtacggttacccgaacggtaccttacccgtaccgtaccgaacgtacggtaccgtacgtacggacggtccggcgtacggacgaggtacg

SEQ ID NO: 41226 - DNA, 972 bp, Homo sapiens
  misc_feature: GYAE6OF02I4QCC.36.85.H08.1.454.CMB.1.raw
tcagtacgctgtctcacgaccggtgctcgatttagtatcactcagtcgcgggaggagcagtacaacagcacgtaccgtgtggtcagcgtcctcaccgtctgcaccaggactggctgaatggcaagggagtacaagtgacgaaggtctaccaaacaaacgcccctacccgaccgaccccccagttaccggaacgaaaaacccacgttaccttaacccaaaacggacccgaaaaggggccaaccggcccccgaaaggaaacccacctaacttcgttaccgttcccgttaccgtaaacggtaaccggtaaaaaacccttggtaccgaacggccaaacccgtcggtacccttccctaaccgaacccgtaagggtaccggtaaaccgtttccgggaaccggttaagggggaacgggttaacccctaccccgttttcgtttaccgggtttacgggttccggaccggtaaccgtaccgtacgggttaaccgttaaccggtacggttcccgaacccccgttaccgtaccccggtaacggtccgtaaccgttacggttcggggtccgtaacggtccggtcgggggacgggtaacgttaacggtaaagcgggtaaaacggacccgggttcggggtacccgggtcccgtaaggtaagggtacgggttaacgggttcccgttaccgaaggtaccggtaaaccgttacggtaccggtaaaggtttacccgtaacccgttacctttaacggtacggttaacgtttacggtaaacgtaaaccgtttaccggtaaacgggttgggtaccctaaccgggaccggttaacgaaccgtaaccgacggggtaacgtacgggttagtaggtaacgggagggtaggtaacggggttacggtaccggtttaacgtaaacgtcggttaaggtacgttaacggtccgtaaggttaacgttagttacggaaccgtacggtaacgttccgggtaaacgg

SEQ ID NO: 41227 - DNA, 851 bp, Homo sapiens
  misc_feature: GYAE6OF02JOMI1.36.85.H08.1.454.CMB.1.raw
tcagtacgctgtctcacgaccggtgctcgatttagtatcactcagtcgggctgaaatgaagaagcctggggcctcagtgaaggtgtcctgcaagacttcaggataccaccttcactagtttatgaatcaactggtgcgacaggccacaggacaagggcttggagtaggatgggagtgggtagaaccgttatagtggtagacacagtattatgctaacaggtaacgttacgagggacctaagaactcaccatacgaaccaagaacacgtcctacaactaaacgactaagttacgacgtacggaactagaacgtacgtagacgttaccgacgtccgtaagggacccgtaggaccgttacgtacgtttacgtacgtacgtacggaacgtaacggacgttttaaccggaacttttttgggaacgtacggttaagaaacgggttaccgtaaaccggggtttcgggacccccgtagggggtaaccccgtaggggggttacccctacgggttccgacccgtttccgtaaccggtccctaacggtaccccgtaaccggaccccgtaaacggggtccccgttaacgttccccgggttaaccttccccccggtcccggtcccgtaaccccgttacccttaacccggtaccgtacccgttaccggaccgggttacccgtaacgggggtaccacccggtaccgggtacccggggacccgtttcggggcccgtttaccgggaccgttaaccgggttaccgtaccgggtttaccctacggttaccccggtaacggcggttaaacccggtacggtaaccggtcgggtaccggtaccgggccgttacggggaccttaccggggacgg

SEQ ID NO: 41228 - DNA, 678 bp, Homo sapiens
  misc_feature: GYAE6OF02JA9AS.36.85.H08.1.454.CMB.1.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (591)..(591): a, c, t, g, unknown or other
  misc_feature (591)..(591): n is a, c, g, or t
tcagtacgctgtctcacgaccggtgctcgatttagtatcactcagtcgcggggctgaaatgaagaagcctgggggcctcagtgaaggtgtcctgcaagacttcaggatacaccttcacagtttatgaaatcaactgggtgcgacaggccacaggacaagggcttgagtggatggggatgggtgaacccttataggtggtgacacagattatgcanagatcgaggnagaatcacatacaccagaacagcnccaagtaaacaactatttaacagtacgggaactagaactagtctggaacgcgtaccggacggaccgaccggtaccggtaacttacgttacgtgtaggaccgtagaacggaactaacggtattttacggtagttaggtagtaacgtacgggttaaacggggtccgtacccggtaggggaccgacgggtaacccggtcgtaccgaccgtcgtcccagtccgaccctacccggtaccgacgggtaccctacgtcccggttccctccccgtcggaccctacccgtccctaacgactacgcctacgtccggtccgggacacctcgggcccgtccggtcggtccgtcnccgtagggtactacggtaccgtacgttaccggaacgttccgaagtccgttacggtacggcccgggacggtggtacgggacgaccggg

SEQ ID NO: 41229 - DNA, 531 bp, Homo sapiens
  misc_feature: GYAE6OF01BZMKV.19.15.B04.1.454.CMB.1.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
  modified_base (455)..(455): a, c, t, g, unknown or other
  misc_feature (455)..(455): n is a, c, g, or t
  modified_base (524)..(524): a, c, t, g, unknown or other
  misc_feature (524)..(524): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctcccaggttccncatctatgctgggtcccacgacgggcccacgtggcactcccgagacaggttcagtggcaggtgggtctgggacagacttcactctcatcattagcagactggagcctagaagtatttcgctagtgtattactgtcagtctagtagtaggtagttcaccttntcgtcgttcggacgtaacgggaccgaaggtagaaagtacgaaacgtacgtggtacggtctagacacctntcgtacg

SEQ ID NO: 41230 - DNA, 660 bp, Homo sapiens
  misc_feature: GYAE6OF01B2IAA.19.15.B04.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagcctccagccagaactatccagacgctaactacatacgcctggtaccagcagaacgcctggccaggcctcccgaggttccncatctatgcgtcgggtcccagcgggccagtcggacactacccgagacaggttcaggtcggctaggtgggtctggggacacgtacttcactctacatcattacgctaagacgtggacgtcctagaacgtacgtttccgactaggttagttactttacgtacgtacgagtacgtaaggttacgtaggttaacgtttccgtaaccgtttcggttacggttaccgggtttaccgggaccggtaaacggggtaacccgtaaaaggggttaaacgtaaaacgttaacgggaaaaacccgttaacggttaccgggttacggtaccgttacggtaacccgtaacccgttaagttcccgtttaacgg

SEQ ID NO: 41231 - DNA, 730 bp, Homo sapiens
  misc_feature: GYAE6OF01DAUJ8.19.15.B04.1.454.CMB.1.raw
  modified_base (145)..(145): a, c, t, g, unknown or other
  misc_feature (145)..(145): n is a, c, g, or t
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
tcagtactctcgtgcacgaccggtgctcgatttagacagtatatacccgcgggggagctgctcagttaggacccagagggaaccatggaaaccccagcgcagcttctcttcctcctgctactctggctcccaggctcagaaaccnccggagaaattgtgttgacgcagtctccaggcaccctgtctttgtctccgaggggaaangccaccctctcctgcagctccagccagaatatccagagctactacatacgcctggtaccagcagaacgcctggccaggcctccaggttccnatctatcgctcgggtccccagacgggcccaacgtcgggactacgtccccgaaggacctaagggtttccaaggttcgggacctagggttcgggggtactagggggaaccaaggtaccttttcgaacctttcgttaccaatttcccgtaagttttaacgaccgtaagggtaaccgttaggggaaccgtcccgttaaggtaaaacggttacgtttttaccgggaccgttaagggtttacgtttaacgttttaaccgttcggttaccgtaaggtacgtaaaggtttaacgttacgggttaaacgttttccaacccgtttcgttacggttccggtttaccgggacccgtaaaggggacccgtaaagggtaacgtaaaacgttagggaaaacggtaacgttaggtacggacttcggaccaacctacgtcgttcggttaccc

SEQ ID NO: 41232 - DNA, 586 bp, Homo sapiens
  misc_feature: GYAE6OF01AQRTX.19.15.B04.1.454.CMB.1.raw
  modified_base (204)..(204): a, c, t, g, unknown or other
  misc_feature (204)..(204): n is a, c, g, or t
tcagtactctcgtgcacgaccggtgctcgatttagacagtatatacccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttcctcatctatgctgggtcccacagggccacgtggcatcccagacaggttcagtggcagtgggtctgggacagacttcactctcatcattagcagactggagcctgaagtactttcgctagtcgtatttacgtgtcagcgtaagttatgggtaacgtttccgaccgttcttcggttccggtttaccgggtacccgtaaaggggtaacccctaaagggttaacgtaaaacgttagggaaaaccggtaacttagggttacgggacttcggaccaaccctaagttcccgttggtttaccc

SEQ ID NO: 41233 - DNA, 763 bp, Homo sapiens
  misc_feature: GYAE6OF01AVKJG.19.15.B04.1.454.CMB.1.raw
  modified_base (203)..(203): a, c, t, g, unknown or other
  misc_feature (203)..(203): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaancgccaccctctcctgcagctccagccaagaatactccagacgctactacatacgcctaggtaccagacagacgcctcggccaggcctcccgtacggttccctctactctagtcgtcgtcgggtaccccacggaccgggcctacgtcggaccacgtcccgaagaccgtacggttcgaggtcggcgtagggtcgggtacgtagggaactacggtacctttaccgacgttcctacgtaacttaccgaagtttaccggacgtaacggtaccgtacgggtaacggtacccgttaaaggtaaacggtttaccgttttaccggagttaacggttttaccggtttaacgttttacgttacggttaaccgtaaggttaccgttaaagggtttacggttaacggggtttaaaccgtttcccctaacccggtttcggtttaccgggttacccgggtttaccggaaacccgggttaaacggggtaaacccggttaaaagggttaaaccggtaaagttaaccgggaaacgttaacgttggtacggtacctacgaccgtactcgttccgttacg

SEQ ID NO: 41234 - DNA, 816 bp, Homo sapiens
  misc_feature: GYAE6OF01EP26T.19.15.B04.1.454.CMB.1.raw
  modified_base (150)..(150): a, c, t, g, unknown or other
  misc_feature (150)..(150): n is a, c, g, or t
  modified_base (208)..(208): a, c, t, g, unknown or other
  misc_feature (208)..(208): n is a, c, g, or t
tcagtactctcgtgcacgaccggtgctcgatttagacagtatatacccgcgggggagctgctcagttaggacccagagggaaccatggaaaccccagcgcagcttctcttcctcctgctactctggctcccaggctcagaaaccacgganaattgtgttgacgcagtctccaggcctacccttgttctttgtcctacgaaggggaaancgcccaccctctcctgcagcctccagaccaagtaactactccgagacgtacttaactacatacgcctacggtaccagcaacgaacgccgtacggaccacggtccttaccccgtaggtttccctactaacttcgtacgtcggtccgttccggggtaccccaacggaccgggtccctacgtcggacctaaccgtaccccgaaggtaccgtacgggttacacgggttacgggaccgttagggttcgggggtaccgtacggggtaacctaacggttaccttaccgtaaccgttcgtacctaacgtttaccgtaagtttaaccggaccgtaacggtaccggttacggggaacccgttaccgttaacggtaacggtttaccgtttaccggacgtttaacggtttacgtttaacgtttaccgtacggtacgtacgttacggttaagttaacggttaacggttaactttccccgtaacgtttcggttacggttacccggttaccgggtaacggtaaaccgggttaaccgtaaaagggttaacgaaaacgttaagggtaaacgttacggttcgggtacggtacgtaacgacccttaacgttcttcgttacgttaccc

SEQ ID NO: 41235 - DNA, 660 bp, Homo sapiens
  misc_feature: GYAE6OF01BVRKS.19.15.B04.1.454.CMB.1.raw
  modified_base (202)..(202): a, c, t, g, unknown or other
  misc_feature (202)..(202): n is a, c, g, or t
tcagtactctcgtgcacgaccggtgctcgatttagacagtatatatccgcgggggagctgctcagttaggacccagagggaaccatggaaaccccagcgcagcttctcttcctcctgctagtctggctcccaggctcagaaaccaccggagaaattgtgttgacgcagtctccaggcaccctgtctttgtctcgaggggaancgccaccctctcctgcagcctccagccaagaactactccagacgcctactacatagcctggtaccagcaagaacgcctggccaggtcctcccgtaggttccctcatcctagtcgccgtcgggtaccccacgacgggcccacgtcggacctactaccccgagtaccgtacggtttcaggtcgggccgtaggttcggggtacgtaggggactacggtaccttcaccgtcctactattactaagttacgactacggacgtggacgtccgttaaggtaacgttcgtttccgactacggttagttaactttacgtagtacacggtactaaggttagtacgggttaacttcctaccgttgttacggttccggttccggaaccggtaacgggaaccgtaaaggtaacgaaagttacggaaacgtacgttacgggtacggcgttacgaacccacgtcgtcgttacg

SEQ ID NO: 41236 - DNA, 754 bp, Homo sapiens
  misc_feature: GYAE6OF01A9454.19.15.B04.1.454.CMB.1.raw
  modified_base (204)..(204): a, c, t, g, unknown or other
  misc_feature (204)..(204): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaancgccaccctctcctgccagcctccagccagaactactccgagagctactaccagtacgcctaggtaccagacagaacgcctggcccacggtccctccccgtaggtttccccacgtacttccgttagtcggtccgttcggggtccccaacggacggggcccctacggttcggaccaaccgtccccgaaggtacctagggttccgaggttcgggaccgtagggttcggggtacgtagggggaactacgggtacggtttacccacgttccctacccgaaccgtacgtaccgaacggtccgaacggtcccgttggaccgtacggttacgttaacggtaacgtttacgttttacggtaccttttaagggttttaacctttaacggttcggtttaaccacggtaccgttaaagttaacgttaaacgtaacgtttccggtaccttacggttacggtaccggtttccggggaacgggtaccgggtaacggtaagggtacgggtaagtacgtacggaaacgtacgcgggttacggcgtacgaccgtaaccgtcgttacg

SEQ ID NO: 41237 - DNA, 557 bp, Homo sapiens
  misc_feature: GYAE6OF01BR5XL.19.15.B04.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (291)..(291): a, c, t, g, unknown or other
  misc_feature (291)..(291): n is a, c, g, or t
  modified_base (387)..(387): a, c, t, g, unknown or other
  misc_feature (387)..(387): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaangccacctctcctgcagctccagccagaactntccagagctactacatagcctggtaccagcagacgcctggccaggcctccgaggttccnactctatcgctcgggtcccagacgggccacgtcggcactcccagactaggtcagtggactaggtcgggtctaggggacaggtaccttcacgttctnacttcattacgcagtacgtggacgtcctaggaacgtntttcgntagtagttattctgtcagctagtagtaggtacgttcaccttgtcgtcggttccggaccgtaagggactaagggtagaaagtacggaaacgtacgttggtacggtctacggacctacgtcttcgtacg

SEQ ID NO: 41238 - DNA, 758 bp, Homo sapiens
  misc_feature: GYAE6OF01C0MD6.19.15.B04.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaangccaccctntcctgcagctccagccaagaatatccagagctactacatacgcctaggaccagcaagaagccctggcccaggcctacccgaggtttcccacattctatcgccttcgggcccaacgacgggcccaagtcgggacctacgtaccccaaggtaccaacgggtttccaagggtcgggacctagggttcggggtacgtggggaaactacggtactttaccgaacttccttactaattaccaagtttacggacctaaggtaaccgttaggggaaccgtacccgtaaggtaaaacgttacttttaccgggataacgggtttcgttaatttaacccgttggttaccgaaggttaccaagggtttacgtaaggggttaacgtttacccgtaaccgtttccgttacgggttacccgggttttaccgggaacccggtaaaacgggggtaaacccctaaagggggtaaaacgtaaaacgttaacgggaaaaccggttaaacgttcgggtaacgggtaccctaacggtaccccaaccgttaaagttcgtttaaccgg

SEQ ID NO: 41239 - DNA, 787 bp, Homo sapiens
  misc_feature: GYAE6OF01CVDUM.19.15.B04.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (777)..(777): a, c, t, g, unknown or other
  misc_feature (777)..(777): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggcctcccaggcctcacgaaaccaccggagtaaattgtgttgacgcagtcctcgagcacccttgtctttgctccgagggaancgccacctctccngcagcctccagaccaagtaactactccgagacgtacctaactacagtacgccgttacggtaaccagacaaagaaccgtccgtacgggacccgtacgggtacccctaccccgttacggtttaccctaccgtaacttaccgtaacggttccggtacccggttacccgggtaccccgaacggaccggggtacccctacggttaccgggaccttaacccgtacccggtaacggtaaccgtttaacgggttccccgtaaggggtttccgggacggttaacggggttacggggttacccggtaaccggggtaaccgtaccggtttaccctttacccggttaccttacccgtacttacgtacccgttaagttacggtacgtaacgtaacggttacggaccgtaccgttaggtaactacgtttacgacgttagtacgttactacgtagtaccgtagtacgtacgttagtacgtaacttcgtcttacggtcgtacggtaccgaacgaaggtaccgaaggttaacgaagtacggtaaacgagttacgacggtacctacgaccttacgnttcgttaccg

SEQ ID NO: 41240 - DNA, 840 bp, Homo sapiens
  misc_feature: GYAE6OF01A9KIP.19.15.B04.1.454.CMB.1.raw
  modified_base (423)..(423): a, c, t, g, unknown or other
  misc_feature (423)..(423): n is a, c, g, or t
tcagtactctcgtgcacgaccggtgctcgatttagacagtatatatccgcgggggagctgctcagttaggacccagagggaaccatggaaaccccagcgcagcttctcttcctctgctactctggctccaggctcagaaaccacggagaattgtgttgacgcacgtccctacgacgacctaccgttgtttcgtttcgtccgtacgggaaacggggaagacccgtacccctacccgtccttccgcgacgacgtcccgtaccgaccgaaccgaaagtaacctaccaccgtaaggacttacctaacactacgttaccgcgttacgaaccgacgacggaacgtaccgtccgtaccggccgacgtcccgtaccgttacgttccactcgtactagtcggtccggtaccggtaccgacggtccggtaccncgtcgacctaccgtaccggacgtacggttacgcggtaaggtcgacggtacgggttcggacggtacggacttaaccggtcttacgcgttacacgtacttacgtagttacggctacgggttacgtacgggtacctaacgttaacggtaaaccgttcgttaccgaaggtttaacggtttacgttaccgtttacggtacggtaaccgttaaggtaaacggtagttttaacgggttaccttaaccccgttcggttttaccgtcggttttacccgggtaaccgggtaaccgggaaacggggttaaaaccccggtaaaagggttaacgttaaaccgtaaacggggttaaaaaccgtacgggttaacggtcgggttaacgtaacccggtacccgtaacccttagggttcccgttttcggttaacc

SEQ ID NO: 41241 - DNA, 956 bp, Homo sapiens
  misc_feature: GYAE6OF01DQ8U2.19.15.B04.1.454.CMB.1.raw
  modified_base (206)..(206): a, c, t, g, unknown or other
  misc_feature (206)..(206): n is a, c, g, or t
tcagtactctcgtgcacgaccggtgctcgatttagacagtatatacccgcgggggagctgctcagttaggacccagagggaaccatggaaaccccagcgcagcttctcttcctcctgctactctgctcccagctcagaaccacggagaattgtgttgacgcagtcctccaggccacccttgttctttgcctaccgaaggggaaacncgccctaccctctccgtgaccacgtcctaccgacgacctaaggtaacttactaccgaaggactaccttaaactacgtataccggccgttacggtaacccaaggaccgtaacggaaccggtcccgttacgggaccctaacggggtccccttaccccggtacggtttaccccttacgtaacgtttcctaacggttcggaccccggtttccgggtaccccaaacggtccgggaccctaacggttcggaccctaaccgtacccggaaggtaccgttacgggttaccgtaggggttaccggacggttacggggttacgggggtacgttaacggggaaccctacggtttacccgttccgtaaaccgttctaacgtaacgtttaccgtaacggttaacgaccgttaacgggtaccgttaacggggtacccgttaaccggttaaggttaacgtttaccgttacccgtaacggtttaacggttttacgtttaacccgtttcggtacggtaacgttacccgggtaagtttaacggggtttaacgttacccgggttaaaccgttttcccggtaacccgttttcgggttttacccgggttaacccgggttaacccggaaaaccccggggttaaacgggtaaacccgttaaaaaggggttaaaccggtaaaaccggttaaacggtaaaccgggttaacggttcgggtaaaccgtacccgttaacgacccgttaaacctttcgttaaaccgtttcttaaccccg

SEQ ID NO: 41242 - DNA, 634 bp, Homo sapiens
  misc_feature: GYAE6OF01A1AAI.19.15.B04.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaanacgccaccctntcctgcagctccagccaagaatatccagagctactacatacgctggtaccagcagaagctggccaggctccaggttcctcatctatgctgggtcccacgtagggccaacgtgggcactcccgagtaccaggtttcacggtggctaaggtgggtctggggacaggacctttcactcgtacatctattacgcgagactggacgacctagaacgtactttcgctacgtagttagttactgtacgaggtactaaggttaagtacgggtaaacgtttccgtacccgttacgttcggttaccggttccgggtaaccggtaaacggggtaaacccgtaaagggttaaacggtaaaagtaacggtaaaaaccggtaaccgttagggttacgggtacgttacgtaccgaacccttaagtcgtttaccgg

SEQ ID NO: 41243 - DNA, 719 bp, Homo sapiens
  misc_feature: GYAE6OF01D5Z46.19.15.B04.1.454.CMB.1.raw
  modified_base (204)..(204): a, c, t, g, unknown or other
  misc_feature (204)..(204): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgcccacccgtctcctgcacgcctccagccagaatactaccagagtactactacatacgcctaggtaccagacagaacgccgtaggcccgacggccttaccccgacggtttccctactaacgttcttacggtcggtacccggttccgggtacccaaccggtaccgggccctacgtcggacctaccgtacccgtaacgacgtacggttccaggtggtacgagggtttcgggtacgtacgggactacgtaccttcacgttcctacgtactcgtaacgttgaccgtacgtacggtacggacgtaccgttaaggtaacgttacgtttccggacgtaggtttacgttaacttacgtcggtaacgacgttcggtaagtttacggtacgggttaacttccctaacgttccggtagggttacccgtacgggtaacccgaaaggggtaacctaaagggtaaactaaggtaacgaaacgggtaccctgggaccggtactaccgtaccgaccttaggtcttacccg

SEQ ID NO: 41244 - DNA, 748 bp, Homo sapiens
  misc_feature: GYAE6OF01CGYYX.19.15.B04.1.454.CMB.1.raw
  modified_base (196)..(196): a, c, t, g, unknown or other
  misc_feature (196)..(196): n is a, c, g, or t
tcagtactctcgtgcacgaccggtgctcgatttagacagtatatacccgcgggggagctgctcagttaggacccagagggaaccatggaaaccccagcgcagcttctcttcctcctgctactctggctccagctcagaaaccacgagaattgtgttgacgcagtctccgagccacctgtcttgtctccgagggaanacgccaccctctcctgcacgctccagaccaagtaactactaccgagacgtcctactacagtacgaccgtcggtaaccagtcgaagaacgccgtagggaccctagggtccctacccgtaaccggtttcctaccgtaacgtttccgtagtaccggtccggttacccgggttacccaaacgggtacggaccccgtaacggttccggacctacccgtaccccgtaagggtaccgttaagggttacccgaagggttccggtacggtaacgggttccggggtaacgtacggggtaacctacggttaccctttaccgtaccttaccggtacgtaacgttacgtaacgttaccgagtacgtacgtacggtacgtacgtaggtaacgttacgttacgtacggtagttagttacgtacgtagtactagagtacgtaagttacgtactttacgtcgttcgttacgtacggaaccgtaacggtacgtaaacggtaagtaacgtaggtaaacttacgggtacgtacgtacgtacgtacgaccttagtacgttcgttcgttacccg

SEQ ID NO: 41245 - DNA, 836 bp, Homo sapiens
  misc_feature: GYAE6OF01DA2WW.19.15.B04.1.454.CMB.1.raw
  modified_base (226)..(226): a, c, t, g, unknown or other
  misc_feature (226)..(226): n is a, c, g, or t
  modified_base (498)..(498): a, c, t, g, unknown or other
  misc_feature (498)..(498): n is a, c, g, or t
tcagtactctcgtgcacgaccggtgctcgatttagacagtatatatccgcgggggagctgctcagttaggacccagagggaaccatggaaacccagcgcagcttctcttcctcctgctactctggctcccaggctcaacgaaaccgaccggaagtaaattgtgttagacgcagtcctaccgacggcctacccgttgttctttcgtccgtaccggaagggggaaacncgtacccctacccgttctccgtcgccgacgtcctaccgacgacctaagtaacttacgaccgaaggtactacttaaccttaacacgtacggtaccgttacgggaaccgacgaacgtaacggacggtacccggttacggacccggaccggtacccgttaccgttaccggtttaccctaacgtactttacgtacgtccggtcggttaccccgggtacccaacgggtaccgggaccctacgtcggacctaaccgtcccgaacgtacgtaacggttnaacgggtgacggtggttcggtacggcgtacgtacgtacttcgactctacgtactagtttacgtaacgtacggacgtacggtacggtacgtaccggttaagtaaccgtttagttcgaacttacgggtttaaactttcgtaacggtcgaccgttaacggtacttaacgggttataaccgggtttaactaccccgtttacgtaggtttacccggttacggggtacccgaaaaccggggttaagggaaacccgttaaaaggtacggtaaaacggttaacggtaaacgggtaccgtcggggtaactccggtaaccgtaacctccgtttaagttcccgttaacg

SEQ ID NO: 41246 - DNA, 498 bp, Homo sapiens
  misc_feature: GYAE6OF02HSWBW.19.15.B04.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctggatcccacagggccatggcatcccagacaggttcagtggcagtgggtctgggacagacttcactctcatcattagcagactggancctgaagtatttcgcagttgtattactgtcagcagtatggaattcactctgtcgttcggaccaagggaccaaggtagaaagtcgaaacgacgtgaggctgactacatcg

SEQ ID NO: 41247 - DNA, 513 bp, Homo sapiens
  misc_feature: GYAE6OF02HY18N.19.15.B04.1.454.CMB.1.raw
  modified_base (202)..(202): a, c, t, g, unknown or other
  misc_feature (202)..(202): n is a, c, g, or t
  modified_base (510)..(510): a, c, t, g, unknown or other
  misc_feature (510)..(510): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaanagccaccctctcctgcagctccagccagaatatccagagctactacatagcctggtaccagcagaagcctggccaggctccaggttcctcatctatgctgggtcccacgagggcccacgtggcatcccagacaggttcagtggcaggtgggtctgggacaggacttcacttctcatcattagctagactggacgtcctgaagtatttcgctagtgttaattactgtcagcagtatgaagttcacttctgtcgttcggccgtaagggctaaggtaagtaatagaaacgacgtgtaggctgacactactntcg

SEQ ID NO: 41248 - DNA, 507 bp, Homo sapiens
  misc_feature: GYAE6OF02FRYWQ.19.15.B04.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (397)..(397): a, c, t, g, unknown or other
  misc_feature (397)..(397): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccnatctatgctgggtcccagagggccactggcatcccagacaggttcagtgcagtgggtctgggacagcttcactctcatcattagcagactggacgcctagaagtntttcgctagtgtattactgtcagcagtataggtaattcacctctgtcgttcgacgacgggaccaaggtagaaagtacgaaacgtacgtaggtggctgaccactatctacg

SEQ ID NO: 41249 - DNA, 531 bp, Homo sapiens
  misc_feature: GYAE6OF02F4PUY.19.15.B04.1.454.CMB.1.raw
  modified_base (203)..(203): a, c, t, g, unknown or other
  misc_feature (203)..(203): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagttagtaggtaagttcctaccttctcggttcggttacggaccgaacggggaccaagggtaagaaatacggaaacgtaactgtacggtctacggacctacctatcgttacg

SEQ ID NO: 41250 - DNA, 502 bp, Homo sapiens
  misc_feature: GYAE6OF02G9SJZ.19.15.B04.1.454.CMB.1.raw
  modified_base (203)..(203): a, c, t, g, unknown or other
  misc_feature (203)..(203): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (393)..(393): a, c, t, g, unknown or other
  misc_feature (393)..(393): n is a, c, g, or t
tcagtactctcgtgcacgaccggtgctcgatttagacagtatatacccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaancctggtcaggctcccaggttcctnatctatgctgggtcccagngggccactggcatcccagacaggttcagtggctaggtgggtctgggacagacttcactctcatcattagcagactggacnccgtagaagtatttcgctagtgttattacgtgtcagcagtataggattcactctgtcgtcgcaaggactaaggtagaagtagaacgacgtgtagctagcacatcgtatc

SEQ ID NO: 41251 - DNA, 721 bp, Homo sapiens
  misc_feature: GYAE6OF02GQH6D.19.15.B04.1.454.CMB.1.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcacctgtctttgctccgaggggaaangccaccctctcctgcagcctccagccagaactactccagacgctactacatacgcctggtaccagcaagaacgccgtaggccaggccttccccgagggtttccccanacttcctatcggtccgttccgggtaccccaacggcggggccccaacgttcgggacctacgtaccccgaaggaccgtaggtttaccaggttcgggccgtaaggggttcgggtacgttaggggaacctaacgggtacctttaccgaccgtttcctacgtacttacgtaagtttacgacgtaacggtacgtacgggtacgtacccgttaaggaaacgttacgtttacggacgttaggtttacgttaactttacgtcgtaccgaacgtacgtaaggttacgttacggtaacgttccgttaaccgttcgttcggttaccggttacggaccggtaagggaaccgtaaacgggtaagtaaacgtaacggtaaaccgttaacgtacggtacgtccggtacgaccgtacgtatccgttacg

SEQ ID NO: 41252 - DNA, 575 bp, Homo sapiens
  misc_feature: GYAE6OF02I4B1O.19.15.B04.1.454.CMB.1.raw
  modified_base (202)..(202): a, c, t, g, unknown or other
  misc_feature (202)..(202): n is a, c, g, or t
  modified_base (366)..(366): a, c, t, g, unknown or other
  misc_feature (366)..(366): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctctcctgcagctccagccagaatatccagagctactacatagcctggtaccagcagaagcctggcccaggctcccaggttcctcatctatgcgtgggtcccacgagggccacgtggcactcccagaccaggttcaggtggcaggtggtctgggacngacttcactctcatcattagctagacgtggacgtccgtagaagtatttcgcgtagttgttacttactgtacagctaggttagtaggtaacgttcgtaccttcgttcggttaccgtttcgggaccgtaacgggaaccgtaagggtaacgaaaacgttaaggaaaacgtaaccgttaggtacggtcgttacgacctaccgtacttctacgg

SEQ ID NO: 41253 - DNA, 731 bp, Homo sapiens
  misc_feature: GYAE6OF02HBXAR.19.15.B04.1.454.CMB.1.raw
tcagtactctcgtgcacgaccggtgctcgatttagacagtatatacccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaaagagccaccctctcctgcagctccagccagaatatccagagctactacatagcctaggtaccagcagaagcctggccaggcctcccaggttcctcatctatcgctcgggtccacggacgggcccagtggctacgtccccaaggtactacgggttcaggtggactaggggttcgggtcctagggggaactacggtaacctttcgaccttcctacgtaacttaccgtaagttaacggactaagggtaccgtgggacgtccgtaagggtaacgttaacgtttcggacttaggtttagttaacttaacgttggtacgtacgacgttaaggtacgttacggggtaaacttccgtaaccgttccgtttacgggttaccggttaacccgggaaccggtaaacgggggtaacccgtaaaagggggttaacgaaaaacggttaaccgggtaaaaccgtaaaccgggtttacggggtaccggtacggttaacccgggaaccgtaaccccggttaatttacccggttacgtttaaccccgg

SEQ ID NO: 41254 - DNA, 595 bp, Homo sapiens
  misc_feature: GYAE6OF02JUYP6.19.15.B04.1.454.CMB.1.raw
  modified_base (203)..(203): a, c, t, g, unknown or other
  misc_feature (203)..(203): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccgagggaaangccaccctctcctgcagctccagccagaatactaccagacgcttacacatacgcctggtaccagcagaacgcctggccaggctcccaggtttccctcgatcctagtcgtcgtcgggtaccccagcgggaccacgtggcctactccgagactaggttcaggtcgcaggtcggtacgcggacagtaccttctactccgatactcgtaattcgagaacgnggttagnggtacctagaaacgttctccgtaagtgttacgttagttacctgttacgacgtacgtaacgttagtacgttaacgtccttacgttcgtacgtcggttaccgacggtaggacctaagggtactaaagtcgaaaccgtagtaggtcgtagacggtactcgtatacgttacg

SEQ ID NO: 41255 - DNA, 737 bp, Homo sapiens
  misc_feature: GYAE6OF02FSKLB.19.15.B04.1.454.CMB.1.raw
  modified_base (203)..(203): a, c, t, g, unknown or other
  misc_feature (203)..(203): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaancgccacctctcctgcagctccagccaagaatactccagacgctactacatagccctaggtaccagcagaacgtccgtaggcccaggccctcccgtaaggtttccctcacttcctaagtcggccgttacggggtccccaacggtacggggaccctaacgtcgggacctaaccgttaccccgaaggtaccgtacgggtttccaacgggttcgggctacgggttgggtccgtacgggaacctaggtaccctttacgaccttcgtactacgtacgtaacgttacgctaacggtacgtagggacgtacccgtaaggtaacgttacgtttccggacttaggtttacgttaacttacgtcggtacaacggtcgtaaggttacgtaggttaaccgttcctaccgttcgtacggtttaccgtacccgggaacccggttaacgggtaaccgtaaacggggttaacgaaacgttaacgggaaaaccggttaccggttaggtacggtaccggttaaccgaccgtaacccgttcgttaccgttaccg

SEQ ID NO: 41256 - DNA, 718 bp, Homo sapiens
  misc_feature: GYAE6OF02HE2AB.19.15.B04.1.454.CMB.1.raw
  modified_base (204)..(204): a, c, t, g, unknown or other
  misc_feature (204)..(204): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccacctctcctgcagctccagccaagaactataccagacgctactacatacgcctaggtaccaggcaagaacgtccgtacggccaggtccctccgaacggtttcccacacttctatcggcgtacgggtaccccacggacgggtccacgtcggacctacgtacccgacggactaggtttcgacgggttcggacgtagggttcgggtacgtaggggaacctaacggtaccttttccgaacgttccgtacgtaacttaccgtaagtttacggaccgtaacggtaccgtagggacgtaccgttaaggtaacgttacgtttccgacgttaaggttcgttaacgtttaccgtggtaccaggtacgtaacggttacgtaggttaacgttccgtaccgttcggttcgtaccgggttacgaccgggtaacgggtaccgtaaagggtaactaaaggtaacggtaaaccggtacggttacggtaccggtaacgtaccggactaacccgttacgttcgttaccg

SEQ ID NO: 41257 - DNA, 741 bp, Homo sapiens
  misc_feature: GYAE6OF02GAN3J.19.15.B04.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgtgacgcagtctccaggcaccctgtctttgtctccgaggggaaangcccaccctctcctgcagcctccagccagaatactccagacgctaactacatacgcctaggtaccagcaagacgcctggccaggcctacccgtaggttccncatctatcgcgtcgggtccccagtaccgggccacgtcggcctacgtccaagtacgtacggttcaggtcggcgtagggtgggtcgagggacagtacctttccgactttccactacgttactacgtttacgacgtaacggtacggtacgggtacgtaccggttaagaacgttacggttttaccggaacggtttaagggttacggttttaaccgttttaccggttacggtttaccgaaggttacggttaaacggtttagggttaacgggttaaaccggtttacccgttaaccgtttccggtttaccgggtttaccggggtttaccccgggaaccggtaaccggggtaaaccggtaaacgggttaaagggaaaacgttaacgggtaaaccgttaacggttggtacggtacgtaccggtacctaacgttcgtaccgtttacg

SEQ ID NO: 41258 - DNA, 819 bp, Homo sapiens
  misc_feature: GYAE6OF02HS0A1.19.15.B04.1.454.CMB.1.raw
  modified_base (199)..(199): a, c, t, g, unknown or other
  misc_feature (199)..(199): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctccaggctcagaaccaccggagaattgtgttgacgcagtctccaggcacctgtctttgtctccaggggaaangccaccctctcctagcagcctccagccagaactactccagagcctacacatacgcctaggtaccagcagaacgccgtggccaggcctcccgacggttcctacacttctagtcgcgtcgggtccccacgacgggcctacgtggaccacgtcccgaagtacgtacggtttcacgggttcggccgtagggttcgggtttacggtagggggtaaacctacggttacccgttttacccgaaccgttccgtttaccgtaagtttaccgtaaacgttttacggaaccgtaaacgggtaaccggttacggggaaacggtacccggttaggtaaacgggttaccgtttttaccgggaccgttaacggttcggttttaaacgtttaaccgttaggtttacccggtaacggtacggttaacggtttaacggttacggggttaaacggtttacccgttaacccgtttccggtttccgggtttacccgggttttaccgggtacccgggtaaaccggggttaacccggttaaaacggggttaaacggttaaaacggttaacgggtaaaaccgttaaccggtacgggtttacggtaccggttaccggtaccctaacgttaccgttccgttaccgg

SEQ ID NO: 41259 - DNA, 684 bp, Homo sapiens
  misc_feature: GYAE6OF02F90S9.19.15.B04.1.454.CMB.1.raw
  modified_base (144)..(144): a, c, t, g, unknown or other
  misc_feature (144)..(144): n is a, c, g, or t
  modified_base (150)..(150): a, c, t, g, unknown or other
  misc_feature (150)..(150): n is a, c, g, or t
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (307)..(307): a, c, t, g, unknown or other
  misc_feature (307)..(307): n is a, c, g, or t
  modified_base (639)..(639): a, c, t, g, unknown or other
  misc_feature (639)..(639): n is a, c, g, or t
tcagtactctcgtgcacgaccggtgctcgatttagacagtatatatccgcgggggagctgctcagttaggacccagagggaaccatggaaaccccagcgcagcttctcttcctctgctactctggctcccaggctcagaaaccnccgganaaattgtgttgacgcagtctccaggccaccctgtctttgtcctcgaaggggaancgccaccctctcctgctagcctccagccagaatactccagcnctacctanatagccgtggtacccagccaagacgtcctggccaggcctcccgtaggttcccngtacctctactcggcctacgggtacccccaggtaaccgggtcccaacttgggacctaacgtcccgaacgaccgtacgggtttccaagtcggtcgtaacgggtttcgggacgtttacggggaaccttacgggttacctttacgaaacccgtttcgtaactaacgttccgtaacgttacgacgtaccggtaacgtgggtaccgtaccgtacgtaaacggtccttttcggacgttacgttaacgtttacgtaacgttcggtacgtacggtacctaggttacgtaggttacgtcctcgtacttacggtcgtccggacgtacgtaacgtacggtaanaacttacgaacgtatcggtgacgtacgacctacgtcgtcgttacg

SEQ ID NO: 41260 - DNA, 722 bp, Homo sapiens
  misc_feature: GYAE6OF02IS9I8.19.15.B04.1.454.CMB.1.raw
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaaagcgccacccttcctcctgcagctccgagccaagaaactatccaagacgcctaacgtacatacgtccgtaggtaaccagacaggaaacgccgtacggacccaggtcctacccgtacggttccctactaacgttacttagtcgccgtacggtacccacgacggtccacgtcggcacgtccgaagactaggtttacacggtcggacgtaggtcgggtacgtacggggaactaacggtacttaccgaccgtttccagtaacgttaccgtaagtttaacggacgaacggtaacgtacgggaacgtaccgtaacggtaaagtaccgtttacggtacgttaacgggttacttaacgtttaacgtacggtacaacgtacgtaagttaacgttaaggtaacgttaccgttaccttaccgtacggttaccgtacggtaaccgaacgggtaaccgtaaggtaaacgtaaacgttaaaggtaaaccggtacgtacggtacggtacgtacgtacccgaactacgtacgttacg

SEQ ID NO: 41261 - DNA, 688 bp, Homo sapiens
  misc_feature: GYAE6OF02GF5PG.19.15.B04.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (675)..(675): a, c, t, g, unknown or other
  misc_feature (675)..(675): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccgagcaccctgtctttgtctcgagggaancgccacctctcctgcagctccagccaagaatacnccagacgctactacatacgccttaggtacccagaccaagaacgccgtggccgaggccctacccgtaggttccctactatctatcgccgttcgggtccccacggtcgggcctaacggtgacctactacccgaagtaccgaggtttaccaggtcggaccgaggttcgggtacgtacggggaactacggttaaccttccaaccttcctacctaagttacgtaacgttacgtacgaacggttcggacggtacgtacctagtaagtacggttacgacgtagttacgttacttacgtacgtacgagtacgttaaggttacgtacggttaacgttcctaccgttcggttacgttaccgtaccggtaacggtaacggtaaccgtaaacggtaaagaaacgttaacggtaaaccggtacggttagtacggtacaccggaccctaacgtnttaccggttaccg

SEQ ID NO: 41262 - DNA, 758 bp, Homo sapiens
  misc_feature: GYAE6OF02H789L.19.15.B04.1.454.CMB.1.raw
  modified_base (484)..(484): a, c, t, g, unknown or other
  misc_feature (484)..(484): n is a, c, g, or t
tcagtactctcgtgcacgaccggtgctcgatttagacagtatatatccgcggggggagctgctcagttaggacccagagggaaccatggaaaccccagcgcagcttctcttcctcctgctactctggctcccaggctcagaaccacgggaataaattgtgttgacgcagtcctccaggccacctgttctttgtacctccgaaggggaagcgacctaccctctcctgcagctccacgaccaagaatactccgagacgtaccttaactaacattacgccgttacggtaaccaggacaacggaaccgtcctcgggaccacgggtccctaccccgtaggtttccctcctaacttcctaagttcgacggttccggtaccaaccggacgggaccctaacgtcgggacctacctcccgtaagtacgtaacggtttcagggtcgcggttaaggtcgggttcgtagggaacctcgtacttccactccgttacnttactagtacgacgtagtaacggtcggaacgtcgttaaggacgttagttcccggagtttaagtacgtttagttacgttcggaactaccgggtattaacgggttagttaaccggttctttaacccgaccgttttacggtaccggtttacccggtacggtaaccgggtaccgggtaacggttaaaaccgggtaagttaacggtaaacgtaaaccggttacttaccgggggtgacccttaaaccgggtcctaacggtttaccccagtttaaccccgg

SEQ ID NO: 41263 - DNA, 616 bp, Homo sapiens
  misc_feature: GYAE6OF02JA28L.19.15.B04.1.454.CMB.1.raw
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
  modified_base (366)..(366): a, c, t, g, unknown or other
  misc_feature (366)..(366): n is a, c, g, or t
  modified_base (434)..(434): a, c, t, g, unknown or other
  misc_feature (434)..(434): n is a, c, g, or t
  modified_base (462)..(462): a, c, t, g, unknown or other
  misc_feature (462)..(462): n is a, c, g, or t
  modified_base (479)..(479): a, c, t, g, unknown or other
  misc_feature (479)..(479): n is a, c, g, or t
  modified_base (514)..(514): a, c, t, g, unknown or other
  misc_feature (514)..(514): n is a, c, g, or t
  modified_base (590)..(590): a, c, t, g, unknown or other
  misc_feature (590)..(590): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctacagaaaccaccggagaaattgtgttgacgcagtctccgaggcaccctgttctttgtctccgaggggaatcgccacccttntcctagctacgctccagccagactatccagacnctacanatacgcctggaccagcaagacgcncggccaggcctccgagttcctcgattctagtgcgtacggcccaacgaggtcccctaagtcggccactacccgataccgtagtccgngtgggacagggttggccgtagggactaacgtcttacgactcgtacctatacaactacggacaacggtntacgggtacgtctaaggagtctttcggntaagttgttacttaacngtaccgtagctaggtactaggtcttaccgacgttntccggttgtaccgggaccgtaacggaccgttaaggaacgttaaacgaggtaaacccgtaggttacgaccgggttanacccgaacgttaccgtacttacgtcg

SEQ ID NO: 41264 - DNA, 858 bp, Homo sapiens
  misc_feature: GYAE6OF02HH0V6.19.15.B04.1.454.CMB.1.raw
  modified_base (853)..(853): a, c, t, g, unknown or other
  misc_feature (853)..(853): n is a, c, g, or t
tcagtactctcgtgcacgaccggtgctcgatttagacagtatatatccgcgggggagctgctcagttaggacccagagggaaccatcggaaaccccagcgcagcttctcttcctcctgctactctggcctcccaggctacgaacgaaacccgaccgggagtaaatttggtagttggaccgcagtcctccgaggcctacccgtgttctttcgtcctacggaaggggaacgcgccctaccctcctcgtacgcgaccgtccaccgtacgaccgtaagaaacgtactacccgaagaccgtacctaacgtacagtacgtcgtacgtacagacgacgacgtcgtacggaccgacgtcctcccgtacggttcctactacgttcgttacgtcgggtacccgttcccgggacccgtaacgggcggaacccttcgggaccggtaaccttaacccgtaccccggaaagggttcccggtaacggtttaacccgtaggggttaaccgggacgggttaggggtttaccggggtcgtaacggggaacctaaccgggttttaccgtaccctaccgtttaccgaccgttaaccttacggttaaacgtacgtaacggtacggtaccggttagggtacccgttacgttaaacggtacggttaaccggttaaccttacgggttaagttaccgtttaaccgtacgttacgtacgtaaggtacggtttaacggtacggtaaccggttacgttaacccttaccggttacgggttcgtaacccgggttaaccgacgggggttaaccacgggttaaacgtaacggtaacggtacgtaacgtcgggtaacggtcggactacggtaacctctaccggttntcccg

SEQ ID NO: 41265 - DNA, 678 bp, Homo sapiens
  misc_feature: GYAE6OF02H55J9.19.15.B04.1.454.CMB.1.raw
  modified_base (219)..(219): a, c, t, g, unknown or other
  misc_feature (219)..(219): n is a, c, g, or t
  modified_base (298)..(298): a, c, t, g, unknown or other
  misc_feature (298)..(298): n is a, c, g, or t
  modified_base (410)..(410): a, c, t, g, unknown or other
  misc_feature (410)..(410): n is a, c, g, or t
  modified_base (568)..(568): a, c, t, g, unknown or other
  misc_feature (568)..(568): n is a, c, g, or t
  modified_base (587)..(587): a, c, t, g, unknown or other
  misc_feature (587)..(587): n is a, c, g, or t
tcagtactctcgtgcacgaccggtgctcgatttagacagtatatatccgcgggggagctgctcagttaggacccagagggaaccatggaaaccccagcgcagcttctcttcctcctgctactctggctcccaggctcacgaaaccaccggagaaattgtgttgacgcagtctccaggccaccctgttctttgtctccgaaggggaagcgcctacccgtntcccgtgcagctccagccagtaactatccgagagactactacatacgcctaggtaccagtacaggtaacgcctggaccnggcctacccgaggtttccactattacctatcggaccgttacgggtaccccaacgacggggtcccaaacggttgggaccctaagtccccgaaaggtacctaagggtttacccngggtttacggaccttaagggtcggggttacgacgggtaacctaagtaacccgtttcaaccttcgtacctaagtactaattcgacaagtaacgtggaacgcgttagaacgtgtttcgaactaaggtttctaacgttagtcgactaggactaggttaacnggtaacgttccaaccgttntacggtccgttagaaccggaagaccgtaaagggtactaaaacgttagggaaaccttacggtggtcgtaccgtacaccaacgttctacgttc

SEQ ID NO: 41266 - DNA, 884 bp, Homo sapiens
  misc_feature: GYAE6OF02FZFUB.19.15.B04.1.454.CMB.1.raw
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
tcagtactctcgtgcacgaccggtgctcgatttagacagtatatatccgcgggggagctgctcagttaggacccagaggaaccatcggaaaccccagcgcagcttctcttcctcctgctactctggctcccaggctacagaaaccaccggagaaattgtgttgacgcagtctccaggcacctgtctttcgctccaagggaanacncccacctctcctgcagcctaccacggaccaagaacttactaccgagacgtaccttaacctactaacgttacggacccgttacggtaacccagaccgaaaggtaaaccgtcccggttacgggaccccgtaacgggtccccttaacccccggtaagggttttacccctactaaccgtttaccgttaacgttccggtacccgttaccggggtttacccccaacgggtaaccggggtaccctaaccggttacgggacctaacccgttaccccgaaacggttacccgttaagggtttaccgaagggttaccgggtaaccggtagggtttacccgggggttacgaccgggggtaaacttaacggttaccctttaccgaaaccgtttccgtaacaacgtttaccgtaagttaccggacgtaaacgtccggttagggaccgttacgtaacggtaaacgttacgtttcgacgtaagtttagtttaaccttacgtgtaacctagggtactaacggttagttaaccggttaacgttcctaacgttccgtttacgggtacccgtttaacgggaacccggttaacgggtaaccgttaaaagggttaacgtaaaacgttaaccgggaaaaccgttacggttacggttaccgtacggtacccgtaaccgtaccgttaccgttcggtttaacccg

SEQ ID NO: 41267 - DNA, 374 bp, Homo sapiens
  misc_feature: GYAE6OF01ALXIP.9.13.B02.1.454.CMB.1.raw
  modified_base (320)..(321): a, c, t, g, unknown or other
  misc_feature (320)..(321): n is a, c, g, or t
  modified_base (323)..(323): a, c, t, g, unknown or other
  misc_feature (323)..(323): n is a, c, g, or t
  modified_base (326)..(374): a, c, t, g, unknown or other
  misc_feature (326)..(374): n is a, c, g, or t
tcagtgatacgtctcacgaccggtgctcgatttagtctagcgactttgggtggggggtgagggatgagaaccttatgaacattctgtaggggccacctgtctcctccaactctgccctccctcaccatctctggactgcaggctgacgacgaggtctgactactactgtcagtcttatgacaccaccaatcgtttgggtgttcggcggagggaccaagttgaccgtccgtcggtcagcccgaaggctgccccctggtcacttctcgttcccaccctcctcagaccgtatccacttgagcgggctggcaaggcgcatagcnncngcnnnnnnnnnnnnnnnnnnnnnnnnnnnnnnnnnnnnnnnnnnnnnnnnn

SEQ ID NO: 41268 - DNA, 310 bp, Homo sapiens
  misc_feature: GYAE6OF01DEIY7.9.13.B02.1.454.CMB.1.raw
  modified_base (300)..(300): a, c, t, g, unknown or other
  misc_feature (300)..(300): n is a, c, g, or t
  modified_base (306)..(310): a, c, t, g, unknown or other
  misc_feature (306)..(310): n is a, c, g, or t
tcagtgatacgtctcacgaccggtgctcgatttagtctagcgactttgggtgggggtgagggatgagaacctatgaacattctgtaggggccactgtctcctccaactctgcctccctcaccatctctggactgcaggctgacgacgaggctgactactactgtcagtcttatgacaccaccaatctttgggtgttcggcggagggaccaagttgaccgtcctcggtcagcccaaggctcgcccctcggtcactctgttcccgcctcctcagacgtatcactgagcgggctggcaaggcncatagnnnnn

SEQ ID NO: 41269 - DNA, 352 bp, Homo sapiens
  misc_feature: GYAE6OF01DJ6LP.9.13.B02.1.454.CMB.1.raw
  modified_base (279)..(279): a, c, t, g, unknown or other
  misc_feature (279)..(279): n is a, c, g, or t
  modified_base (336)..(352): a, c, t, g, unknown or other
  misc_feature (336)..(352): n is a, c, g, or t
tcagtgatacgtctcacgaccggtgctcgatttagtctagcgactttggggtgggggggtgagggatgagaacctatgaacattctgtaggggccactgtctcctccaactctgcctccctcaccatctctggactgcaggctggacgacgagactcgactactactgtactagtcttatcgaccaccacctattcgtttgggtcggtcggcggaggactagtcgtaccgtcgtcgtcacgccgagcctccgcccctcggtctacctcgtccgtccccnccctccacgtacgtacgtactcgacgtcggcggccggcgacggacgacggcgatagnnnnnnnnnnnnnnnnn

SEQ ID NO: 41270 - DNA, 307 bp, Homo sapiens
  misc_feature: GYAE6OF02HLM80.9.13.B02.1.454.CMB.1.raw
  modified_base (306)..(307): a, c, t, g, unknown or other
  misc_feature (306)..(307): n is a, c, g, or t
tcagtgatacgtctcacgaccggtgctcgatttagtctagcgactttgggtgggggtgagggatgagaacctatgaacattctgtagggccactgtctcctccaactctgcctccctcaccatctctggactgcaggctgacgacgaggctgactactactgtcagtcttatgacaccaccaatctttgggtgttcggcggagggaccaagttgaccgtcctcggtcagcccaaggctgccccctcggtcactctgttcccgccctcctcagacgtatcactgagcgggctggcaaggcgcatagnn

SEQ ID NO: 41271 - DNA, 313 bp, Homo sapiens
  misc_feature: GYAE6OF02H4Z5I.9.13.B02.1.454.CMB.1.raw
  modified_base (303)..(303): a, c, t, g, unknown or other
  misc_feature (303)..(303): n is a, c, g, or t
  modified_base (309)..(313): a, c, t, g, unknown or other
  misc_feature (309)..(313): n is a, c, g, or t
tcagtgatacgtctcacgaccggtgctcgatttagtctagcgactttgggtgggggtgagggatgagaacctatgaacattctgtaggggccactgtctcctccaactctgcctccctcaccatctctggactgcaggctgacgacgaggctgactactactgtcagtcttatgacaccaccaatctttgggtgttcggcggagggaccaagttgaccgtcctcggtcagcccaaggctgccccctcggtcactctcgttcccgcccttcctcagacgtatcactgagcgggctggcaaggcncatagnnnnn

SEQ ID NO: 41272 - DNA, 323 bp, Homo sapiens
  misc_feature: GYAE6OF02G1UA2.9.13.B02.1.454.CMB.1.raw
  modified_base (295)..(295): a, c, t, g, unknown or other
  misc_feature (295)..(295): n is a, c, g, or t
  modified_base (312)..(323): a, c, t, g, unknown or other
  misc_feature (312)..(323): n is a, c, g, or t
tcagtgatacgtctcacgaccggtgctcgatttagtctagcgactttgggtgggggggtgagggatgagaacctatgaacattctgtaggggccactgtctcctccaactctgcctccctcaccatctctggactgcaggctgacgacgaggctgactactactgtcagtcttatgacaccaccaatctttgggtgttcggcggagggaccaagttgaccgtcctcggtcagcccaaggctcgccccctcggtcactctgttccccaccctcctcagacgtatcactgagcgggntggcaaggcacgatagnnnnnnnnnnnn

SEQ ID NO: 41273 - DNA, 180 bp, Homo sapiens
  misc_feature: GYAE6OF01B1QKN.29.50.E06.1.454.CMB.1.raw
  modified_base (178)..(180): a, c, t, g, unknown or other
  misc_feature (178)..(180): n is a, c, g, or t
tcagatagagtactcacgaccggtgctcgatttagatctactgacaacacacaagggcccatcggtcttcccctggcgccctgctccaggagcacctccgggagcacagcggccctgggctgcctggtcaaggactacttccctcgtctctactgagcgggctggcaaggcgcatagnnn

SEQ ID NO: 41274 - DNA, 178 bp, Homo sapiens
  misc_feature: GYAE6OF01BB61F.29.50.E06.1.454.CMB.1.raw
  modified_base (178)..(178): a, c, t, g, unknown or other
  misc_feature (178)..(178): n is a, c, g, or t
tcagatagagtactcacgaccggtgctcgatttagatctactgacaacacacaagggcccatcggtcttcccctggcgccctgctccaggagcacctccgagagcacagcggccctgggctgcctggtcaaggactacttccctcgtctctactgagcgggctggcaaggcgcatagn

SEQ ID NO: 41275 - DNA, 179 bp, Homo sapiens
  misc_feature: GYAE6OF01CD83S.29.50.E06.1.454.CMB.1.raw
  modified_base (178)..(179): a, c, t, g, unknown or other
  misc_feature (178)..(179): n is a, c, g, or t
tcagatagagtactcacgaccggtgctcgatttagatctactgacaacacacaagggcccatcggtcttcccctggcgccctgctccaggagcacctccgagagcacagcggccctgggctgcctggtcaaggactacttccctcgtctctactgagcgggctggcaaggcgcatagnn

SEQ ID NO: 41276 - DNA, 179 bp, Homo sapiens; identical to SEQ ID NO: 41275
  misc_feature: GYAE6OF01EYS0S.29.50.E06.1.454.CMB.1.raw
  modified_base (178)..(179): a, c, t, g, unknown or other
  misc_feature (178)..(179): n is a, c, g, or t

SEQ ID NO: 41277 - DNA, 178 bp, Homo sapiens; identical to SEQ ID NO: 41274
  misc_feature: GYAE6OF01DLFXE.29.50.E06.1.454.CMB.1.raw
  modified_base (178)..(178): a, c, t, g, unknown or other
  misc_feature (178)..(178): n is a, c, g, or t

SEQ ID NO: 41278 - DNA, 179 bp, Homo sapiens; identical to SEQ ID NO: 41275
  misc_feature: GYAE6OF01BH0YL.29.50.E06.1.454.CMB.1.raw
  modified_base (178)..(179): a, c, t, g, unknown or other
  misc_feature (178)..(179): n is a, c, g, or t

SEQ ID NO: 41279 - DNA, 181 bp, Homo sapiens
  misc_feature: GYAE6OF01EB3ZP.29.50.E06.1.454.CMB.1.raw
  modified_base (178)..(181): a, c, t, g, unknown or other
  misc_feature (178)..(181): n is a, c, g, or t
tcagatagagtactcacgaccggtgctcgatttagatctactgacaacacacaagggcccatcggtcttcccctggcgccctgctccaggagcacctccgagagcacagcggccctgggctgcctggtcaaggactacttccctcgtctctactgagcgggctggcaaggcgcatagnnnn

SEQ ID NO: 41280 - DNA, 193 bp, Homo sapiens
  misc_feature: GYAE6OF01CN3R0.29.50.E06.1.454.CMB.1.raw
  modified_base (144)..(144): a, c, t, g, unknown or other
  misc_feature (144)..(144): n is a, c, g, or t
  modified_base (177)..(193): a, c, t, g, unknown or other
  misc_feature (177)..(193): n is a, c, g, or t
tcagatagagtactcacgaccggtgctcgatttagatctactgacaacacacaagggcccatcggtcttcccctggcgccctgctccaggagcacctccgagagcacagcggccctgggctggcctggtcaaggctacttcccngtctctactgagcgggctggcaaggcgcatagnnnnnnnnnnnnnnnnn

SEQ ID NO: 41281 - DNA, 190 bp, Homo sapiens
  misc_feature: GYAE6OF01BUA1Z.29.50.E06.1.454.CMB.1.raw
  modified_base (177)..(190): a, c, t, g, unknown or other
  misc_feature (177)..(190): n is a, c, g, or t
tcagatagagtactcacgaccggtgctcgatttagatctactgacaacacacaagggcccatcggtcttcccctggcgccctgctccaggagcacctccgagagcacagcggcctgggctgcctggtcaaggactacttccctcgtctctactgagcgggctggcaaggcgcatagnnnnnnnnnnnnnn

SEQ ID NO: 41282 - DNA, 182 bp, Homo sapiens
  misc_feature: GYAE6OF01ALOGB.29.50.E06.1.454.CMB.1.raw
  modified_base (176)..(182): a, c, t, g, unknown or other
  misc_feature (176)..(182): n is a, c, g, or t
tcagatagagtactcacgaccggtgctcgatttagatctactgacaacacacaagggcccatcggtcttcccctggcgccctgctccaggagcacctccgagagcacagcggccctgggctgcctggtcaaggactacttcctgtctctactgagcgggctggcaaggcgcatagnnnnnnn

SEQ ID NO: 41283 - DNA, 180 bp, Homo sapiens
  misc_feature: GYAE6OF01AQU7X.29.50.E06.1.454.CMB.1.raw
  modified_base (178)..(180): a, c, t, g, unknown or other
  misc_feature (178)..(180): n is a, c, g, or t
tcagatagagtactcacgaccggtgctcgatttagatctactgacaacacacaagggcccatcggtcttcccctggcgccctgctccaggagcacctccgagagcacagcggccctgggctgcctggtcaaggactacttccctcgtctctactgagcgggctggcaaggcgcatagnnn

SEQ ID NO: 41284 - DNA, 179 bp, Homo sapiens; identical to SEQ ID NO: 41275
  misc_feature: GYAE6OF02H6EF4.29.50.E06.1.454.CMB.1.raw
  modified_base (178)..(179): a, c, t, g, unknown or other
  misc_feature (178)..(179): n is a, c, g, or t

SEQ ID NO: 41285 - DNA, 177 bp, Homo sapiens
  misc_feature: GYAE6OF02HVWW0.29.50.E06.1.454.CMB.1.raw
  modified_base (177)..(177): a, c, t, g, unknown or other
  misc_feature (177)..(177): n is a, c, g, or t
tcagatagagtactcacgaccggtgctcgatttagatctactgacaacacacaagggcccatcggtcttccctggcgccctgctccaggagcacctccgagagcacagcggccctgggctgcctggtcaaggactacttccctcgtctctactgagcgggctggcaaggcgcatagn

SEQ ID NO: 41286 - DNA, 179 bp, Homo sapiens; identical to SEQ ID NO: 41275
  misc_feature: GYAE6OF02IF65P.29.50.E06.1.454.CMB.1.raw
  modified_base (178)..(179): a, c, t, g, unknown or other
  misc_feature (178)..(179): n is a, c, g, or t

SEQ ID NO: 41287 - DNA, 178 bp, Homo sapiens; identical to SEQ ID NO: 41274
  misc_feature: GYAE6OF02HLIF7.29.50.E06.1.454.CMB.1.raw
  modified_base (178)..(178): a, c, t, g, unknown or other
  misc_feature (178)..(178): n is a, c, g, or t

SEQ ID NO: 41288 - DNA, 182 bp, Homo sapiens
  misc_feature: GYAE6OF02JCDFY.29.50.E06.1.454.CMB.1.raw
  modified_base (178)..(182): a, c, t, g, unknown or other
  misc_feature (178)..(182): n is a, c, g, or t
tcagatagagtactcacgaccggtgctcgatttagatctactgacaacacacaagggcccatcggtcttcccctggcgccctgctccaggagcacctccgagagcacagcggccctgggctgcctggtcaaggactacttccctcgtctctactgagcgggctggcaaggcgcatagnnnnn

SEQ ID NO: 41289 - DNA, 181 bp, Homo sapiens
  misc_feature: GYAE6OF02HH3JO.29.50.E06.1.454.CMB.1.raw
  modified_base (179)..(181): a, c, t, g, unknown or other
  misc_feature (179)..(181): n is a, c, g, or t
tcagatagagtactcacgaccggtgctcgatttagatctactgacaacacacaagggcccatcggtcttccccctggcgccctgctccaggagcacctccgagagcacagcggccctgggctgcctggtcaaggactacttccctcgtctctactgagcgggctggcaaggcgcatagnnn

SEQ ID NO: 41290 - DNA, 181 bp, Homo sapiens; identical to SEQ ID NO: 41279
  misc_feature: GYAE6OF02GO12F.29.50.E06.1.454.CMB.1.raw
  modified_base (178)..(181): a, c, t, g, unknown or other
  misc_feature (178)..(181): n is a, c, g, or t

SEQ ID NO: 41291 - DNA, 540 bp, Homo sapiens
  misc_feature: GYAE6OF01A6F8X.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagtgcctggagtggattggggaaatcaatcatggtggatacaccaactacaacccgtcctacaagagccgagtcaccatcttagtgacacggacgaagaaccagttctccctagaaactgaccgctgtcgaccgccgcggacacggctgtgtattactgtgcgagacgaagtgggcgggtggctacgacgttgtacgtttggggccagggaaacctggtccaccgtctccccagtccttccaccgacggcccagtccggtccttcccccgg

SEQ ID NO: 41292 - DNA, 587 bp, Homo sapiens
  misc_feature: GYAE6OF01CRYC4.48.4.A04.1.454.CMB.1.raw
  modified_base (382)..(382): a, c, t, g, unknown or other
  misc_feature (382)..(382): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtcccctcacctgcgctgtggctggtgagtccttcagtgcttatcactggacctggatccgcagtccccagcgaagggcctggagtggattggggaaatcaatcatggtggatacaccaactacaacccgtccctacaagacgccgagtcaccatcttaagtggacacggcgaaagaaccagttccnccctgaaactgaccgctgtcgaccgccgcggacacggctgtgtatactgtgcgagacgaagtgggcgggtggtctacgacgttgtacgttttggggccgtaacgggtaaaccgtgggtccgtacccggttccctcccccgtacggtcccttaccccgaacccgtaaccgggacccctagtcccggttccgttccccccgtccggg

SEQ ID NO: 41293 - DNA, 533 bp, Homo sapiens
  misc_feature: GYAE6OF01DOJGR.48.4.A04.1.454.CMB.1.raw
  modified_base (499)..(499): a, c, t, g, unknown or other
  misc_feature (499)..(499): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattgggggaaatcaatcatggtggatacaccaactacaacccgtccctcaagagccgagtcaccatcttagtggacacggcgaagaaccagttctccctagaaactgaccgctgtcgaccgccgcggacacggctgtgtatactgtgcgagacgaagtgggcgggtggcgtacgacttgtacgtttggggccagggaacctggtcaccgtctcccngcctccaccacggcccagtccgtctccccgtcgg

SEQ ID NO: 41294 - DNA, 574 bp, Homo sapiens
  misc_feature: GYAE6OF01BVH8D.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtgatacaccaactacaacccgtccctacaagagccgagtcaaccatcttagtggacacggacgaaacgaaccagttcctccctagaaacctcgaccgctgtgacccgccgcggacacggctgtgtattactgtgcgagacgaagtgggcgggtggctacgtacgttgtacgttttgggcctaagggaaaccgtggtccgacccgttccgtccccgacgccttacccgacccgaacgggcccccaagttcccggtcccttcccccgtccggg

SEQ ID NO: 41295 - DNA, 602 bp, Homo sapiens
  misc_feature: GYAE6OF01ELAR9.48.4.A04.1.454.CMB.1.raw
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggactccgccacgtccccagcggaaggcctggagtggtagttggggaaactnaatcagtggnggatacaccaactaccaacccgtccctanaacgacgccgagtaccaaccatcttagtacggaccacggacgaaacgaaccagttcctacccgtagaactcgaccgctgtacgacccgccgcggacacggctgtgtattacgtgtgcgagacgaagtgggcgggtgacgtacgacttcggtacgtttcggggaccgagggtaaaccgtggtaccgtaccggttcctacccgtacgtcccttacccgaaccgtaacgggacccctaggtcccggttcccgttcccccgtccggg

SEQ ID NO: 41296 - DNA, 671 bp, Homo sapiens
  misc_feature: GYAE6OF01DTQKJ.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtgaggcgcaggactgttgaagccttcggagacccctgtcccctcacctgcgctgtggctggtgagtccttcagtgcttatcactggacctggactccgccacgtccccagcgaagggcctggagtggagttaggggaaatcaatcagtggtggactacaccaactaccaaccccgtcctacaagacgccgagtaccacctatcttagtcggacacgggacgaagaacctacgttacctacccgtagaaacgtcgaacccgtcgtacggtacgacccggcccggaccgggaccgaccgggtcttcggttgtaatttacgtcggtggacggaagaacggaaggtcggggtacggggtcgggtcgtaccggtacgttacggtacggttttacggggacccgtaacggggtaaacccgttcgggtacccgaacccggttcccgtacccccgacgtcccttacccgaacccggtaaccgggcccctaacggttcccggttccccgttaccccccgg

SEQ ID NO: 41297 - DNA, 574 bp, Homo sapiens
  misc_feature: GYAE6OF01DN9EN.48.4.A04.1.454.CMB.1.raw
  modified_base (167)..(167): a, c, t, g, unknown or other
  misc_feature (167)..(167): n is a, c, g, or t
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (333)..(333): a, c, t, g, unknown or other
  misc_feature (333)..(333): n is a, c, g, or t
  modified_base (447)..(447): a, c, t, g, unknown or other
  misc_feature (447)..(447): n is a, c, g, or t
tcagagtatacatacacgaccggtgctcgatttagagtagtgatcagggggctttctgagagtcatggatctcctgcacaagaacatgagacacctgtggttcttcctcctcctggtggcagttcccagatgggtcctgtctcaggtgcagttacagcagtggggcncaggactgttgaagccttcggganaccctgtccctnacctgcgctgtggctggtgagtccttnaggtnacttatcatgacctggactccgccagtcccagcgaaggcctggagtggagttggggaaatcgaatcagtggtgactacaccaactaccaaccgtccanaacgagccgtagtacacctatcttaagcggacacgacgaagaacctacgttactaccctagaaacctcgaaccgtctcgtacgaccgccgcggaactcggctcgtgtacttacngtgcgagacgaagtgggacggtgactacgacgttgtacgtttggggaccagggtaacctcggtaccaccgttcctccccagtcccttacccgaaccgaacgggcccctagtccggtcccttccccgg

SEQ ID NO: 41298 - DNA, 541 bp, Homo sapiens
  misc_feature: GYAE6OF01EQJOJ.48.4.A04.1.454.CMB.1.raw
  modified_base (167)..(167): a, c, t, g, unknown or other
  misc_feature (167)..(167): n is a, c, g, or t
  modified_base (435)..(435): a, c, t, g, unknown or other
  misc_feature (435)..(435): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcncaggactgttgaagccttcggagaccctgtccctcacctgcgctgtggctggtgagtccttcagtgcttatcactggacctggatccgccagtccccagcgaagggcctggagtggattgaggaatcaatcatggtggatacaccaactacaaccccgtcctcaagacgccgagtcaccatctagtcggacacggcgaaagaacctagttctccctagaaactgaccgctgtcgaccgccgcggacacggctgtgtagttactgtcgngagacgaagtcgggcgggtggctagcgttagacgtttgggccgagggtaacctggtccacgtcctcccagtcctaccgacgacggcctacgtccgtccttcccccg

SEQ ID NO: 41299 - DNA, 572 bp, Homo sapiens
  misc_feature: GYAE6OF01AVQM1.48.4.A04.1.454.CMB.1.raw
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggactccgccagtccccagcgaaggcctggagtggagttggggaaatcaatcagtggtaggatacaccaactaccgaacccgtcctacaagacgccgagtaccaccatactaggtcgaacacggacgaaagaacctagttacctaccctagaactcgaccgcgtcgtcgaccgccgcggacgacggctgtgtatacgtgtcgcgagagagngggtcggngcgtacgcgttgtacgtttgggaccgtaagggaccgtggtccgaccgtcctacccgcgtccttaccgaccgtacggaccctagtcccggtcccgttccccgtcgg

SEQ ID NO: 41300 - DNA, 545 bp, Homo sapiens
  misc_feature: GYAE6OF01APJFY.48.4.A04.1.454.CMB.1.raw
  modified_base (426)..(426): a, c, t, g, unknown or other
  misc_feature (426)..(426): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattgggggaaatcaatcatggtggatacaccaactacaacccgtccctacaagagccgagtcaccatcttagtggacacggacgaagaaccagttctcctagaaactgaccgctgtgaccgccgcgacacggctgtgtatacngtcgcgagacgaagtgggcgggtggctacgacttggacgtttggggcctagggaaacctggtaccgaccgtctccccgagtcctaccaccgacggcccagtccgtccgttccccgtcgg

SEQ ID NO: 41301 - DNA, 541 bp, Homo sapiens
  misc_feature: GYAE6OF01BSPQA.48.4.A04.1.454.CMB.1.raw
  modified_base (501)..(501): a, c, t, g, unknown or other
  misc_feature (501)..(501): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtgatacaccaactacaacccgtcctcaagacgccgagtcaccatcttagtggacacggacgaaagaaccagttctccctagaactgaccgctcgtgacccgcgcgacacggctgtgtatactgtgcgagacgaagtgggcggtggctacgtgttgtacgtttgggccgagggaaacctggtaccgaccgtcctcccgngccttaccaccgaacgggcccatccggtcctccccgtcgg

SEQ ID NO: 41302 - DNA, 845 bp, Homo sapiens
  misc_feature: GYAE6OF01COX10.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcaggactgttagaacgtccgttcggacgaccctcgtccctcacctgcgctggtggctgggtgtacgttccttcgagttcgcttatcacgtcggaccgtggactccgaccacgtaccccgaggaccggaacgggtccgtagggtaggtgggtaacggttagggggaaactacgtaagtacgtagtagggtacggaactaaccgtaacctaaaccgtaacccgaacccccgtaccccgtaaccgaaacgggaccgaacccggtacgtaccgaacccgtaacttaccggtttaacggtaccggggaaccgaaccgggaaaccgtaaaaccggtaaacccgttacggtttaccctaccccgttaacgtaaacccgtaccgtaacccggtacggttaccggtaacccgggaccccggcccggtaaccgggaaccgtaccgggtaccgtaggttaacgttacgttacgtcggttacggacggaacgggaacggttaacgggtcggggggtaccggttacgggtaccgttaacggttacggtttacggtaccgggttttcgggaaccgggtaaccggtaaccggtcggttacccgtacccgtacccgtccccgtaccggtcccgtaccccaacccggtaaccggtaccctaccggttcccggttcccgttcccccggtcccggg

SEQ ID NO: 41303 - DNA, 551 bp, Homo sapiens
  misc_feature: GYAE6OF01E3TMW.48.4.A04.1.454.CMB.1.raw
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggactccgccacgtccccagcgaagggcctggagtggattggggaaatcaatcatggtggatacaccaactacaacccgtcctcaagagccgagtcaccatcttagtggacacggacgaaagaaccagttctccctagaaactcgaccgctgtcgacccgccgcggacacggctgtgtattactgtgcgagacgaaggtgggcgggtggctacgacgttgtacgtttcgggccagggaaacctgggtaccaccgtcnccccgngccttcccaccgacggcccagtccggtccttccccgtcgg

SEQ ID NO: 41304 - DNA, 625 bp, Homo sapiens
  misc_feature: GYAE6OF01BYERZ.48.4.A04.1.454.CMB.1.raw
  modified_base (438)..(438): a, c, t, g, unknown or other
  misc_feature (438)..(438): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagttccttcagtgcttatcacgtggacctggactccgccacgtccccaggcgaagggcctgggagtggagttggggaaatcaatcagtggtgatacaccaactaccaacccgtccacgaacgacgccgagtccaccactctagtcggacgaacggacgaaacgaacctagttcctacccgtagaaactcgaccgctacgcgacccgccgacggaccncggtcgtgttgtacttacgtgtcgcggagacggaagtggggcgggtgacgttacgtacgttcgtacgtttcggggacctaacgggtaaacccgtggtacccgtacccggttcctaccccgtcgtacccgttacccgaaccgaacccgggtacccctacgttcccggttccccttcccccggtccggg

SEQ ID NO: 41305 - DNA, 545 bp, Homo sapiens
  misc_feature: GYAE6OF01C1HDX.48.4.A04.1.454.CMB.1.raw
  modified_base (501)..(501): a, c, t, g, unknown or other
  misc_feature (501)..(501): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaaggcctggagtggattgggggaaatcaatcatggtggatacaccaactacaacccgtccctcaagacgccgagtccaccatcttagtggacacggcgaaagaaccagttcctccctgaaactcgaccgctgcgaccgccgcggacacggctgtgtatactgtgcgagacgaagtggggcggtggctacgacgttgacgtttgggccagggaacctggtccgccgtctccccngccctaccgaccgacgggccctagtccggtccttcccccgtcgg

SEQ ID NO: 41306 - DNA, 721 bp, Homo sapiens
  misc_feature: GYAE6OF01CC6FZ.48.4.A04.1.454.CMB.1.raw
  modified_base (166)..(166): a, c, t, g, unknown or other
  misc_feature (166)..(166): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtgggcncaggactgttgaagcccttcggacgaccctgtcccctcacctgccgctggtggctggtgagttccttcgagtgtcttatcacgtggacctggactccgccacgtcccgagacggaacgggcctggaggtaggagttaggggaaatcaatcagtggtagactaaccgaacctaactacccgtaaccccgtcctacgaacgaccgaccggtaacgtaccaaccctaagttaccgtaacggtaccgggaaacgaccgggtaaccgaaaacggtaacctacgttacccgtacccgtacgtaaaccgtccgaaccgtcgtacggtaccgacccggccggtaccggaacgtaccggcttaggtacgttacgtacgtggtacggacggaacgacggtaaggtcggggcggtacggtaccgttaccggtacgttcggtacggtttcgggaccgtaacgggtaaacccgttggacccgtacccgtcccgtaccccgtacggttccccgtaacccgaccggtaaccggtaccctacgttcccggttccccttccccggtacccgg

SEQ ID NO: 41307 - DNA, 562 bp, Homo sapiens
  misc_feature: GYAE6OF01EVANW.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattgggggaaatcaatcatggtggatacaccaactacaacccgtccctcaagagccgagtcaccatcttagtggacacggcgaagaaccagttctccctagaaactgaccgctgtcgacccgccgcggacacggctgtcgtattactgtgcgagacgaagtggggcggtgggctacggacttggacgttttggggcctaaggggaaacctgggtaccgaccgtcctccccgagcccttcccgacccgaacgggccccatccggtccttcccccgtcggg

SEQ ID NO: 41308 - DNA, 596 bp, Homo sapiens
  misc_feature: GYAE6OF01EG5SU.48.4.A04.1.454.CMB.1.raw
  modified_base (361)..(361): a, c, t, g, unknown or other
  misc_feature (361)..(361): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagacccctgtcccctcacctgcgctgtggctggtgagtccttcagtgcttatcactggacctggatccgccagtcccccagcgaagggcctggagtggagttggggaaatcaatcatggtggatacaccaactaccaacccgtccctacaagacgccgagtcaccatcttagnggacacggacgaagaaccagttcctaccctagaaactcgaccgctgtcgacccgccgcggacacggctgtgtattactgtgcgagacgaagtggggcgggtggcctacgacttggtacgtttggggccgaacgggtaaaccgtcggttaccgacccggttcctcccccgtacgtcccttaccccgaacccgaaccggggtccccacgttcccggttcccgttccccccgtccggg

SEQ ID NO: 41309 - DNA, 647 bp, Homo sapiens
  misc_feature: GYAE6OF01CUHHT.48.4.A04.1.454.CMB.1.raw
  modified_base (167)..(167): a, c, t, g, unknown or other
  misc_feature (167)..(167): n is a, c, g, or t
  modified_base (241)..(241): a, c, t, g, unknown or other
  misc_feature (241)..(241): n is a, c, g, or t
  modified_base (403)..(403): a, c, t, g, unknown or other
  misc_feature (403)..(403): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcncaggactgttgaagccttcggagaccctgtccctcacctgcgctggtggctggtgacgttccttcagtgcttancactggacctggactccgccagtcccagcggaaggcctggagtggacgttagggggaaatcaatcagtggtaggatacaccaacctaaccaaccccgtcctacaagtacgccgacgtcacctacttctaaggtcggacacggacgaaacgaacctagttccnccgtagtaacctcgaccgtctcgtacgacccgccgcggtaccacggcgttacgtgtactacgtggtacgcggagacggaagtggggccgggtgtaccgtacgtacgtttcggtacggtttcggggaccggaacggtaaccggttcggtacccgacccggttccctcccccgagtccccgttacccgaacccggtaacccgggaccccttaacgttccccggttccccgttcccccggtcccggg

SEQ ID NO: 41310 - DNA, 714 bp, Homo sapiens
  misc_feature: GYAE6OF01C0OXG.48.4.A04.1.454.CMB.1.raw
  modified_base (246)..(246): a, c, t, g, unknown or other
  misc_feature (246)..(246): n is a, c, g, or t
tcagagtatacatacacgaccggtgctcgatttagagtagtgatcagggggctttctgagagtcatggacctcctgcacaagaacatgagacacctgtggttcttcctcctcctggtggcagttccagatgggtcctgtctcaggtgcagttacagcaggtggggcgcagggactggttgaagccctttcggacgaccctgtccctcacctgcgctggtggctggtgacgtccttcagtgtcttancacgtggacctggactccgccacgtcccaggcggaacggccgtgggagtggtagttaggggaaactcgaatcgagtggtaggaataccgaacctaaaccgtaacccaaccccgtccctaacgaacggacgacccgtaacgtccaacctacttcgttaacggtacggaaccgtaacggacgaaacgaaccgtacgttcctaccgtagaaacctcgaaccgtcgtcggtcgacccggcggaccggacgacggctggttcgtaacttcgtggtgaccggaaggtacggaagggtcgggggacgggtcggtaccgttacggtacggtttacggttacgggttttcggggaaccggttaacggggaaaccgttcggtacccgtcccggtccctaccccggtacgtacccgttaacccgaaccgggtaccgggaccccttaccggttcccggttcccccgtttccccggccggg

SEQ ID NO: 41311 - DNA, 636 bp, Homo sapiens
  misc_feature: GYAE6OF01EJJKP.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccacgtccccagcgaaggcctggagtggagttggggaaatcaatcagtggtgatacaccaactacaacccgtcctacaagacgccgagtcaccatctagtggacacggacgaaacgaaccagttcctaccctagaaactcgaccgctcgtcgacccgccgcggacgacggctgtgtattacgtgtgcgagacgaagtcgggcgggtggcgtacgtacgttgtaccggttttcggggaccgtaacggggtaaacccgttcgggtacccgtaccccggttcccgttacccccgtacggtaccccgtttaccccgaaaccccggtaaccggggtaccccctaacggtttccccgggttaccccgttcccccccgttccccgggg

SEQ ID NO: 41312 - DNA, 679 bp, Homo sapiens
  misc_feature: GYAE6OF01BOPFB.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtgggcgcaggactgttgaagcctttcggagaccctgtccctcacctgcgctgtggctggtgagtccttcagtgcttatcactggacctggactccgccacgtcccagcgaggctggagtggattgggaatcatcagtggtgatacaccaactacaacccgtcctacaacgacgccgagtacaacctatacgtacggtacggaaccacgggacgaaacgtaaccctaggttaccctacccctaagtaaaccgtacgaacccggtccgttcggtacgtacccccggaccgggaccggaaccgtaccggtccgttacggttacggttactttacgtggttcggacggaagacggaaggtcggggcgggtacgggtaccgttacgtacgttacgggtacgttttcggggacccgtaacggggtaaaccgtagggtccacccggttccctacccggacgtcccttacccgaacccgtaaccgggtacccctacgttcccggttcccgttccccccggtaccggg

SEQ ID NO: 41313 - DNA, 702 bp, Homo sapiens
  misc_feature: GYAE6OF01DOLWD.48.4.A04.1.454.CMB.1.raw
  modified_base (224)..(224): a, c, t, g, unknown or other
  misc_feature (224)..(224): n is a, c, g, or t
tcagagtatacatacacgaccggtgctcgatttagagtagtgatcagggggctttctgagagtcatggacctcctgcacaagaacatgagacacctgtggttcttcctcctctggtggcagttcccagatgggtcctgtctcaggtgcagttacagcagtggggcgcaggactgttgaacgtccttcggacgtaccctgtccctcacctgcgctgtggctggtnacgtccttgagtgcttatctacgtggacctggactcccgccacgtccccaggcgaacgggtcctggacgtgggagtttaggggaaactcgaatcgaagttcgggtaggaataaccgaacctaaactacctaaccccgtcctacgaagtacgccgagtaccactatcgtttagcggacacggacgaaacgaacctagttcctacctagaactcgacccgtcgtagtccgacccggccggacggaaccgtacggtcgtacgttagtacttacgttaggtcgtacgacggtaacggaacggtacggggcgggtacggtaccgttacggtacgtttcggtacgggtttacgggacccgtacgggtaaacccgttcgggtaccgtaccccggtccttacccccggagttaccccgttaacccgacccggtaaaccgggtccccgtaaacggttccccggttccccgttacccccggtcccggg

SEQ ID NO: 41314 - DNA, 616 bp, Homo sapiens
  misc_feature: GYAE6OF01B5T5A.48.4.A04.1.454.CMB.1.raw
  modified_base (167)..(167): a, c, t, g, unknown or other
  misc_feature (167)..(167): n is a, c, g, or t
  modified_base (238)..(238): a, c, t, g, unknown or other
  misc_feature (238)..(238): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcncaggactgttgaagccttcggagaccctgtccctcacctgcgctgtggctggtgagtccttcagtgcttancactggacctggactccgccagtcccagcgaaggcctggagtggagttaggggaaatcaatcatggtgatacaccaactacaacccgtcctacaagacgccgagtcacatcttagtcgacgacggacgaaacgaacctagttacctcctagaaactcgaccgcgtcgtacgacccgccgcggacgacggctgtgtattacgtgtcgacgagacgaagtgggacgggtggaccgtacgtacgttcggtacgttttcggggaccgtaacggggtaaaccttcgggtaccgtacccggttccctaccccggtacgtcccgttaccccgaaccggtaaccgggacccctaagttcccggttaccccgttcccccgtcccggg

SEQ ID NO: 41315 - DNA, 614 bp, Homo sapiens
  misc_feature: GYAE6OF01BQRD4.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcagtggtgatacaccaactacaacccgtcctcaagacgccgagtcaccatctagtcggacacggacgaacgaaccagttcctacccgtagaaaccgtcgaccgtcgtcgtacggacccgccgacggacacggctaggtcgtattactgtcgacgagacgaagtgggcgggtggactacggtacgttcggtacgttttcggggaccgtaagggtaaacccgtcgggtacgacccgttccgtcccccgaggtccccgttacccgaacccgtaacgggcccccaacggttcccggttccccgttcccccggtacccggg

SEQ ID NO: 41316 - DNA, 560 bp, Homo sapiens
  misc_feature: GYAE6OF01E235C.48.4.A04.1.454.CMB.1.raw
  modified_base (515)..(515): a, c, t, g, unknown or other
  misc_feature (515)..(515): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggagttggggaaatcaatcatggtggatacaccaactaccaacccgtccctacaacgacgccgagtcaccatcttagtggacacggacgaagaaccagttcctaccctagaaactcgaccgctcgtcgacccgccgcggacgacggctgtgtattactgtgcgagacgaagtgggcggtggctacgtcgttgtacgtttgggcgacgggaacctggtaccgtccgtcctccccncgtccttccgaccgtaacgggcccagtccggtccgtccccgtcgg

SEQ ID NO: 41317 - DNA, 844 bp, Homo sapiens
  misc_feature: GYAE6OF01AY227.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtgggcgcaggactgttgaagccttcggagaccctgtccctcacctgcgctgtggctggtgtacgtccttcgagttcgctttacgtcacgtcggtacctggactccggacccaacgtccccgaagaccggaacggggcccgtagggaggtcgggtaacggtttacgggggaaaacttaccgtaaagttaccgtaaggtacgggttacgggtaaacctaaccgaaaccccgtaaaccgttaaacccgtaacccccgttacccctaacgtaaacggacggaacccggaacgttaccaacccgtacgttaccgtttaacggtcgggaaccgtaaccggggacgtaaaccgaaacccgtaacgtttacccgtaccccgtaagtaaacccgtcggaacccgtccgtacgggttaccggaccccggtaccgggaccgggaaccgtaacccgggtgttacggtttacggttaaaccttttacgttcgggtacggtaccggtaaccgggtaacggtaaacgggtcggggacggggttcggtaacccggttacgtaccgttagttacgggttttaccggggaccggtaaacgggtaaccgttaccggtaccgtaccggtccctacccggtacgttcccgttacccgaaccgtaccggcccgtaaccgtccgggtcccctttccccggtaccggg

SEQ ID NO: 41318 - DNA, 671 bp, Homo sapiens
  misc_feature: GYAE6OF01CC2EW.48.4.A04.1.454.CMB.1.raw
  modified_base (308)..(308): a, c, t, g, unknown or other
  misc_feature (308)..(308): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggacgaccctgtccctcacctgcgctgtggctggtgagtccttcagtgcttatcacgtggacctggactccgccacgtcccagcgaaggcctggagtggagttagggaatcgaatcagtggngatacaaccaactacacccgtcctacaagacgcgagtcaccactcttagtggacacggacgaaacgaacctagttcctaccctagaaacctcggacccgtcgtcggtacggaaccccgccggacggaccgtaccgggtctggttacgtaacgtttacgtggtcgacggaacgacggaaggttcgggggtccggggtaggccgttaacggtacgttacggttaccgggttttcggggacccgtaaggggtaaaacccctggggtaccctacccggtcccccgtacccgtacggtcccttaaccccgacccggaaaccgggtcccctaacgtccccgggtttccccgttcccccgttccccgggg

SEQ ID NO: 41319 - DNA, 737 bp, Homo sapiens
  misc_feature: GYAE6OF01A4W3F.48.4.A04.1.454.CMB.1.raw
  modified_base (169)..(169): a, c, t, g, unknown or other
  misc_feature (169)..(169): n is a, c, g, or t
  modified_base (677)..(677): a, c, t, g, unknown or other
  misc_feature (677)..(677): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagagtgggtcctgtctcaggtgcagttacagcaggtggggcncgagggactggttagaacgccgttcggacgcccgtgtcccctcacctgcgcgtggtggctggtgacgttccttcagtgtcttatcacgtggacctggactcccgccacgtcccaggacgaacgggcctgggagtacggagttagggggaaatcaaactcgaagtgggtaggaactaaccacccgtaaactaaccccgtaacccctccctacgaaacgtacggaccggactacccgaacctacgtaccgtttaggtaacggaacggaaccgggacggtaaaaccgaacccgtacgttttacccgtacccgtaacgtaaacccgtcggtacccggtcgttaggcccggtacccggaccggaccgggaacctccggacgttcgttacgttacgttaaccgtggtacggagacggtacggaagggtcggggtcgggtcgacgttacggtcgttaggtaccgggtttcgggaccggtaacggtaaacccgttggaacccgtccggttaccccncccgacgtcccgtacccgaccgtaccggccctactcccgggttccccgttcccggtccgg

SEQ ID NO: 41320 - DNA, 935 bp, Homo sapiens
  misc_feature: GYAE6OF01DBYS2.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcgaggtggggcgcaggactggttgaacgccttcggacgacccgtgtccctcacctgcgctggcggtctgggtctacgtccttcgagtgcttatcacgtggacctggtactcccgactaccgtcccaggtaccggaacgggtcctagggtaggtcggtaaggttagggggaaatccgaaagtcgtagtagggtacggaactaacctaaccgtaaacctaaccgtaacccccgtaccgtaccgaaaggtacgtaacccgtaacggttaccaaacccgtagttaccgtttaacggtacgggtaaccgaaacccggggaccgaaaacgtaaaccccggtacgtttaccccttaccccggtaaacgtaaaccgttacccggtaacccggtaccgttacgggttacccgggaaaccccccgggttcccgggaaccgggtaaccccggtaacccgggttaccgttacgggtttaccggttaaaccgttttacggttaccgggtttaacggaacccggggttaacgaaccgggtttaaacgggttacgggggggccgggggtttaaccgggtaaccggttaaacccgggttaccgggttttagggtttaaccccggggtttacgggggttaaacccccgtaagggggttaaaccccgttacggggtaccccgtaccccgggttacccgttacccccggtacgttaccccggttaccccgaaacccgggtaaccccgggtacccttaacccgttccccgggtttcccgttacccccccgggtccggg

SEQ ID NO: 41321 - DNA, 601 bp, Homo sapiens
  misc_feature: GYAE6OF01CBZNX.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtcccctcacctgcgctgtggctggtgagtccttcagtgcttatcactggacctggatccgccacgtccccagcgaagggcctggagtggagttggggaaatcgaatcatggtgatacaccaactacaacccgtcctacaacgagccgagtcaccatctagtgacacggcgaagaaccagttctacccgtagaactcgaccgcgtgtacgacccgccgcggacacggctgtgtatactgtgacgagacgaaggtgggcgggtgtcgtacgacgttgtacgttttcgggaccgtaacgggtaaccgttcgggtaccgtacccgttccctacccccgtcgtcccgttacccgaacccgaaccgggtccccgaaccgttcccggttccccgtttccccccgtcccgggg

SEQ ID NO: 41322 - DNA, 746 bp, Homo sapiens
  misc_feature: GYAE6OF01CBXEX.48.4.A04.1.454.CMB.1.raw
  modified_base (167)..(167): a, c, t, g, unknown or other
  misc_feature (167)..(167): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcncaggactgttgaagccttcggacgaccctgtcccctcacctgccgctggtggctggtgacgttcctcgagtgtcttatcacgtcggacctggactcccgccacgtccccaggaccgaacgggcctggagtggagttaggggaactcaatcagtgggtaggactaccgaaccaacctaaccgaaccccgtcctacgaagaccgaccgacgtccaactacttacgtagtacggacacgggacgaaacgtaacctacgttaccctaccgtaacgtaaccgtcgaacccgtcgtacggtaccggaccccgccggaccggaaccgtaccgggtcttaggttaacgttacgttacgttcggtacgtaccggtaaggaaccgtagggtcggggacggggttacgggtaccgttaccggttacgtttacgggttaccgggttttacgggggacccgtaaccggggtaccccgttcgggtacccgttaccccgttccgtaccccgtccgtcccgtacccccgtaccccgtaaacccggaacccgggtaccccttaccgggttcccccggttccccttacccccccggg

SEQ ID NO: 41323 - DNA, 748 bp, Homo sapiens
  misc_feature: GYAE6OF01CBWDG.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagtccgttcggagaccctgtccctcacctgcgctgtggcgtggtgacgttccttcgagttgtcttatcacgtggacctggactccgccacgtcccagacgaacgggcctggagtggagttaggggaatcaatcagtggtagatacaccactaccaacccgtcctacaacgacgccgagtcacctatcttaggtcgacgacggacgaaacgaccgtacgttccacccttagaaacctcggacccgtcgtcggtaccggaccccgccgggtacggaaccgtaccgggtccgttaggttacgtttaacttacggttggtcgggaacgacggtaacggtaacggttacgggggccgggttacgggttacccgttaaacgggttccgtttacgggtttaccgggttttacgggggaacccgtaaccgggggtaaacccgtttccggggacccgttaaccccggttaccccgtcccccggtaacgttcccccgttaaccggaaacccccgggttaccgggttacccccgtaacggttttcccccgggttcccccgtttccccccgggtacccggg

SEQ ID NO: 41324 - DNA, 741 bp, Homo sapiens
  misc_feature: GYAE6OF01BD90Y.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcaggactgttgaagccttcggagaccctgtcccctcacctgcgctgtggctggtgagtccttcagtgcttatcacgtggacctggactccgccacgtccccagcggaagggcctgggagtggagttaggggaaatcaatcagtggtaggataccaaccaaactaccaaccccgtcctacaacgacgaccgacgtaccaacctattacgttaggtcggaacgacgggacgtaaacgaaccgtacgttcctacccgtacgtaacgtcggtaccgtcgtacggtacgaaccggtcccggaccggaccgaccggtcttacggttagttaacgtttacgtggtacggtacggaacgggtaacggtaagggtcgggggtacggggtcgggtaccggttacggttacgtttacgggttaccgggttttccgggggaaccgtaacggggtaaacccgtcgggttacccgtacccggttccccgtaccccggtacggttaccccttaaccccggaacccgggtaaccccgggtaccccgttaaccggttccccggttacccccgttcccccggtaccccggg

SEQ ID NO: 41325 - DNA, 785 bp, Homo sapiens
  misc_feature: GYAE6OF01DAJPA.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgctagttacagcgaggtcggggcgcgaggacgttggttaggaacgtccgttacgggacgtacccgttcggtccccttcgaccgtgccgtctggtcggtcgttgggtagtacgttccgttcgagttcgtcttacgtcgacgttacggaccgtggacctcccgccgacgtccccgaggaccggtaacgggccgtaggagtggtaaggttagggaaactcgtaagtcgaggtgggtaggtaactaaccaacctaaccgtaacccgtaaccccgtacctacgaacgacgacccgtaagtaccaccgtattaccgttaggtaccggaacggtaacggtaaccgaaacgtaacccgttacgttcccgtaccgtaacgtaaccgtcggaccgtcgtacgtaccggacccggtccggacggacgtacggtcgttacgttacgtaacgtttcgtaggtacggacgtaacggtaacggtagggtacgggggtccgggtacggtaccgttaacggttacggtttacggttacgggtttaccggggaccgtaacgggtaaccgtcggtaaccccgccggttccccaccggtcgtacccgtaccgacccggtacggtccctaccggttcccggttacccctccgggtccgg

SEQ ID NO: 41326 - DNA, 717 bp, Homo sapiens
  misc_feature: GYAE6OF01CTWDA.48.4.A04.1.454.CMB.1.raw
  modified_base (242)..(242): a, c, t, g, unknown or other
  misc_feature (242)..(242): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcgaggtgcagttacagcgagtgggcgcaggactgttgaagccgttcggagaccctgtccctcacctgcgctgtggctggtgacgtccttcagtgtcttancacgtggacctggactcccgccgacgtcccccgagacggaacgggccgtagggacggtggagtttagggggaaacttacaagtacaggtgggtacggtaactaccaaaccaaacctaaccgtaaccccgtccctacgaacgaccgccgtaacgtaccacctaacttcgttaacggtacggaccgaacggacgaaaagaaccgtacgtttacccgtacctagaaaccgtcgaccgtcgtacgtaccggacccgccgaccggaacgccggtcgttagttacgttacgttacgtcgtcgacgaacgtaacggaaggtcggggtcgggtacgtccgtacgtacgtttcggtacggtttaccggggaccgtaacgggtaaaccgtcggtacccgtacccgtcccgaccccgtaggtaccccgttaccgacccggaaaccggtcccttacggttcccggtccccgtttccccggtcccggg

SEQ ID NO: 41327 - DNA, 844 bp, Homo sapiens
  misc_feature: GYAE6OF01DSNY5.48.4.A04.1.454.CMB.1.raw
  modified_base (226)..(226): a, c, t, g, unknown or other
  misc_feature (226)..(226): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaacgccttcggacgaccctgtccctcacctgccgctgtcggctgggtnacgtccttcaagtgtacttatcacgtcggacctggaactccgcctacgttcccgaggcggaacgggtcctaggagttgggacgttagggggaaactacgaagttcgagttcgggtaggaacttacccgaaacctaaccgtaaacccgtaaacccccgtacccgttacgaaaacggtaccgtaccggtaacgtacccgtaaaccctaacgtttaccggttaaggttaccggggtaaccgaacccggggtaccggaaaaacggtaaacccggttaccgtttaccgtaccccgttaacggtaaaccgttaccgaacccggtaccgttacggtacgggtaacccccggtaccgggtacccgggaaccgtaacccgggtcggttacggttaacggtttaaccgttttaccgggtacggttacgggtaccggtaacgggtaacgggtaacgggtacgggggtaccggggttacgggtaccggttaaccggtacgtttaccgggtacggtttttccggggacccggtaacgggtaaaccgttcggtaccggtacccgtaccgtacccgaccgtccgttaccgaccgtacggtaccctacgtccggttccccgtcccgtacccggg

SEQ ID NO: 41328 - DNA, 693 bp, Homo sapiens
  misc_feature: GYAE6OF01BUU0M.48.4.A04.1.454.CMB.1.raw
  modified_base (166)..(166): a, c, t, g, unknown or other
  misc_feature (166)..(166): n is a, c, g, or t
  modified_base (238)..(238): a, c, t, g, unknown or other
  misc_feature (238)..(238): n is a, c, g, or t
tcagagtatacatacacgaccggtgctcgatttagagtagtgatcatggggctttctgagagtcatggacctcctgcacaagaacatgagacacctgtggttcttcctcctcctggtggcagttcccagatgggtcctgtctcaggtgcagttacagcagtgggcncaggactgttgaagccttcggagaccctgtccctcacctgccgctgtgctggtcgagtccttcagtgcttancacgtgactggactccgccacgtcccgagcgaagggcctggagtcggagttaggggaactcaaagtcagtggtcggacacgaaccaactaccaacccgtccctcaacgacgacgacgtcactatctagacgacgacggtacgaaacgaaccacgtttacctaccctaagaaccgtcgaccgtcgtacggttacgaccggtacccggacggaaccgacggtccgttggtagttaaccgtttacgtacggtcgaccggtaagaaccggtaacggtcggggacgggtcggtaccgttacggtacgttacggttaaccggttttcggggtacccgtaacggggtacccccgttagggtaccccgttacccggttaccggttcccgtaccgaacccggttccccgtaacccggtacccggtaaccggggacccttacccgggttcccgtttaccccccgg

SEQ ID NO: 41329 - DNA, 918 bp, Homo sapiens
  misc_feature: GYAE6OF01CI6J0.48.4.A04.1.454.CMB.1.raw
  modified_base (147)..(147): a, c, t, g, unknown or other
  misc_feature (147)..(147): n is a, c, g, or t
tcagagtatacatacacgaccggtgctcgatttagagtagtgatcagggggctttctgagagtcatggacctcctgcacaagaacatgagacacctgtggttcttcctcctcctggtggcagttccagatgggtcctgtctcaggtncagttacagcaggtggggcgacgaggtacttggttagaacgtccgtttcgggacgtacccctggtcccctacgaccgtgccgtccgttggtcggtccgttggtacgtacggttcccttcgagttcgtactttaactccgtaacgttcggacccgtgggacctccccggacctaccgttaccccgaggtaccggaacggggtcctagggtacggttgggtaacggtttaagggggaaaacttacgtaaacgttaccggtaggttacgggtacggtaacttaacccgaaaccccgtaaaacccgttaaaccccgtaaaccccccggttacccttaaccggaacggaaccggtacccgtaacgttacccgaaaccttaacgttaccggttaacggtaccgggaaccgaaccgggaaccgaaaacggtaaccgtaccgtttacccgtacccgtaacgtaaccgtacggtacccgtcggttacgaccgggtaccccgaccggacggtaacgcggtacgtacggttcgttaaacgtcggtacgtacggaaccgtaacggtaacgggtaacgggtcgggggtaccgggttacgtaccggttaccgttaacggtttcgggttaccgggtttaacgggaacccggttaagggtaacccgttacgggtaccccgttacccgtcccgttaccccggtaacggttcccccgttaacccggaacccggtaccggggttaccccttaccgggtttccccgtcccccggtttaccccggtcccggg

SEQ ID NO: 41330 - DNA, 1073 bp, Homo sapiens
  misc_feature: GYAE6OF01CPUHN.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttccagatgggtcctgtctcgaggtgctagttacagcgaggtggggcgcaggactggttagaacgtccgttcggacgtacccgttcgtcccctcaccgtgccgtcgtggtacggtcgttgggtcgtacggtttcccttagtacgttcgtcctttaacgtaccgtacggtacggtacccgtcgggtaccttcccggaccgtaacccgtacccccggaggaccgggtaacgggtaccgttaggggtaggtaggggttaagggtttaacgggggaaaacttacgtaacgttacgtaaggttcggggtaacggtaaccttaaacccgaaaacccgttaaacccgtaaccccggtaaccccccgttacccgtaaaccggtaaacggaacccggtaacccggtaacgttacccgtaaacccgttacggtttaaccggttttaaccgggtaacgggaaacccggaaaccgggtaacccggtaaaaaccggtaaccccgtttaacggtttaccccgttaacccgtaacggtaaaaccccggtccgggtaacccggtttccggttacgggtaaccccgggtaccccgggaccccgggaacgggtaacccggtaaccgggttccgtttaacgggttacggtttaaaccgtttcgggttaacgggtaccggtaacgggtaaaccgggtacgggtaaacgggggtttccggggggtaaccggggtttacccgggtaccgttttaaccgggtttaaacggttttaccgggggtttaaccggggtttttaccggggggaaaccccggttaaacgggggttaaccccggttcccgggttaaaccccggttaccccggttaccccgttaccccggtaaaccggttaccccgttaaccccgggaacccggtaacccggtacccgttcccgggtttaccccgttccccccggttccccgggtacccggg

SEQ ID NO: 41331 - DNA, 762 bp, Homo sapiens
  misc_feature: GYAE6OF01B3K2K.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatggggtcctgtctcaggtgcagttacagcaggtggggcgcaggactggttgaagccttcggacgacccttcgtccctcacctgcgctggtggctggtgagtccttcagtgcttatcacgtggacctggactccgccacgtcccccaggccggaacgggcctgggaggttggagttagggggaaactcaagtcgatggtagatacaccaactaaccaaccccgtcctacgaacgacgccgacgtcaccattacgttagtacggaacgaaccgggacgaaaacgtaacctacggtttacctaccccgtagtaaaccgtcggaaccccgtcgtacggttacgggaccccgcccgggaccgggaccgaccggcgttcgtacgttacgttacgtggtacgtacggacgggtaacggtaggtcgggggtcggggtacgggtccgttaacggtaccgttttacgggttaccggtttttcggggggacccggtaacgggggtaaaccccgttacggggtacccgtaccccggttccccgttacccccggtaccggtccccgtttaccccgaaccccgggtaaacccgggtacccccgtaccggttccccgggtttcccccgtttccccccggtcccgggg

SEQ ID NO: 41332 - DNA, 686 bp, Homo sapiens
  misc_feature: GYAE6OF01AMTZP.48.4.A04.1.454.CMB.1.raw
  modified_base (167)..(167): a, c, t, g, unknown or other
  misc_feature (167)..(167): n is a, c, g, or t
  modified_base (235)..(235): a, c, t, g, unknown or other
  misc_feature (235)..(235): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcncaggactgttgaagccttcggacgaccctgtccctcacctgccgctggtggctgggtgacgttccttnagtcgtcttatccacgtggacctggactccgccacgtccccgagcggaacgggcctggagtggagttaggggaaactcatcagtggtagacaccaccaacctaccaccccgtcctacgaagacgccgacgtcacctatacgtaggtacggacgacggacgaaacgaacctacgttccctacccgtacgaaccgtcgaccgtcgtacggtccggacccggtcccggacggtaccggaccggtcgttgtacgttacgttacgtggtacgcggaacgtaacggtagggtacggggcgggttacggtaccgttaccgtcgtttcggtacggtttaccggggaccgtaacgggtaaccgtcggtaccgtaccccggtccctaccccgcgtcccgttacccgaccggtaacccgggtcccttacccggttcccggtcccccgttccccgggtcccgg

SEQ ID NO: 41333 - DNA, 793 bp, Homo sapiens
  misc_feature: GYAE6OF01B8MUU.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcgaggactgttagaacgtccgttcggacgaccctcgtcccctcacctgccgtcgtggtggtcgtgggtgtacgttccttacgagttcgtaccttaagtcctaacgtcggtacccgtggtaacctcccgacccgtacgtcccccgacggacggaacggggaccgtgggtacggtgggtagttaagggggaaaactacgtaaactcgtaagtgggtaggtaacgtaaccgaaaccctaaaaccgtaacccgtaacccccgtccctaacgaaacggaccgaccggaacgtaccaaacctacgttacgttaggtacggaacgtaaccgggacgaaacgtaacccgtaagttcccgtaacccgtacgtaaaccgtcgtaaccgtcgtacggtcgaccccggacccggaccggaaccgaccggtcgtaggttacgttaacgttacgttaggcggtacgtaacgggaacgtagggtacggggtcgggtacggttaccgtacggtacttcgggttacggttccggggaacccggtaaacgggtaaccgttcgggtacccgtccgtccctaccccgtacgtccgtacccgaaacccggtacgccctacggtcccggttcccttccccggtccgg

SEQ ID NO: 41334 - DNA, 890 bp, Homo sapiens
  misc_feature: GYAE6OF01EX67F.48.4.A04.1.454.CMB.1.raw
tcagagtatacatacacgaccggtgctcgatttagagtagtgatcagggggctttctgagagtcatggacctcctgcacaagaacatgagacacctgtggttctcctcctcctggtggcagttcccagagtgggtcctgtcctcgtaggtgcagttacagcgagggtggggccacgaggtactggttacggaacgtccgttacgggacgtacccgtcgtcccctcgaccgtcgccgtcgtggtcggcgtagggtcgtacgttccttacgagttcgttcttactccgacgttcggaccgtaggctcccgaccgtaccgtaccccgaggtaccggaacgggtccgtacgggaggttagggtaggttacggggaaactacgtaactcgtaggtggtagtaacgtaccaaccaaccgtaccgaaccccgtaccacgtaacgacgtaccgtagtaccactacgttacgtacggtacggaccgtaacggaaccgtaaacgaaccgttacgtaccctacccgtaacggtaaccgtacggacccgtacggttaccggtacccgggaaccccggtacccgggaaccgggtaaccgtaccgggtaccgtttacgggtaacgtttaccgttaacgggttcggtaacgggtaccggtaacgggaacgggttaaggggccggggggttacgggtaccgggttaaccgttaacggtttaaccgggtttcggtttaacccggggtttaccgggggaaacccgggttaaaccggtaccccgggttacggttacccccggtaccgttacccccggttacccggtaccgttacccgtaaccccggaaccccggtacccgggaccccttaaccggttcccccgggttccccctaccccggggtccccgg

SEQ ID NO: 41335 - DNA, 746 bp, Homo sapiens
  misc_feature: GYAE6OF01DFHZ9.48.4.A04.1.454.CMB.1.raw
  modified_base (169)..(169): a, c, t, g, unknown or other
  misc_feature (169)..(169): n is a, c, g, or t
  modified_base (248)..(248): a, c, t, g, unknown or other
  misc_feature (248)..(248): n is a, c, g, or t
  modified_base (689)..(689): a, c, t, g, unknown or other
  misc_feature (689)..(689): n is a, c, g, or t
tcagagtatacatacacgaccggtgctcgatttagagtagtgatcaggggcgtttctgagagtcatggacctcctgcacaagaacatgagacacctgtggttcttcctcctcctggtggcagttccagtatggggtcctgtctcgaggtgcagttacagcaggtgggcncaggactgttgaacgtcctttcggacgaccccttgtcccctcacccgtgcgctggtcggcttggagacgttcccttagngttcgtacttatccacgtggaaccctggacctcccgcctaccgtcccgagacgtaacgggccttggaggtggagttaggggaactacgatcgagttcggtacggactaaccgaaccctaaccgtaacccgtaaccccgtacccgtacgaaacgtaccgccgtagtaccaccctaacgttacgttacgtacggaccgaaccgggacggaaaacgaacccgttacgtttaccctaccgtaacgtaaaccgttccgacccggtactcggtaccggaacccggccggaccgggtaacgacccggtcgtacggttacggttagttacgttcgggtacgcggtaacgtaacggtaacgggtcggggtcggtagtaccggttaacgtcgttacgggtttaccggttcgggtaacgtaccggaaaccgttggaccccgtaccgttcccncccgtcgacccttcccgaccgtacggccctacgttcccgtcccgtacccggtcccgg

SEQ ID NO: 41336 - DNA, 872 bp, Homo sapiens
  misc_feature: GYAE6OF01CASY5.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcgaggtgctagttacagcgaggtcgggcgacagggacttggttagaacgtcccgttacggacgtaccccttcggtcccctacgcctggccgcgtggtgcgtggtagtacgttccttgagtcgtacttactccgtcgtacggaccgtaggtccgtccgccgaccgacccgaggaccggtaggtaccggtagggtacgggtaggtaaggttaacggggtaaactagtaacgttacgtaggtaggtacggtaactaacccgaaccgaaaccctaaccgaccccggttaccaacgaacgacggtaccgtaccgtacaccgtattaccgtaggtcggaaccgtaccggaaaccgtaaacgtaccgtaccgtttaccgtacccgtaaacgaaccgtcggtaaccgcggttaccggaccgaccccgggccgggtaaccggtaacgccggttaacggttacggttacggttaaaccgttcggtacggtaccggggaaacgtaaccgggggaggttaaacggggtcgggggttaccgggtaacgggtaaacccgtttacggtacgggttttaccggttacggggtttcccgggaaaccgggttaaaccgggacccgggttttaccggacccggtaccccgtttaccccgacccgggtaccgttacccctaacccgggaaaccccggttcggtaaccccggttacccgtaccccggtttccccgtacccccgggtcccgg

SEQ ID NO: 41337 - DNA, 969 bp, Homo sapiens
  misc_feature: GYAE6OF01ETE10.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcaggtacttgttagaacgtccgtttcgggaacgtacccttgtccccgtactacctggtccgtaccttggttcgggccgtttggggtacgttaccggtttcccttacggtaggttcgtaccttttaacgtccgtaaccggtttcggggtaacccgttacggggtaacccgttcccccggacccgttaacccggttacccccgaacgggtaaccggggaaaccggggttcccgtagggggtaacggtttacgggggtaaagggtttaacggggaaaactacgtaaacgttacggttaagggttgggtaacggtaaccttaacctaaacccctaaccgttaaacccgtaacccccgttacccaacggtaaacggaaccgtacccggtaacgtaaccctaacgtacgtttaacgtttacgggaacggtaaccggtaaccggaacggtaaaccgtaaaccgtcggtttaccctaaccggtacgtaaacccgtcgaacccgttcgtacgggtaccccgacccgggtaccggtaccggaacggtaccgggttactacggtttaccgtttaacggtttacgtcgggtacggtaacgggaacggaacgggttaacggggttccggggtaccgggttaccgttacggttaaccggttcggtttacgtttaccggggggttaccgggtaaaccggaaccggttaaacccggttcgggtaaacccgttccgtacccgtacctaaccggttaccctaacccggaaacggacccggttcccttaacggtttccccgttccccgtcccggtcccgg

SEQ ID NO: 41338 - DNA, 872 bp, Homo sapiens
  misc_feature: GYAE6OF01B4QNF.48.4.A04.1.454.CMB.1.raw
tcagagtatacatacacgaccggtgctcgatttagagtagtgatcagggggctttctgagagtcatggacctcctgcacaagacatgagacacctgtggttcttcctcctcctggtggcagttcccagatgggtcctgtctcaggtgctagttacagcagtggggcgcaggacttgttagacgtccgttcggacgtaccctcgtcccctcaccgtgcgcgtggtcggccgttggtgtacgtttccgttacgaggttcgtacctttatacgacgtacgggaaccttgggacctacccggtacctaaccggtcccccgtaagggaccgggtaaccggggtccgttaggggaccggttagggttaacggtttaacggggggtaaaacttacgtaaacgttccgtaaggttacggggttaaacggtaaccttaaacccgtaaacccgtaaacccgttaaccccgtaacccccggttacccctaacgaaaccggacgtacccgtaagtacccgacccgtaacttccggttaggtaccgggaaccgtaacgggaacctaaacggtaaccccgttacgtttacccgtacccgtaaaggtaaacccgtccggaacccggttccgtacggtacccggtaccccggacccggtacggaccggtaccggtcttagggttacgttacgttaagtcgtacggacggtacgggtaacagggtcggggtcggacggttacgtaccggtagttttcggacgggtttcggaaccggttacgggtaaccgttcggtaaccccgtccgttacccgtcccggtaacggtcccttaccccggaaacggacccggtcccgtaaggttccccgtttaccccgtaccccgtccggg

SEQ ID NO: 41339 - DNA, 880 bp, Homo sapiens
  misc_feature: GYAE6OF01BC1LW.48.4.A04.1.454.CMB.1.raw
  modified_base (171)..(171): a, c, t, g, unknown or other
  misc_feature (171)..(171): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagagtgggtcctgtctcgaggtgctagttacagcaggtggggcncgaggtactggttagaacgtccgttcgggacgtaccctcgtcccctcacctgcgtcgtgtggtcgtggtgtacgttccttcgagtgtacctttacgccgacgttacggaccgtcggtaaccgtcccggtaccctaccgtacccccgaggaccgggaacggggtccgtaggggtagggttacgggtaagggtttaacgggggtaaaactacgtaaacgttaccgtaaggttcggggtacggtaactaacccgtaaaccctaaaccccgttaaccccgaacccccggttaccccttaacggaaaccggaccgggtacccgtaacggtacccaaccgttacgttaccgtttaagggtaccggaaccggaaccggggtaaccgaaaaccggtaacccgttaccgtttcccgtaacccgtaacgtaaaccgtcggacccggttacgttccgggacccggtaccccggaccgggacgggtaacccgtccggtacgtttcggttacgtttaacgttaccggttggtaccggacggaacggtaacggtcggggtacggggtccgggtacggtaccgttaccggttgtttacgggttaccggtttcggggaaccggtaacgggttaaccgttccggtacccgtacccgtcccgtacccggcgtaccctacccgaacccggtcggaccccttaggtccccgttcccgtcccggtcccgg

SEQ ID NO: 41340 - DNA, 847 bp, Homo sapiens
  misc_feature: GYAE6OF01ECYM3.48.4.A04.1.454.CMB.1.raw
  modified_base (164)..(164): a, c, t, g, unknown or other
  misc_feature (164)..(164): n is a, c, g, or t
tcagagtatacatacacgaccggtgctcgatttagagtagtgatcagggggctttctgagagtcatggacctcctgcacaagaacatgagacactgtggttcttcctcctcctggtgcagttccagatgggtcctgtctcagtgctagttacagcaggtgggcncaggactggttgaagtccgttacggacgtaccctgtcccctacaccgtgcgtcgtggtggccgtggtgtacgttcctttcgagttcgtactttaacgtcctaacgttcggaaccgttggaacttccccgaccgtaaccgttcccccaaggaccggtaaaccgggtcccgttagggacggttacgggttaaggttaaagggggtaaaacttccgtaaaagttccgtaaggttacggggtaacggtaaactaaccccgtaaaccccgtaaaaccttaaaccccgtaacccccgttaaccccgttaacggaaacgtaccggaaccgtacgtacccaaaccgtacttaccgtttaaggccggaaccgaacggaacggaaaacgtaccgtacgtttcctacccgtaagaacccgtcgacccgtcgtacgtaccggacccgaccggaccggaaccgacgggtctttacggttacgttaactttaccggtggtacggacggaaagtacggtaagggtccgggggtacggtacgtacgttaccggttagttacggttaccggtttacggggaaccgtaaacgggtacccttcggttacccgtcccgtttaccctcccgtaacgtcccgtaacccggaacccggtaccggtaccccgtaccgtttcccgtcccccggttccgtaaccccggg

SEQ ID NO: 41341 - DNA, 844 bp, Homo sapiens
  misc_feature: GYAE6OF01BBHXJ.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcaggactgttgaagccttcggagaccctgtcccctcacctgcgtctgtcggctggtgacgtccttcagtgtcttatccacgtcggacctggactcccgccctacgtacccccaggccggaacgggtccgtagggaggtaggtacgttagggggaaaactcgaaagtctaacggtggtaggactaaccaaccctaaaccttaacccgaaccccgttccctaacgaacggtacgaccggtaacgtccaacctacgttcgtttaaggtacggaaaccgacgggaacgaaaacgtaaaccctacgttaccctacccgtaacgaaaccgtacgaacccgtcgtacggtacccggaacccggtcccggaccggaaccggtaccgggtctcgggtttacgttaacgtttacggtcggttacggaccggaaagggtaaccgggtaacgggttcgggggtccggggttaccgggtaccggttaaccggtttccgttaacgggtttaccgggtttcccgggggaacccggttaaaacggggttaacccggttcccgggttaccccgttaaccccgggttccccgtaacccccgtaccggttccccgtaacccgaaccccgggttaaacccgggtcccccgtaaccggtttcccccgggtttcccccgttccccccgggttcccggg

SEQ ID NO: 41342 - DNA, 822 bp, Homo sapiens
  misc_feature: GYAE6OF01AG9OO.48.4.A04.1.454.CMB.1.raw
  modified_base (168)..(168): a, c, t, g, unknown or other
  misc_feature (168)..(168): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcncaggactgttgaacgtccttcggacgaccctcgtccctcacctgcgctggtggctggtgtacgtcctcgagtgcttatcacgtcggaccgtggactccgccacgtccccaggccggaacgggccgtgggaggtcggtaggttaggggaaactctaatcgtagtgggtaggaactaccaacctaacctaaccccgtaacccccgttaccccgtacgaaacggtaccggacccggtaacgtaccctaccctaactttaccgtttaacgggttacgggaacccgtaccggggaaaccggaaaaccgtaaaccccggttaaccgtttccccgtacccgttaacggaaacccgttccggaacccggttccgtacgggtacccggacccccggacccgggacccggaacccggtccggtccgttaggttacgttaccgttacgttcggtcggacgaacgggacggtaagggtcgggggaccggggttggtaccgttacggttacgttcgggttaccgggtttaccggggacccggtaacggggtaccccgttaccgggtacccgtaccggttcccttcccgtccggtacccgtaccccctacccggaacccggtaccgggaccccctacggttcccccggttccccgttcccccccgggg

SEQ ID NO: 41343 - DNA, 819 bp, Homo sapiens
  misc_feature: GYAE6OF01DD3EE.48.4.A04.1.454.CMB.1.raw
  modified_base (167)..(167): a, c, t, g, unknown or other
  misc_feature (167)..(167): n is a, c, g, or t
  modified_base (251)..(251): a, c, t, g, unknown or other
  misc_feature (251)..(251): n is a, c, g, or t
tcagagtatacatacacgaccggtgctcgatttagagtagtgatcagggggctttctgagagtcatggacctcctgcacaagaacatgagacacctgtggttcttcctcctcctggtgcagttccagatgggtcctgtctcaggtgctagttacagcaggtggggcncgaggactgttagaacgtccttggacgccctgtccctcaccgtgcgctggtcggcgtggtgtacgttccttcgagtcgtcttancgtacgtggacctcggactccgaccgtaccgtacccgaggtaccggaacggtccgtaggtaggtgggtaggttaacggggaaaacttacgaacgttacgaggttagggtacggtaactaaccaaaccctaaacctaaccccgaaccccgtcccgtaacgaacggaccggtccgtaacgtacccaaccgtacttacggttaacggacggtaaccgaaccgggtaaccggaaacgtaaacccgttacgttaccctacccggtaagaaaccgtccgaccgttcgtacggtaccgaccccggccggtaacggaaccgtccgggtcttaggttacgttaacgtttcggtacgggtacgggaaccgggtaaggtacggggtacggggtccgggggttacgtaacccggtttacggtaccgggtttcggttaaccggggttttacggggaaccggttaaaacgggtaacccgttccgggtaccgtaccccggtcccctacccgtacggttaccccgttacccgaacccgggtacggtccctaacggttcccgttacccctcccggcggtaccccg

SEQ ID NO: 41344 - DNA, 685 bp, Homo sapiens
  misc_feature: GYAE6OF01APF9R.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagtccttcggacgacccttgtcccctcacctgcgcgtgtggcttgggtcgacgttccttcagttgctttactcacgtcggacctggactcccggccaccgtcccacgcgaacgtcgccgtggagtggaggttaggggaaactcgtaactcgtagtgggtacgtacgtaaccaccgaacctacccgtaaccccgtccctaacgaacgtacgaccgacgtcacctatcgttagtcggacgacggacgtaaacgaaccgtacttaccgtacccgtagaaccgtcgaccgtcgttcggacgacccgggcccgaccggaccgaccggtctaggttacgtacgttagtcggtacggacgaaggaccggaaggtcggggcgggtacgggtactaccggtacgttcggtaccggttcggggaccggtacgggtaaaccgtcggtccgtaccgtcccgtcccacgtcctaaccccgtacggaccggtacccgcggttcccgttcccgtaccccgg

SEQ ID NO: 41345 - DNA, 639 bp, Homo sapiens
  misc_feature: GYAE6OF01A78YW.48.4.A04.1.454.CMB.1.raw
  modified_base (165)..(165): a, c, t, g, unknown or other
  misc_feature (165)..(165): n is a, c, g, or t
tcagagtatacatacacgaccggtgctcgatttagagtagtgatcaggggctttctgagagtcatggacctcctgcacaagaacatgagacacctgtggttcttcctcctcctggtggcagttcccagatgggtcctgtctcaggtgcagttacagcagtgggcncaggactgttgaagcctttcggagacccctgtcccctcacctgcgctggtggctggtgagtccttcagtgcttatcacgtgactggatccgccagtccccagcgaggctggagtggattggggaaatcaatcaagtggtagatacaccaactacaaccccgtcctcaagcgccgagtcaaccgatcgttagtggactacggacgaaacgaacctaggttcctacccgtagaacctgacccgtcgtacgttcgacccgccggccggaaccgacggtctaggtcgttacctttaacgtggtacgccggaagtaccgtaagtggggcgggtagtcgtaaccgtacgtttgtacggttttcggggactaaaccggggtaccttcgggtcccgtacccgttaccctccccggtaacgccctttaaccccgacggtaacccgggccctaacgtcccgggttcccttcccccggtcccggg

SEQ ID NO: 41346 - DNA, 919 bp, Homo sapiens
  misc_feature: GYAE6OF01AW9NG.48.4.A04.1.454.CMB.1.raw
  modified_base (171)..(171): a, c, t, g, unknown or other
  misc_feature (171)..(171): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgactagttacagcaggtcggggcncgaggactgttacgaagtccgttacggacgtaccctcgtcccctcgaccgtcggcgccgttggtacggtcgtgggtacgtaccgttccgttactaggttcgtacttaactaccgtaacgttcggtaaccgtacggaccttcccgacccgtaccgtaccccgaggacgggaaccgggtccgtaggggtacggtacgggtaaggttacgggggaaaactacggtaaacgttacgaaggtttcgggaacggtaaccttaaccgaaacccgtaaaccctaacccgtaaccccgtacccgtaacgaaacggtccggtaccgtaacgtaccgacccgtagttaacgtttacggtaacgggaaccgtaaccgggaaccgtaaacgtaacccgttaccggttcctaaccccggtaagtaacccgtccggtacccgtaccggtacggtacccggtaccccggccgggtaaccggtaaccggcggtacccgttaggttaacgtttaccgttaccgagggtttacccggacgtaacccgggtaagggtaccgggttacgggggtacccgggtacgggttaaccgtaaccggttttacggtttaacggttaccggggtttaccgggaccgtaaaaccggggttaccgtacccgggtaccgtaaccccctcccggtaacccgcccttacccgtaaccccgtaacccggtaacccggttcccttaaccggtccccgtttaccccggtccccggttacccggg

SEQ ID NO: 41347 - DNA, 545 bp, Homo sapiens
  misc_feature: GYAE6OF02G34DC.48.4.A04.1.454.CMB.1.raw
tcagagtatacatacacgaccggtgctcgatttagagtagtgatcagggggtcgtttctgagagtcatcggacctcctggcacaagaacatgagacacctgtggttcttcctcctccgtggtggcagttcccaggatgggtcctgtctcaggtgcagttacagcagtgggcgcaggactgttgaagccttcggagaccctgtcccctcgacctgccgctgtggctggtcgacgtccttcagtgcttatcactggaccgtggatccgccagtcccccagcgaagggcctggagtggattggggaaatcaatcatggtggatacaccaactacaacccgtccctcaagagccgagtcaccatcttagtggacacggacgaagaaccaggttcctccctagaaactgacccgctgtgaccgccgcggacacggctgtgtattactgtgcgagacgaagtgggcgggtggctacgcttgactttggggccagggaacctggtcaccgtctcccagccttccaccacgggcccatccggtctcccctcgg

SEQ ID NO: 41348 - DNA, 606 bp, Homo sapiens
  misc_feature: GYAE6OF02JFLFL.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggactccgccacgtccccagcgaagggcctggagtggagttggggaaatcaatcagtggtgatacaccaactacaacccgtcctacaagacgaccgagtcacatcttagagacacggacgaacgaaccacgttctcctagaactcgaccgctcgtcgaccgccgacggacaccggctagtctagttactggtcgacgtaggacgagtcgggacgggtcgcgtacgtacgttcggtacggttttcggggaccgtacggggaaccttcgggtaccgtacccggttaccttacccgacggtacccgtttcccgaaccgtaaccgggccctaacgtcccggttccccgttcccccgtccggg

SEQ ID NO: 41349 - DNA, 535 bp, Homo sapiens
  misc_feature: GYAE6OF02HCK56.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctacaagagccgagtcaccatcttagtggacacggcgaagaaccagttctccctgaactgaccgctgtcgaccgccgcggacacggctgtgtattactgtgcgagacgaagtgggcggtggctacgacttgacgtttgggcctagggaacctggtcgaccgtcctccgtcacgcctccaccgacggcccacgtccggtccttccccg

SEQ ID NO: 41350 - DNA, 640 bp, Homo sapiens
  misc_feature: GYAE6OF02IX2JG.48.4.A04.1.454.CMB.1.raw
  modified_base (410)..(410): a, c, t, g, unknown or other
  misc_feature (410)..(410): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccacgtccccagcgaagggcctggagtggagttggggaaatcaatcgatggtggatacaccaactacaacccgtcctacaagacgaccgagtccaccctaatcgttaagtggacacggacgaacgaacctagttcctccctagaaacctgacccncgtcgtcgacccgccggcgacaccgacgtgtgttattacgtgtgacggagaacgtaaggtggggccgggtggccgtaacgtacgtttggtacgttttcgggggacctaacggggaacccttgggtacccgtaacccggttcccgtaccccgtacgtacccgtttacccgaacccggtaaccggggtacccctaacggttccccgggttcccctttccccccgtaccgggg

SEQ ID NO: 41351 - DNA, 586 bp, Homo sapiens
  misc_feature: GYAE6OF02GOHMQ.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtcccccagcgaagggcctggagtggattgggggaaatcaatcatggtggatacaccaactacaacccgtccctcaagagccgagtcaccatcttagtggacacggcgaagaaccagttcctccctagaacctgaccgctgtcgaccgccgcggacacggctgtgtacttactgtgcgagacgtaagtgggcgggtggcgtacgtacgttcgtacgttttcggggaccgtaggggaaccgtgggtaccgtaccggtccgtacccccgagtcccgtttacccgaccgaacggggccccacggttcccggttcccttcccccgtaccggg

SEQ ID NO: 41352 - DNA, 534 bp, Homo sapiens
  misc_feature: GYAE6OF02GME5H.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagtgcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaagtgggcgggtggctacgacttgacttttggggcctagggaacctggtcaccgtcctccccagccttccaccaacggcccacgtccggtcttcccccg

SEQ ID NO: 41353 - DNA, 586 bp, Homo sapiens
  misc_feature: GYAE6OF02G7HSA.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaaggcctggagtggagttgggggaaatcaatcagtggtggatacaccaactacaacccgtccctcaagagccgagtcaccatcttagtggacacggcgaagaaccagttctccctagaactcgaccgctgtcgaccgccgcggacacggctgtgtacttactgtgcgagacgaagtggggcgggtggcgtacggtacttcggtacgttttcggggaccgtaacgggaaccgttcgggtaccgtacccggttcctcccccgacgtcccgttacccgaacccgaacggggcccacgtcccggttccttcccccgtccggg

SEQ ID NO: 41354 - DNA, 551 bp, Homo sapiens
  misc_feature: GYAE6OF02GL9OI.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtcccctcacctgcgctgtggctggtgagtccttcagtgcttatcactggacctggatccgccagtcccccagcgaagggcctggagtggattggggaaatcaatcatggtggatacaccaactacaacccgtcctacaagacgccgagtcaccatcttagtgacacggcgaagaaccagttcctccctagaactgaccgctgtcgaccgccgcggacacggctgtgtattactgtgcgagacgaagtgggcgggtggctacgacttgtacgtttggggccagggaacctggtaccgaccggtcctccccgagtccttaccgaccgacgggcccagtccggtccttcccccgtcgg

SEQ ID NO: 41355 - DNA, 583 bp, Homo sapiens
  misc_feature: GYAE6OF02H375Q.48.4.A04.1.454.CMB.1.raw
  modified_base (202)..(202): a, c, t, g, unknown or other
  misc_feature (202)..(202): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtgggcgcaggactgttgaagccttcggagaccctgtcccctnacctgcgctgtggctggtgagtccttcagtgcttatccactggacctggatccgccagtccccagcgaagggcctggagtggattggggaaatcgaatcatggtgatacaccaactacaacccgtcctcaagacgccgagtcacatcttagtggacacggacgaagaaccagttctccctagaactgaccgctgtcgaccgccgcggacacggctgtgtattactgtgcgagacgaagtgggcgggtggcgtacgtacgttggtacgttttcggggaccgtacgggaaccgttcgggtaccgtaacccggtcctaccccgtacgtccgttacccgaacccgtaacgggacccctacgtccggtcccgttcccccgtccggg

SEQ ID NO: 41356 - DNA, 696 bp, Homo sapiens
  misc_feature: GYAE6OF02ITBT8.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcacgtggacctggactccgccacgtcccccagcgaacgggcctggagtggagttggggaaatcaatcgagtggtgatacaccaactaccaaccccgtcctacaacgacgccgacgtacaaccatacttaggtcggacacggacgaaagaaccctagtttcctacccgtagaaacgtacgaccgcgtcggtacgaccggccgaccggacgaccggcgtcggttagttacttacgtgtcgtacggaaggtaacggtaaacggtggggtccggggtcgggtaccgttaaccggtacgtttacggttaccggtttttcgggggacccgtaacggggtaacccgttacgggttacccgtacccggttaccccgttcccccgaccgtacccgtttaccccgaacccggtaaaccgggtaccccgtaaccggtttcccggttaccccgttccccccggtcccggg

SEQ ID NO: 41357 - DNA, 570 bp, Homo sapiens
  misc_feature: GYAE6OF02GRD7J.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggagttggggaaatcaatcagtggtgatacaccaactaccaacccgtccctacaagacgccgagtccacatcttagtcgacacggcgaaacgaaccagttcctacccgtagaactcgaccgctcgtcgaccgccgcggaccgacggctgtgtattactgtgcgagacgagtgggcgggtgcgtacgtacgttgtacgtttcgggaccgtaggaccgttcggtaccgtcccgtccgtccccgacgtcctaccgaccgaacgggcccacgtccggtcccttccccgtccgg

SEQ ID NO: 41358 - DNA, 561 bp, Homo sapiens
  misc_feature: GYAE6OF02IH6U3.48.4.A04.1.454.CMB.1.raw
  modified_base (416)..(416): a, c, t, g, unknown or other
  misc_feature (416)..(416): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtcccctcacctgcgctgtggctggtgagtccttcagtgcttatcactggacctggatccgccagtccccagcgaagggcctggagtggattgggggaaatcaatcatggtggatacaccaactacaacccgtccctcaagacgccgagtcaccatctagtgacacggacgaaagaaccagttcctccctagaaactcgaccgctgtcgaccgccgcgacncggctgtcgtattacgtgtgcgagacgaagtggggcggtgcgtacgacttgacgttttggggacgagggaaccgtggtcctaccgtcctccccgacgtccttaccaccgaacggtcccacgttccggttccttacccccgtccgg

SEQ ID NO: 41359 - DNA, 572 bp, Homo sapiens
  misc_feature: GYAE6OF02G0G0A.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattgggggaaatcaatcagtggtggatacaccaactacaacccgtccctacaagacgccgagtccaccatcttagtcggacacggcgaaagaaccagttctccctagaaactcgaccgctgtcgaccgccgcggacacggctgtgtattactgtgcgagacgaagtgggcggtggcgtacgacttggtacgttttggggcctagggtacctgggtaccgaccggtcctaccccgagtcccttaccgaccgtaacgggccctaggtcccggttacccttcccccgtccgg

SEQ ID NO: 41360 - DNA, 615 bp, Homo sapiens
  misc_feature: GYAE6OF02HUED5.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtcccctcacctgcgctgtggctggtgagtccttcagtgcttatcactggacctggactccgccacgtccccagcgaagtgcctggagtggagttaggggaaatcaatcagtggtggataccacccaaactaccaaccccgtccctacaacgacgccgagtcaccatcgttagtcgacacggacgaacgaacctagtttcctaccctacgaaacctcgacccgtctacgtcgaccgccgccggacgacggctgtgtacttacgtgtgcgagacgaagtgggcgggtggacgtacgtacgttcgtacggttttcgggaccgtacgggtaaccgtcgggtccgtacccgttcctccccgtacgtcccgttacccgaacccggaaccgggtacccctacggttcccggttacccttcccccgg

SEQ ID NO: 41361 - DNA, 571 bp, Homo sapiens
  misc_feature: GYAE6OF02I8ADL.48.4.A04.1.454.CMB.1.raw
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaacgggcctggagtggattggggaaatcaatcatggtggatacaccaactacaacccgtcctacaagagccgagtcaccatctagtggacacggcgaagaaccagtctccctagaaactcgaccgntgtgaccgcgcggacncggctggtntattacgtgcgcgagacgaagtgggcgggtgactacgactttggacttttggggacctagggaacctggtaccgaccggttcctaccccgacgtccttacccgaccctaacggggtcccctaaggttcccgggtacccttcccccggtccgg

SEQ ID NO: 41362 - DNA, 597 bp, Homo sapiens
  misc_feature: GYAE6OF02ITFMA.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtcccctcacctgcgctgtggctggtgagtccttcagtgcttatcactggacctggatccgccagtccccagcgaaggcctggagtggattgggggaaatcgaatcagtggtaggatacaaccgaactaccaacccgtccctacaagacgccgagtcaaccatcttagtggacacggcgaagaaccagttctaccctgaaactcgaccgctcgtcggacccgccggcggaccgaccggctggtacgtattacgtgtgcgagacgaagtgggcgggtggcgtacgtacgtttaggacgttttacggggccgtacgggaaccgtaggtaccgtaccgtacccgtcccgtacgtccgttacccacccggaccggccccacgtcccggttcccttcccccgtccgg

SEQ ID NO: 41363 - DNA, 593 bp, Homo sapiens
  misc_feature: GYAE6OF02I4OYS.48.4.A04.1.454.CMB.1.raw
  modified_base (167)..(167): a, c, t, g, unknown or other
  misc_feature (167)..(167): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcncaggactgttgaagccttcggagacccctgtccctcaccctgcgctgtggctggtgagtccttcgagtgcttatcactggacctggatccgccagtccccagcgaaggcctggagtggattgggggaaatcaatcatggtggatacaccaactacaacccgtccctcaagacgccgagtcaccatcttagtggacacggcgaaacgaaccagttacctcctagaaactcgaccgctgtcgaccgccgcggacacggctgtgtacttactgtcgcgacgacgaagtgggcgggtcggcgtacgacttggtacgttttcggggccgtaacgggaaccgttgggtaccgtacccggttacctccccgtaacgccctttaccgaacccgtaacgggaccccacggtcccggttccgttcccccgtccggg

SEQ ID NO: 41364 - DNA, 796 bp, Homo sapiens
  misc_feature: GYAE6OF02FF0US.48.4.A04.1.454.CMB.1.raw
  modified_base (166)..(166): a, c, t, g, unknown or other
  misc_feature (166)..(166): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtgggcncaggactgttgaagtccttcggacaccctgtccctcacctgcgctggtggctggtcgacgttcctgagtgtcttactcacgtcggacctggacctccgacctacgccccaggccggaagggtcctagggagtggtagttacgggaaatcaaattcgtaagtggtacggtaactaccgaaccctaaactaacccgaaccccgtccctacgaacggaccgtaccgtaacgttaccaaccgttacgttaccgttaacggacggaaccgaaccgggtaaccgtaaacgtaacccgttacggttaccctacccgtaacgtaaaccgttcgacccgtcgttacggaccggacccggccggtaccggtaaccaccgggtcttacggttacgttaacgttaccgtacggtacgaccggtaacggtaacggacgggtcggggttacgggtacgtaaccggtttaaccgggttacgttacggtttaaccgggtttccgggaacccggtaacgggttaaccctcgggtaaccccgttacccggtaccccttaacccccggtacgttaccccgttaacccggaaccggtaacccgggtaccccttacggtcccccggtttacccgttccccccggtaccggg

SEQ ID NO: 41365 - DNA, 601 bp, Homo sapiens
  misc_feature: GYAE6OF02F1UVG.48.4.A04.1.454.CMB.1.raw
  modified_base (420)..(420): a, c, t, g, unknown or other
  misc_feature (420)..(420): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggacgtggattggggaaatcaatcatggtggatacaccaactacaacccgtccacaagacgccgagccaccatcttaggtgacgacggacgaagaaccagttccaccctagaaactcgaccgctcgtacgcccgccgccggacnccggctgtgtattactgtgacgaggacgaagtcggggcgggtgcgtacgtacgttggtacggttttggggcccgtaagggtaaccggtcggtaccgtacccggttcctaccccgtaccgtccttacccgacccggaacgggtcccctaaccgtcccgggttacccttcccccggttcccgg

SEQ ID NO: 41366 - DNA, 649 bp, Homo sapiens
  misc_feature: GYAE6OF02J1WYK.48.4.A04.1.454.CMB.1.raw
  modified_base (395)..(395): a, c, t, g, unknown or other
  misc_feature (395)..(395): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtgctggtgagtccttcagtgcttatcactggacctggatccgccacgtccccagcgaaggcctggagtggatggggaatcaatcagtggagatacaccaactaccaacccgtcctacaagacgccgacgtcaccatctagtgacacgacgaagaacctagttcctacctagaaactcgacccncgtcggtcgaccggtccggacggaccgaccggtacgtggttacgttacgtttacgtcggttacgacggtacgaaccgggtaagtcgggggtacgggtcgggtaccgtacgtacgtttcggtaccggtttaggggacccgtaacggggtaccgttcgggtaccgtaacccggtcccgtaccccgtcgtacccgttacccgaacccggtaaccgggtcccctaacggtcccggttacccgttcccccgtaccgggg

SEQ ID NO: 41367 - DNA, 821 bp, Homo sapiens
  misc_feature: GYAE6OF02GKJBD.48.4.A04.1.454.CMB.1.raw
  modified_base (169)..(169): a, c, t, g, unknown or other
  misc_feature (169)..(169): n is a, c, g, or t
tcagagtatacatacacgaccggtgctcgatttagagtagtgatcagggggctttctgagagtcatggaccctcctgcacaagaacatgagacacctgtggttcttcctcctcctggtggcagttcccagatgggtcctgtctcaggtgcagttacagcaggtggggcncaggactggttagaagccttcggacgaccctcgtccctcacctgccgtctgtggcgtggtgtacgtcccttcaggtcgtctttacgtcaccgtcggaccctggacgtcccgccgacgtccccgaggccggaacgggccgtgggacggtggtaagttagggggaaaactcgaaagtacgtagttgggtaggaactaaccgaaccaaacctaaccgtaacccccgttacccgtaacgaaggaaccgccgacgtaccacctactacgttagtacggaacgacgggaccgaaacgaacccgtacgtttccctaccctacggtaaaccgtacggacccgtacgtcgtaccggacccggtacccggaccggaacccgtaccgggtcgtttcggttacgttaacgtttaccggtacggttcgaccggtaacggtaaacggtaaagggtccgggggtaccgggttacgggtaacccgttaaccggttaccggtttacggttaccgggttttaccgggggaccctaagggggtaaccccttgggtaaccccggtaacccggttccccgttaccccgtaaccggttccccgtttaacccgaacccgggttaaccgggtacccccgttagttccccgggtttaccccgtcccccgtcccgggg

SEQ ID NO: 41368 - DNA, 541 bp, Homo sapiens
  misc_feature: GYAE6OF02FJW3P.48.4.A04.1.454.CMB.1.raw
  modified_base (484)..(484): a, c, t, g, unknown or other
  misc_feature (484)..(484): n is a, c, g, or t
tcagagtatacatacacgaccggtgctcgatttagagtagtgatcagggggcgtttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatctagtggacacggcgaaagaaccagttcctccctagaaactcgaccgctgtgaccgccgcggaccacggctgtgtacttactgtgcgagacgaatcgggcgggtggctacgacttgcgttttgggccagggaccnggtcgaccgtcctcccgagtccttccacgacggcccagtccggtccttccccgtcgg

SEQ ID NO: 41369 - DNA, 589 bp, Homo sapiens
  misc_feature: GYAE6OF02GLWXZ.48.4.A04.1.454.CMB.1.raw
  modified_base (167)..(167): a, c, t, g, unknown or other
  misc_feature (167)..(167): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcncaggactgttgaagccttcggagaccctgtccctcacctgcgctgtggctgggtgagtccttcagtgcttatcactggacctggatccgccagtccccagcgaagggcctgggagtggagttggggaaatcaatcatggtggatacaccaactacaacccgtcctacaagacgccgagtcaccatcttagtggacacggacgaacgaaccacgttcctccctagaactgaccgtctgtcgaccgccgcggaccgacgctgtgtattctgtcgcgagacgaagtggggacgggtggcgtacgacgttgtacgttttggggacctacgggtaaccgtgggtaccgtacccggtccctccccgacgtcccttaccgacccgaacggggtcccctacgttccgggttacccttcccccggtccggg

SEQ ID NO: 41370 - DNA, 704 bp, Homo sapiens
  misc_feature: GYAE6OF02IGLP2.48.4.A04.1.454.CMB.1.raw
tcagagtatacatacacgaccggtgctcgatttagagtagtgatcagggggcttttctgagagtcatggacctcctgcacaagaacatgagacacctgtggttcttcctcctcctggtggcagttcccagatgggtcctgtctcaggtgcagttacagcagtggggcgcaggactggttgaagtccttcggagacccttgtcccctcacctgcgctgtggctggtgacgtccttcagtgtcttatccaactggaccttggactccgccacgtccccaggaccggaagggcctaggacgtgggtagttagggggaaaatcgaattcgagttgggtggaactaaccgaacctaaacctaaccaaacccccggttacccctaacgaacgacgaccgaacgtaccaacctattaccgttaagtcggaaccgaacgggacgaaacgtaaccgtacgtttaccgtcccgtaagaaacctcggaccgtcttacggacgtaccggccggacggacgaccggtctacggttacgtattacgtgtcgtcgaacggacgtaggtgggcgggtagacgtacgtacttacggtacgtttcggggaccgtacgggtaaccgtcggttaccgtaccggttaccctcccgtacgttacccgtacccgtacccgaacgggtccccgtacggttacccggttccccgttaccccgtcccggg

SEQ ID NO: 41371 - DNA, 682 bp, Homo sapiens
  misc_feature: GYAE6OF02F8J8B.48.4.A04.1.454.CMB.1.raw
  modified_base (309)..(309): a, c, t, g, unknown or other
  misc_feature (309)..(309): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagttccttcagtgcttatcactggacctggactccgccagtccccagcgaagggctggaggtggagttaggggaatcgaatcagtggngatacaccaactaccaaccctccacaagacgcgacgtccactatacgtacgtggacgacggacgaaacgaaccagttccaccctagaactacgaccgtcgtacggtcgaccgccggaccggacgaccgggtcgtacggttacgttacgttacgtcggttacgacggacggaacgtaacgggtcgggggtcggggtcggaccggttacggtacgtttacggtacgggtttttacgggggaacccgggtaacgggtaacccggttacgggttacccgtacccgttacccgttccccgaaccggttacccgtttaaccccgacccggtaaccgggtacccctacggttccccggttcccgttccccccgtaccggg

SEQ ID NO: 41372 - DNA, 568 bp, Homo sapiens
  misc_feature: GYAE6OF02F7H90.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactgacctggatccgccagtcccagcgaaggcctggagtgatggggaatcaatcatggtggatacacaactacaacccgtcctacaagagccgagtcaccatcttagtgacacgacgaagaaccagttctacccgtagtaaactcgaccgctagtcgaccgccggacggacaccgggctagttacgttattactgtgacgaggacgaagtggggtcgggtggacgtacgtacgttgtaccgttttggggacctaaggggaacctgggtaccaccggtcctccccgagtccgttccacccgtaacggcccagtcggttcctccccgtcgg

SEQ ID NO: 41373 - DNA, 643 bp, Homo sapiens
  misc_feature: GYAE6OF02HKFV2.48.4.A04.1.454.CMB.1.raw
  modified_base (213)..(213): a, c, t, g, unknown or other
  misc_feature (213)..(213): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgnggctggtgagtccttcagtgcttatcactggacctggactccgaccacgtccccagcgaagggcctggagtggattgggaaatcaatcagtgtggatacaccaactacaacccgtcctacaagacgaccgagtacaccatcttagtagacgacggacaaacgaaccacgttactacccgtagaaactcggaaccgtcgtcgtacggacccggccgacggacgaccggctcggttagttattacgtgtcgacgagaacgtaaggtcggggcgggtacggaccttacggtacgtttcggtacgttttcggggaccgtaagggtaacccgttgggtacccgacccggttccgtaccccgtaggttccctttacccgaaccggaacccgggtacccgtaacggttcccgggttaccccttacccccggtccggg

SEQ ID NO: 41374 - DNA, 603 bp, Homo sapiens
  misc_feature: GYAE6OF02GAC11.48.4.A04.1.454.CMB.1.raw
  modified_base (167)..(167): a, c, t, g, unknown or other
  misc_feature (167)..(167): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcncaggactgttgaagccttcgggagaccctgtccctcacctgcgctgtggctggtgagtccttcagtgcttatcactggacctggactccgcagtccccagcgaagggcctggagtgggattggggaaatcaatcagtggtgatacaaccaactacaaccccgtcctacaagacgccgagtcaccatacttagtggacacggcgaagaaccagttacctaccctagaactcgaccgctcgtcgaaccgccgacggacacggctacggttagtactttacgtgtcgacggtaacgacggaagtcggggtcgggtggtacgttacgtacgttggtacgttttcgggggacctaacggggtaccgtggtaccgtaacggtccctacccggagtacctaccgaccgtacggaccctaggtcccggttccctccccgtacgg

SEQ ID NO: 41375 - DNA, 620 bp, Homo sapiens
  misc_feature: GYAE6OF02GARDU.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcagggactgttgaagccttcggagaccctgtccctcacctgcgctgtggctgggtgagtccttcagtgcttatcacgtggacctggatccgccacgtcccccaggccgaaagggcctgggaggtggagttagggggaaatcaatcatggtggatacaccaactacaaccccgtcctacaagacgaccgagtcaccatcttagtggacacggcgaaagaaccacgttcctacccgtagaaacctgacccgctgtcgacccgccgcggacgaccggcttggtagtacttactgtcgcgagacggaagtgggcgggtgcgtacgacgtttcgtacgttttcggggaccgtaacggggtacctgggtacccgtaccggtccctaccccgtacgtacccgttaccctaaccggaccgggtacccctagtcccgggttacccgttcccccgtaccggg

SEQ ID NO: 41376 - DNA, 572 bp, Homo sapiens
  misc_feature: GYAE6OF02JG7IK.48.4.A04.1.454.CMB.1.raw
  modified_base (388)..(388): a, c, t, g, unknown or other
  misc_feature (388)..(388): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcgagtgcttatcactggacctggatccgccacgtccccagcgaagggcctggagtggattgggggaaatcaatcatggtggatacaccaactacgaaccccgtccctacaagacgccgagtccaccatcttagtcggacacggcgaaagaaccagttccncctgaaactgaccgctgtcgaccgccgcggacacgtctgtcgtattctgtgcgagacgagtgggcggtgcgtacgacttggtacgtttcgggcgtacgggaaccgtggtaccgtaccggtcccttcccgagtccctttacccgaccgaacgggtccctagtcccggttccgttaccccctcggg

SEQ ID NO: 41377 - DNA, 743 bp, Homo sapiens
  misc_feature: GYAE6OF02JHJ6G.48.4.A04.1.454.CMB.1.raw
  modified_base (238)..(238): a, c, t, g, unknown or other
  misc_feature (238)..(238): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttancactgacctggactccgccacgtccccagcgaacggcctggagtggagttggggaaatcgaatcgagtggtaggatacaccaactaccaacccgtcctacaacgacgaccgagtccaacacttacttagacggaacaccgggacgaaacgaacccgacggtttaccctacccgttacgtaaaccgtacgaacccgtccgttacggtcccggtacccggcccggtaaccgggaaccgaacccgggtccgttcggttacgtttactttaccgtaggtcgggtaccgaacgggtaaccggaacgggttacggggtaccggggtacggggtacccgttaaccgggtacgttttaccggttacgggttttttacgggggacccgtaacggggtaacccgttcgggtacccgtacccggttcccgtaccccggtacgtcccgtttacccgaacccggtaaccgggccccgtaaccggttccccggtttacccgttcccccggttacccggg

SEQ ID NO: 41378 - DNA, 774 bp, Homo sapiens
  misc_feature: GYAE6OF02H28EH.48.4.A04.1.454.CMB.1.raw
  modified_base (243)..(243): a, c, t, g, unknown or other
  misc_feature (243)..(243): n is a, c, g, or t
tcagagtatacatacacgaccggtgctcgatttagagtagtgatcagggggcttttctgagagtcatggacctcctgcacaagaacatgagacacctgtggttcttcctcctcctggtggcagttcccagatgggtcctgtctcaggtgcagttacagcaggtgggcgcaggactgttgaagccttcggagaccctgtccctcacctgcgctgtggctggtgacgttccttcagtgcctttanccacgtcggacctggactccgccacgtccccagcggaaggcctggagtggagttagggaaatctaatcgagttggtacggaactaaccgaacctaaacctaacccgtaacccccgttaccccacgaaacggtacggacccggacgttaccgaacctacgttcgtttaaggtacggtaaccggaccggaacgtaaaacgacccgtacgtttcctaccctacgaaacgtccgaccgcgttcggtaccgacccggcccgtacgggaccacggtcttggttacgtttaacgttcgtggttcgacggtaacggacggtaaggtcgggggtcgggtaccggtaccgttaacgttaccgtttacggttaccggtttccgggggaacccgtaaacggggtaacccgttcgggttaacccgtaccccggtttacccgtaccccgtaaccggttaccccttaaccccggtaacccggaaccccgggtaccccgttaacccggtttccccgggtttcccccgtttacccccggtccccgggg

SEQ ID NO: 41379 - DNA, 656 bp, Homo sapiens
  misc_feature: GYAE6OF02JA1X7.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtgggcgcaggactgttgaagccttcggagaccctgtccctcacctgcgctgtcggctaggtcagttccttcgagtcgcttatcacgtggacctggactccgccagtccccagcgaaggcctggagtggagttggggaaatcgaatcgagtggtgataccaccgaactaccgaaccccgtcctacaagacgccgagtccacatcgtttaagcggtacacggacgaaagaaccgtagtttccaccgtacgtaactacgtacccgtcgtacgtcgaccgccgaccggacgaccggcgtaggttcgttagttcgtgtacgacgacggtacgaaggtcgggtcgggtacgtcgtaaccgtcgttacgtacggttttacgggaccgttacgggaaccgttacggtacccgtaaccggtcccgtacccgtaaccgttccttaccccggaaccgtaccgggtaccccttacggtcccggttacccgttcccccggtaacccggg

SEQ ID NO: 41380 - DNA, 612 bp, Homo sapiens
  misc_feature: GYAE6OF02GMPEG.48.4.A04.1.454.CMB.1.raw
  modified_base (230)..(230): a, c, t, g, unknown or other
  misc_feature (230)..(230): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgacgtccttnagtgcttatcacgtggacctggactccgccacgtccccagcgaacgggcctggagtggagttaggggaaatcaatcagtggtgaataccaaccaactaaccaaccccgtccctacaagacgccgagtccaaccatcttagtcggacacggacgaaagaacctagttcctcctagaacgtcgaccgctcgtcgaccgccgcgacgcggctgtgtacttacgtgtcgacgacgacgaaggtggggcgggtcgcgtacgtacgttcgtacggtttcggggaccgtaagggtaccgtcggttaccgacccggttcctaccccgtacgtcccttacccgaaccggtaaccgggccctacggtcccggttcccgttcccccgtccggg

SEQ ID NO: 41381 - DNA, 621 bp, Homo sapiens
  misc_feature: GYAE6OF02F974S.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtgctggtgagtccttcagtgcttatcacgtggacctggactccgccacgtccccagcgaacgggcctgggagtggtagttaggggaaatcgaatcagtggtagactaacgaccaactaccgaaccccgtcctacaagacgacgagtcacctatactaggtacgacgacggacgaacgaacctacgttcctacccgtagaacgtcgaccgcgtcgtacggaccgaccgcggacgacggtctgttagtacttacgtgtgacgagacgagtgggtcgggtgtacgtacgtacgttagtacggtttcgggaccgtacgggtacgtcggtaccgtacccgtaccgtacccgtacgtaccgttacccgaaccgaccgggtaccctacggtcccggtttacccgtccccgtaccgg

SEQ ID NO: 41382 - DNA, 657 bp, Homo sapiens
  misc_feature: GYAE6OF02IZUYK.48.4.A04.1.454.CMB.1.raw
  modified_base (239)..(239): a, c, t, g, unknown or other
  misc_feature (239)..(239): n is a, c, g, or t
  modified_base (347)..(347): a, c, t, g, unknown or other
  misc_feature (347)..(347): n is a, c, g, or t
  modified_base (414)..(414): a, c, t, g, unknown or other
  misc_feature (414)..(414): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgacgtccttcagtgcttanccacgtggacctggactccgccagtcccccagcgaacgggcctgggacgtggagttaggggaaatcaatcagtggtggatacaccaactaacacccgtccctacaganccgagtcaccatcttagtgacgacggcgaagaacccagttcctacccgtagaaacctcggtaacccnctacggtgtaccccgccggacggaccgaccggccgttgtagttgtttaactgtcgccggagaaccggaagtaggggtccgggtggcctaagacgttggttccgttttacggggacccgtaggggaacccgttcgggttaccgaccccggttcccgtacccccgtacgttcccgtttacccgaaccccgaaccggggtcccaacggttaccccgggtttcccgttacccccccgttccccgggg

SEQ ID NO: 41383 - DNA, 673 bp, Homo sapiens
  misc_feature: GYAE6OF02I9CC2.48.4.A04.1.454.CMB.1.raw
  modified_base (364)..(364): a, c, t, g, unknown or other
  misc_feature (364)..(364): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgacgtccttcagtgcttatcactggacctggactccgccacgtccccagcgaacgggcctgggagtggagttagggggaaactcaacgtcagtggtggtactacaccaactaccaacccgtcctacaagacgccgagtcacctntacgttagtcggacacggacgaacgaaccgtagttcctaccgtacgaaactcgaccgcgtcggtacgacccggccgtcggacgaccggcgtagtgtacttacgtggtcgtacggaggtaacggtaaggtcggggtacgggtcggtacggttaacgtacgtttggtaccggtttttacggggacccgtaacggggtaaccgttcgggtacccgtaacccggttacccgtaccccgtacggtacccttacccgaacccggtaaccggggtccctaacggttccccggttacccgtacccccggttcccggg

SEQ ID NO: 41384 - DNA, 797 bp, Homo sapiens
  misc_feature: GYAE6OF02IQRR3.48.4.A04.1.454.CMB.1.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtgggcgcaggactgttgaagccttcggacgaccctgtcccncacctgcgctgtgctggtnagtccttcgagtgccttatcacgtggacctggactccgcctacgtccccgagacggaacgggcctggagtggtacgttagggggaaactacgaagttcgtagtggtacggtaacgtaaccaaaccaaaccttaacccgtaaacccccggtaccctaacgaaacggtaacggacccggtaaccgtaccaacccgtaacttaccgtttaaggtacggaacgtaaccgggacgaaaacgaacctacgttacccgtaccctaacggtaaacttccggaaccgtcgttcggtaccgacccggaccggtaccgggaaccgaccggtacgtcggtttacgttaaccgtttaacggtcggtacggacgtaacgggaaacggtaacggttcgggggacgggtacgggtaccctaaacgggttaccgtttacggttaccgggttttaccgggggaccgtaaaccgggggttaccgttacggggtacccgtacccggttacccgtacccgaaccgttcccgttaacccggaaccggtaacccgggtacccttacggttacccggttccccctccccgggtaacccgg

SEQ ID NO: 41385 - DNA, 655 bp, Homo sapiens
  misc_feature: GYAE6OF02FH1D9.48.4.A04.1.454.CMB.1.raw
  modified_base (240)..(240): a, c, t, g, unknown or other
  misc_feature (240)..(240): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcgggagaccctgtccctcacctgcgctggtggctggtgagtccttcagtgcttancactggacctggactccgccacgtccccagcggaagggcctgggagtcggattagggggaaatcgaatcaagtggtaggactacaccgaactaccaaccccgtaccctcaaggacgccgagtccaccatcttaggtcggacgacggacgaaagaacctacgttactccctagaacctgaccgtctgtcgaccgccgcggaccgacggctggtagtacttactgtcgacggtagacggtagtcggggcgggtacggtacgttaccgtaccgtttcggtaaccggttttcgggggaccgtaacgggggtaacctcgggttacccgacccggttaccctaccccgtaacggtaccctttacccgacccggtaaccgggcccctaacggtcccggttaccccgttcccccgtacccggg

SEQ ID NO: 41386 - DNA, 718 bp, Homo sapiens
  misc_feature: GYAE6OF02HZEWS.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcacgtggacctggactccgccacgtcccccaggaccggaacgggccgtgggaggtggagttaggggaaatacgaatcgagtggtggactaaccaccaactaaccgaccccgtccctacaacggacgccgacgtcaacctatcgttagtacggaacgacgggacgaaaccgaacctacgtttcctacccgtaagaaacctcgacccgtcgtcggtaccgacccggccggaccggaccgaccggtcgttaggttacgttaacgtttacgtaggtacgacggaacggacggtaaggtcgggggccggggtacggtaccgttaaccggtacgtttcggtaccggttttcgggggaccgtaaacggggtaacccgttcgggtacccgtacccggttcccgtaccccgtaacggtcccgtttacccgaacccgggtaccgggtacccctaacggtttccccgggttaccccttcccccggtccggg

SEQ ID NO: 41387 - DNA, 725 bp, Homo sapiens
  misc_feature: GYAE6OF02HKVS5.48.4.A04.1.454.CMB.1.raw
  modified_base (119)..(119): a, c, t, g, unknown or other
  misc_feature (119)..(119): n is a, c, g, or t
  modified_base (133)..(133): a, c, t, g, unknown or other
  misc_feature (133)..(133): n is a, c, g, or t
  modified_base (138)..(139): a, c, t, g, unknown or other
  misc_feature (138)..(139): n is a, c, g, or t
  modified_base (143)..(143): a, c, t, g, unknown or other
  misc_feature (143)..(143): n is a, c, g, or t
  modified_base (145)..(146): a, c, t, g, unknown or other
  misc_feature (145)..(146): n is a, c, g, or t
  modified_base (148)..(148): a, c, t, g, unknown or other
  misc_feature (148)..(148): n is a, c, g, or t
  modified_base (151)..(151): a, c, t, g, unknown or other
  misc_feature (151)..(151): n is a, c, g, or t
tcagagtatacatacacgaccggtgctcgatttagagtagtgatcagggggctttctgagagtcatggacctcctgcacaaagaacatgagacacctgtgttcttcctcctctggtgcntccagatggctgtncaggnnatangnngnggngcgagatgtgagctcgacgacctcgtcctcactcgcgtcgtgtgcgtgtagtacgttactactagtagtacttactactacgtacgacgtacgtacgtaccgaccgaccgtaccgacgacgacggacgtaggtaggtaggtagtaggtaacgtactacgtacgtagtagtacgtaacgtaaccgtaacctaacctaaccgtaaccccgtaccgtaacgaacgacgaccgacgacgtaacgtaacgttacgttaacggtacgaacgtacgaacgtaaacgtaaccgtaaccgttaccgtaaccgtaacgtaacgtacgtaaccgtacgtacgtaccgaccggaccggacggaacggtacgtacgtacggttacgttacgttacgttacgtacgacgaacgtaacgtaacggtacgggtacggtaccggtaacgtaaccgttaacgttacggttacggtttaccggtaaccggtaaccggtaaccgtacgtaccgtaacccgtaccgtaccgtaccgtaccgttaaccgaacccgaaccggacccgtaccgtacccgttacccgttacccgtccgg

SEQ ID NO: 41388 - DNA, 627 bp, Homo sapiens
  misc_feature: GYAE6OF02IRFEX.48.4.A04.1.454.CMB.1.raw
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgctagttacagcagtggggcgcaggactgttgaagccttcggagaccctgtccctcactgcgctgtggctggtgacgttccttcgaggttgcctttagtccacgtcggacctggactcccgcctacgtcccccgaggaccggaagggcctgggacgtggtagttagggggaaatctaatcgagtcgggtaggactacacctaaactaccgtaacccgtcctacaagacgccgagtcacctatactaggtcgacgacggacgaacgacctagttacctctacgtaactcggaaccgcgtagtacgacccgcgcggaacncggntgtcgtatactcgtgcgagacgaggtcggggtacggtgtcgtactacgttcgttacggtttgggaccgtagggtaccgtcggtaccgtacccgtaccgtccctaacgtcccgttacccgacgtaacgggccctacgtcccggttcccgtccccgtcgg

SEQ ID NO: 41389 - DNA, 578 bp, Homo sapiens
  misc_feature: GYAE6OF02FMY3H.48.4.A04.1.454.CMB.1.raw
  modified_base (238)..(238): a, c, t, g, unknown or other
  misc_feature (238)..(238): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttancactggacctggatccgccagtccccagcgaagggcctggagtggattggggaaatcaatcatggtggatacaccaactaccaacccgtccctanaagagccgagtcaccatcttagnggacacggcgaaagaacccagttcctacccgtagaaactgaccgctgtcgaccgccgcggacacggctgtgtattactgtgcgagacgaagtgggcgggtggctacggacttggtacgttttcggggaccgtaacgggacctgggtaccgtacccggtcctaccccgacgtcccttaccgaccgaaccgggaccctacgtccggttccttcccccgtccggg

SEQ ID NO: 41390 - DNA, 722 bp, Homo sapiens
  misc_feature: GYAE6OF02GHD10.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcaggactgttgaagccttcggacgaccctgtccctcacctgcgctgtggctggtgacgtccttcgagtgtcttactcgacgtggacctggactccgccacgtccccaggcggaacgggccgtggaggtggagttaggggaaatcgaatcgagtgggtagtactacgaaccaactaacccgaacccgtcctacgaagtacgaccgtacgtaccaactacttacgttaggtacgaccgacggacgaaacgtaaccgtacgttacctaccgtacgaaccgtcggtaccgtcgtacggtaccggacccggccggacggaccgacggtcgttaggttacgttaactttacggtcggtacggacggtaaggaacggtagggtcggggtacgggtcgtaccggtaacgttacgtttacgggttacggtttacggggaccgtaacggggtaccttccgggtacccgtacccggttcccgtaccccgtagttaccccgttaacccgaaccgggtacccggtacccgtaccggttaccccgggttccccgttccccggtccggg

SEQ ID NO: 41391 - DNA, 677 bp, Homo sapiens
  misc_feature: GYAE6OF02H0XUG.48.4.A04.1.454.CMB.1.raw
  modified_base (166)..(166): a, c, t, g, unknown or other
  misc_feature (166)..(166): n is a, c, g, or t
  modified_base (246)..(246): a, c, t, g, unknown or other
  misc_feature (246)..(246): n is a, c, g, or t
  modified_base (388)..(388): a, c, t, g, unknown or other
  misc_feature (388)..(388): n is a, c, g, or t
  modified_base (399)..(399): a, c, t, g, unknown or other
  misc_feature (399)..(399): n is a, c, g, or t
tcagagtatacatacacgaccggtgctcgatttagagtagtgatcaggggctttctgagagtcatggacctcctgcacaagaacatgagacacctgtggttcttcctcctcctggtggcagttcccagatgggtcctgtctcaggtgcagttacagcaggtgggcncgaggactggttgaacgtccttcggagacccctgtcccctcacctgcgctgtggctaggtgacgtccttgagtgacttancacgtggactggactccgactcgtcccagcggtaacggccgtaggacgtaggtaggttacgggaaatcgaaactcgtagtggtcgtaactaccaacgaacctaaccgaaccccgttccagtaacgacgaccgataccaaccnttaccttaggngaaccgcggaagtaaacgacccgtagttcctacccgtaagaactccgaccgacttcgacgaccgccgaccggacgcgactaggtacgtaacgttacgtcgtacgacgtaacggacgtaaacggtggggaccggtacggtaccgtaaccggttacttccgggtacgtttacggggaaccgtaacgggtaaccgtcggtaccgaaccggttccctacccgtacggtaccctccggtaaccgaacgggtcccaccggttccggtccctaccccggtcccgg

SEQ ID NO: 41392 - DNA, 620 bp, Homo sapiens
  misc_feature: GYAE6OF02JBQ16.48.4.A04.1.454.CMB.1.raw
  modified_base (167)..(167): a, c, t, g, unknown or other
  misc_feature (167)..(167): n is a, c, g, or t
  modified_base (439)..(439): a, c, t, g, unknown or other
  misc_feature (439)..(439): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcncaggactgttgaagccttcggagaccctgtccctcacctgcgctgtggctggtgagtccttcagtgcttatcactggacctggactccgccagtcccagcgaagggcctggagtggattggggaaatcaatcatgggtgataccgaaccaactaaccaccccgtccctgaacgacgccgagtccaaccattcttagtaggaccgacggacgaaagaacctacgttacctaccgtagaacctcgaccgtactgtcgacccggtccgacggacncgggctggttatacgttacgtgtcgtcgaacgtacgagtgggcgggtagtcgtacgtacttcggtacggttttcgggaccgaacgggtaaccgttcgggtaccgacccggttccgtaccccgagtcccgttacccgacggtaacggcccctacggtcccgggttacccttccccgtccggg

SEQ ID NO: 41393 - DNA, 798 bp, Homo sapiens
  misc_feature: GYAE6OF02ISDNK.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtgggcgcgaggactggttgaacgtccgtttacgggacgtaccctgttccccctcgacctcggccgtcgtggtgggccgttgggtcggtacgttcccttacgagttcgtacttaagtccgtaacgtggaccttggtactccggtccgaccgtccccgaggcgaaggtcccgtaggacggttggtaagttagggggaaactacgtaactgaacgtgggtaggtaactaaccgaaccctaaaccgtaacctaaccccgttccctaacgaacgacgacccgtacgtacaccattacgttacgcggacgacggacgaaacgaacctacgttcctaccgtagaacgtcgaccgtctcgtaccgaccgtccggacggaccgtaccgtcgtcggttacgtttacgttacttaggtacggaccgaaaggacgtaaacgggtacggggtcgggtacggtaccgtacggttaccgtttacgggttaccgggtttttacgggaccgggttaaacgggtaaccgttacggttacccgtaacccgggttaccccttaccccggtaccggttacccgttaaccccgtaacccggtaacccggacccgtacccggtttacccggtttcccccgttacccccggttaccccggg

SEQ ID NO: 41394 - DNA, 755 bp, Homo sapiens
  misc_feature: GYAE6OF02GSAS9.48.4.A04.1.454.CMB.1.raw
  modified_base (164)..(164): a, c, t, g, unknown or other
  misc_feature (164)..(164): n is a, c, g, or t
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
tcagagtatacatacacgaccggtgctcgatttagagtagtgatcagggggctttctgagagtcatggacctcctgcacaagaacatgagacacctgtggttcttcctcctcctggtgcagttcccagatgggtcctgtctcaggtgcagttcagcagtgggcncaggactgttgaagccttcggagaccctgtccctcacctgcgctgtggctggtgagttccttcagtnacttatcactggacctggactccgccacgtccccagcgaacggcctggagtggagttaggggaatcgaatcgngtggtaggactacgaccaacgacctaacccgtcctacaacgacgaccgacgtaccaacctacttacgtttagtacggacgaacgggtaacgaaacgaaccgtacgtttccctacccgtacgtaaaccgtacgacccgtcgtttacggaccggacccggccggaccggaccggaaccggtcgttcggtagttacgttacgtcggttacgacgtaacggacggtaaacggtcggggtaacggggttcggaccggtttaacccgtacgggtttacggttaacccgggttttcggggacccgggtaaacgggttaacccgggttcgggtaaccccgtaccccgggttacccttacccccggtaaggttacccccgtttaacccggaacccggaaccggggttccccccgttaacggttacccgggtttccccccgtttaccccccgtacccgggg

SEQ ID NO: 41395 - DNA, 581 bp, Homo sapiens
  misc_feature: GYAE6OF02IIKR0.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgccgctgtggctggtgacgtccttcagtgcttatcactggacctggactccgccagtccccagcgaagggcctggagtggagttggggaaatcaatcagtggtggactacaccaactaccaacccgtcctacaagacgccgagtcaccatctagtcgacacgacgaagaaccagttcctcctagaacctgaccgctcgtcgaccgcgcggacacggctgtagtattacgtgtcgcgagacgagtgggcggtggcgtacgtacgttggtacgtttggggaccgtacgggtaaccgtggtaccgaccggttccgtccccgacgtccctaccgacccgtaacgggaccctacgtcccggttcccgttaccccgtcggg

SEQ ID NO: 41396 - DNA, 668 bp, Homo sapiens
  misc_feature: GYAE6OF02I58UC.48.4.A04.1.454.CMB.1.raw
  modified_base (166)..(166): a, c, t, g, unknown or other
  misc_feature (166)..(166): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagtacagcagtggggcncaggactgttgaagccttggagaccctgtcccctcacctgcgctggtcggctggtgacgttccttcagtcgcttatcactggacctggactccgccacgtccccagcgaacgggcctggacgtggagttggggaaactcaatcagtggtgatacaccaactaccaacccgtcctacgaacgacgaccgacgtcaccatctagtgacacggacgaagaaccagttacctaccctagaacgtcgaccgtctcgtcgaccgccgacggaccgtaccggctcggttagtacgttacgttggcgtcgacggaacggtaacggtggggtcggggtacggtcgtaacggtaccgtttacgggttacggttttacggggaccgtaacggggtaacccgttcgggtacccgtaacccggttcccgttacccccgaacggttcccgttaacccgaacccggtaaccgggtaccccgtacgttcccgggttaccccttacccccggtcccggg

SEQ ID NO: 41397 - DNA, 751 bp, Homo sapiens
  misc_feature: GYAE6OF02HRRVR.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtcccctcacctgcgctgtggctggtgacgttccttcgagtgacttatcgtacgtcggaccgtaggacgtcccgccgaccgtaccccaggacggaacgggccgtagggtaggtggtaggttaggggaaatcgaagtacgaggttggtacgactacgaaccaaccgtacctaaccccgtacctacgaacgacgaccgacgtacactacgtacgtttacggacgacgacggacgaaacgtaaccgtacgttaccgtaccctagaaaccgtccgaccgttagtcggtaccggacccgacggacccggacgtccggtacgtggttaacttcgttaacgttggacggacggtaacgggaacgtaggggttcggggaccgggtacgaccgttacgttaaccgtttcgggtttacgggtttaccggggaacccgggtaacgggttaaccgttcgggtaaccccgtaccgttacccccggtaccgtacccgttcccgttaccccgaaaccgggtacccggtcccgtaccggtttacccccggtttacccctccccggtcccggg

SEQ ID NO: 41398 - DNA, 702 bp, Homo sapiens
  misc_feature: GYAE6OF02IRWW2.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctgggtgacgtccttcagtgcttatcactggacctggactcccgccacgtcccccaggcggaacgggcctgggagtggtagttaggggaaatcgaatctagtggtggactaccaccaacctaaccgaaccccgtacccacaacgacgccgactaccacctactcgttagtcggacgacggacgaaacgaacccgtagttccctcccgtaacgaaacctcggaccgtcgtacggtacgacccggtccggaccgggaccgaccggtcgtaggttcgttaacgtttacgtggttcgacggtaacggaacgaagggtcggggtaccggggtcggtaccggttaccgtaccgtttgggttaccggtttcggggaccggtaaccggggtaaccgttcgggtcccgtaacccggtccccgttacccgacgttcccgttacccgaacccgtaaccgggtcccctacggttccccggttcccgttcccccgtccgg

SEQ ID NO: 41399 - DNA, 722 bp, Homo sapiens
  misc_feature: GYAE6OF02I6M5D.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtgggcgcaggactgttgaagtccgttcggacgaccctgtccctcacctgcgctgtgctggtgacgtccttcagtgtcttatcacgtggacctggactccgccaacgtccccgagacggaacggtccgtaggagtggtagttaggggaaactcaaagtcaaggtggtacggtactaaccaaccaacgtaaccaacccggtccctacgaacgacgaccgagtaccacgtattacgttacggtaacggacgaacggtaacgaaacgtaaccgtacgttacctacccgtaagaaacgttcgaaccgtcgtcgtaccgaccggccgacggacgtacggtcgtgttacgttacttacgtcgtacgacggtaacgaacgggtacggtcggggtccggggtacgaccgttaccggtagtttccggttacgggtttaccgggaccgtaaacgggacccgtttcgggacccgtaaacccggtcccgttacccgtaacggtaccccgtttaccgaaccccggtaaccgggtaccctacgggtttacccccgttcccggttcccccggtccggg

SEQ ID NO: 41400 - DNA, 849 bp, Homo sapiens
  misc_feature: GYAE6OF02IC8UO.48.4.A04.1.454.CMB.1.raw
tcagagtatacatacacgaccggtgctcgatttagagtagtgatcgagggggctttctgagagtcatggacctcctgcacaagaacatgagacacctgtggttcttcctcctcctggtgcagttcccagatcgggtcctgtctcgaggtgctagttacagcaggtcggggacgcagggacttggttacggaagtcccgttacggacgtacccttcgtcccctacgacctcgcgtctggtggccttagggtcacgttccttcgagtcgtacttatcctacgtggaccgtggtacctcccgcctacgtccccaggacggtaacgggtcctaggggtcggtaggttaacgggtaacgggtaaacttaccgtaaacgtacgaaggttgggtaaggtaacctaaacccgtaaccgtaaaaccgtaccccgtaacccccgttaccgacggtaacggtaccgacccggtaaccggttacccacccgtagttacccggttaaggtaccggaaccgtaaccggaacgtaaacggtaacccgtcgttaccctaaccgtaaccgtaacgtccgtaacccgtcggtacggtaccggaccggtacccggtacggaccgtacggtcgttacggttacgtttacgtcgttacggacgaacggtaacgacgggtagggacggggtccggaacggttaccgtaccggttacgtttacggttaacccggttcggggaaccggttaacggggttaccctccgggttacccgtaacccggtcccttaacccggtaacgttacccgaccccggtaacccggtaccggccccgttaacgggttcccccgttaccccggtcccggtcccggg

SEQ ID NO: 41401 - DNA, 889 bp, Homo sapiens
  misc_feature: GYAE6OF02IGA8J.48.4.A04.1.454.CMB.1.raw
  modified_base (166)..(166): a, c, t, g, unknown or other
  misc_feature (166)..(166): n is a, c, g, or t
tcagagtatacatacacgaccggtgctcgatttagagtagtgatcaggggctttctgagagtcatggacctcctgcacaagaacatagagacacctgtggttcttcctcctctggtggcagttcccagatcgggtcctgtctcaggtgcagttacagcagtgggcncgaggactgttagagccttcggagaccctgtccctcaccgtgccgtccgtggtacggcttgggtagtacggtccgtttcgagttcgtcctttatccgaacgtcggtaccgtgggtacttccccgggaccctacggtccccccaggtaccggtaaacggggtcccgttaggggtaaggtcggggttaacgggtttaacgggggaaaacttccggtaaacgtaccggtaaaggttgggttaacggaacttaacccgaaaccctaaacccgtaacccgtaaacccccgtcccccggttaaagaacccggtaacgtcccggaacgttaccccaacccttaagttaccgttaacgggtcgaaaccggtacccgggaacgtaaacgaacccgtacgtttaccgtacccggtaagtaaacccgtcgtaaacccggtcgtaccggtaccgacccggtaccgggtaccggaaccgtaccggtccttacgggtaacgttaacttaccggtttcggcgaaccggtaccggaacggttaacgggtcgggggtaccgggtcgggttaacccgtccgttaaccgggttgggtaccggtttaccgggggaacgtaacccggggtacgtttaacggtccccgtaacccggttcccgtcccggtaacggttaccccgttccggaacccggaccgggtttaccccacggtttccccggtttccccgtcccccggttacggg

SEQ ID NO: 41402 - DNA, 714 bp, Homo sapiens
  misc_feature: GYAE6OF02IU6OR.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcgaggactggttgaagccttcggacgaccctgtcccctcacctgcgctggtggctggtgtacgttccttcagtgtcttactcgacgtcggacctggtactcccgccaccgtcccccaggtaccggaacgggcctgggagtggtagttagggggaaactcgaagtcgagtgggtaggtactacgaaccaacctaaccgaaccccgttcccgtacgaacgaccgaccggacgtacccaacctattaccgtttaggtacggaccgaaccgggacggaaaacgtaaccgttacggttcccgtaccctagtaaaccgtccggtaccgtcgtcggtacggacccggccgaccggacgaccggtcgttgttacgttacgttacgtgtacgcgaaggacgtaacggtggggcgggtcggacgtacgtcgtttacggtacggtttcggggaccgtaacgggtaccgttcggtaccgtcccgtccctcccgtctacccgttacccgaacccggtaccggtccctaccggttcccggttaccccttccccggtccgg

SEQ ID NO: 41403 - DNA, 847 bp, Homo sapiens
  misc_feature: GYAE6OF02FXPEZ.48.4.A04.1.454.CMB.1.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtnacgtccttnagtgcttancactggacctggactccgccacgtcccagcgaaggcctggagtggagtaggggaatcgaatcagtggtaggactacaccactaccgaacccgtcctacgaagtacgaccgtaaggttaccacctacgttacctttaacggtacgggaaccgtaaccggggtaaccgaaaaccggtaaaccgtaaccggttttaccccttacccggttacgtaaaacccgttacggtaaccccggtccttaccgggttaccggaaccccgggaccccgtaccggggaacccgtacccggtaccgttacggttacgggttaactttaccgttacgggttaccggaccggttaaacggaaacccgggttaagggtacggggggtacccggggtttacggggaaccgttaacccgggttaaccgttttacgggttacccgggtttttaccgggggaacccggtaacccggggttaacccggttaccggttacccggttaaccccgttacccggtttaccccccgtaaccggttacccgtttaacccccggaacccggtaaccggggtaacccccgttaccggtttccccgggttacccctttaccccccgggttaccccggg

SEQ ID NO: 41404 - DNA, 786 bp, Homo sapiens
  misc_feature: GYAE6OF02F1UCB.48.4.A04.1.454.CMB.1.raw
  modified_base (148)..(148): a, c, t, g, unknown or other
  misc_feature (148)..(148): n is a, c, g, or t
  modified_base (165)..(165): a, c, t, g, unknown or other
  misc_feature (165)..(165): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtncagtacagcagtgggcnaggactgttgaacgccttcggagtaccctgtccctcacctgcgtctggtacgcgtaggtgacgtccttacagtgacttatcaacgttgggacctggtactccgcctacgttccccgaggccggtaagggccctagggagtacgggtaagttacgggggaaacttcgtaaacgtcgtagttacgggtaggtaactaaccgtaaccaacgtaacccaacccgttaccctacgaacggtaccgccgtaacgtccgaacctaacgtttacgtttaacggacggtaacctaaccggaccggtaaacgttaaacccgtagttttacccctaccgttaacgaaacgtaccggaccgtactacggtccggtacccggccgtaaccgggtaccgtaccggtactacggttacgttaacgttacgtccgtagaccgtaaacggacggtacggtacggggtacggggtaccggtaacgtaccggttaccgttaggttacccggttttcgggggaaccttaaccggggtaacttccgggaaccgttcccgttaacccgtcccgaacgtttccccgtacccgtaaccggacccggtacccgtacggttccccggttacctcccccgggtaccgg

SEQ ID NO: 41405 - DNA, 943 bp, Homo sapiens
  misc_feature: GYAE6OF02IXFMP.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcgaggtactggttgaacgccgttcggagaccccttgtcccctcacccgtgccgtcgtggtcggtcgttgggtagtacgttccccttagaaggttcggttactttaactcctacggttaccggggtaccgttagggtaccgttccccgacccgttaaccggacccccgtacgggaaccgggtaacgggggtacccgttacgggggtagggttacgggttaacgggtttaacgggggggtaaaacttaaccggtaaacttaccggttaagggttacgggttacgggtaactaaaccccgtaaacccgtaaacccgtaacccgtaacccccgttaccccgttaaccgaaaacggtaccggtaccggaaacccgttaccaaacccggttaacttaccggttttaacggtaacggaaccgggtaaaccgggtaacccgggtaaaacccggtaacccgttaacccggttttacccgtacccgttaaacggtaaacccgtaacccggtacccggtaccgttaccgggtacccggtacccgggtacccgggcccggtaaaccggcccgggtttaacggttacggttaaccgtttaaggttaacccgttgacgggtaacgacgggtaaccgtaggggtacggggtccgggtacggtaccgttacggtacgtttcgtacggtttccgggacggtaaccgttacggtcggtaccgtaccgtccgtacccgtacgtcccttaccggaaccggtccggacctccggttaacccggtcctccccgtcgg

SEQ ID NO: 41406 - DNA, 707 bp, Homo sapiens
  misc_feature: GYAE6OF02JFNGZ.48.4.A04.1.454.CMB.1.raw
  modified_base (168)..(168): a, c, t, g, unknown or other
  misc_feature (168)..(168): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcncaggactgttgaagccttcggacgtaccctgtcccctcgacctggcgtcgtgtcggctgggtctacggtcccttnaggtcgctttaacnctacgtcggaccttggacttcccgccacgtccccgagccgaacgggcctggacgtggacgttagggggaaactcaagtcagtggtagactaacaaccaactaaccacccgtccctacaagacgaccgagtccacactctagtacgacgacggcgaaacgaaccacgttcctaccgtagaaactcgacccgtgtacgtacgacccggccgaccggtacaccggagttcgtagtacgtttactggttcgacgtacggaacgtaggtcggggacgggtacgtccgtaaccgttacgttcgggttaccggttttggggacccggtaacgggtaccgttacgggtcccgtacccggttacccgttaccccggtaacgttaccccgtttaacccgaacccggtaacccgggtacccttacgggttcccggtttaccccgttcccccggtacccggg

SEQ ID NO: 41407 - DNA, 711 bp, Homo sapiens
  misc_feature: GYAE6OF02ID5T7.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcgcaggacttgttgaagtcctttcgggacgaccctgtcccctcacctgcgtctggtcggtcgtgggttgacgttccttcgagtcgtcttatcacgtcggacgtggactcccgacctaccgtccccgaggacggaacgggcctggacggtaggtagttacggggaaatactaacgtcgaagtgggtagactaaccaaccaactaccgtaacccgtccacgaacgacgaccgtacgtccgactacgttacgtagtacggaacgaccggacgtaaacgaccgtagttccctaccgtacgaaaccgtcgacccgtgtacggtaccgaccggccggacggaaccgcggtcgttacgttacgttacttacgttacgtcggacggaacgtacggaacgggtcggggtacggtacggacgtacgttacgttcggttaccggtttcggggaaccgtacggtaccgtcggtaccgtcccggttccgacccgtcgtcccttaccgaccggtaccgggtacccttacggttacccggttcccgttaccccgtccggg

SEQ ID NO: 41408 - DNA, 722 bp, Homo sapiens
  misc_feature: GYAE6OF02GXFYS.48.4.A04.1.454.CMB.1.raw
  modified_base (167)..(167): a, c, t, g, unknown or other
  misc_feature (167)..(167): n is a, c, g, or t
  modified_base (224)..(224): a, c, t, g, unknown or other
  misc_feature (224)..(224): n is a, c, g, or t
tcagagtatacatacacgaccggtgctcgatttagagtagtgatcagggggctttctgagagtcatggacctcctgcacaagaacatgagacacctgtgttcttcctcctcctggtgcagttcccagatgggtcctgtctcaggtgctagttacagcaggtggggcncaggactgttagaagccttgggacaccctgtccctcacctggctctgtggccttggngtactccttcgaagtgtacttaagtcagtgtaccgtagactccgacaccgtcccgaagacggaacggcctaggagtacggagttagggaaatacaatcaagtggagataccgaacaaacgtaaccaacccggtcctaagacgacgaccgtagcctaactacgtacgttaaggtacggaacgaacggtaacgaaacgaaccgtcgttacctacccgtaagtaaacgtacgtaaccggtccgttaaggtacccgaccggacccggtaaccgggtaaccgtaacgggtccgttacggttacgtttaacgttaccgttacgggtacggaacggtaacggtaggtaaacgggtcgggtacgggtacgtaccggttacgtacggttacggtacggtttagggaacggaccggtagtaccgtaccgtaaccgtacccgtcccgattacccgtacccgaccggtaccggaaccgtaccgtaccggttaccccgttcccgtacccgg

SEQ ID NO: 41409 - DNA, 671 bp, Homo sapiens
  misc_feature: GYAE6OF02GEDIU.48.4.A04.1.454.CMB.1.raw
  modified_base (245)..(245): a, c, t, g, unknown or other
  misc_feature (245)..(245): n is a, c, g, or t
tcagagtatacatacacgaccggtgctcgatttagagtagtgatctagggggtcgtttctgagagtcatggacctcctgccacaagaacatgagacactgtgttcttcctcctcctggtggcagttcccagatcgggtcctgtctcaggtgcagttacagcaggtgggcgcaggacttgtgaagtccttcggagaccctgtccctcacctgcgctgtggctggtgacgtccttcagtcgcttacncacgtgacctggatcgccagtccccagcgaacgggcctggagtcggattggggaaactcgaaattcactggtaggactacgaccaaactaacctaaccccgtcctacaacggacgtccgagtacccaccgtaagttcgtttaagtcgggaaacgtaccggacggaaacgtaaaccgtacgtttaccgtcccctaaggtaaacctacggacccgtacggtacgtcggaccgtccggaccggtacgacgcgtcgttattacgttactgtgcgacggagaacgtgggacgggttggacgtacgtacgttgtacgtttgggaccgtacgggacgtcggtaccgtaccgtaccgttacccgtaacgtccgtttaacccgaccgtaacgggtaccccgtacgtacccggttcccgttacccccgttaccggg

SEQ ID NO: 41410 - DNA, 634 bp, Homo sapiens
  misc_feature: GYAE6OF02GP8OD.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgtagtccttcgagtgtcttatcacgtggacctggactccgcacgtcccagcgaacggcgtggacgtggagttagggaaatcaagtcagtggagatacaacaactaccaaccgtcctacaagacgccgatcacatacgttagacggacacggacgaaacgaactacgttcctaccgtacgaaacctcgaccgtcgtacggtcgacccggtccggaccgggacaccggtcgttaggtacgttacttacgtcggttacgacggtaacggaacggtaaggtcggggacgggttcgacgttacgtacgttacggtacggtttcggggacgtaacgggtacgtcgggtaccgtaccggtccgtacccgacgtccgttaccgaccgtacggtcccacgttcccggtcccgttcccgtccgg

SEQ ID NO: 41411 - DNA, 786 bp, Homo sapiens
  misc_feature: GYAE6OF02F2GHX.48.4.A04.1.454.CMB.1.raw
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcgaggtggggcgcaggactgtgagcgtcggtacgaccgtcgtccgtcctacctcgcgcgtgtggtcgtggtgtagtccttctgtgtgttactcacgtcggtaccgtggtcgtccgcccgtaccgtaccccgtaccggacggaacgggaccggtcggtagggtagggtacgggttaaggggtaaccgtaacgtaacgtaccgtaggttaggggtcggtaacgtaaaccgaacccgtaaaacctaacccgtaaccccgtaccccgtacgaacgaccggtaccgtaaccgtaccgacctacttaccgttagtaacggtaccggaaccggaacggtaaaccgtaacctaaccggtttacccgtacccgtacggtaaaccgcccgaacggtccgttacggaccggtacccggcccgggtacggaccgcgtcggttacgttggtaaccgtttcgtggtcgtacgggaggtaacggtacgggtggggcgggtacgttacctacggttacgtttaggtccggtttaggggccgtaacgggtaccggtcgtacgtaccccgtcccttaaccggccccgttaagtccccgaacccggaggttaccccgtacccgtttacccggtccccttccccgggcg

SEQ ID NO: 41412 - DNA, 707 bp, Homo sapiens
  misc_feature: GYAE6OF02I2GCY.48.4.A04.1.454.CMB.1.raw
  modified_base (240)..(240): a, c, t, g, unknown or other
  misc_feature (240)..(240): n is a, c, g, or t
  modified_base (310)..(310): a, c, t, g, unknown or other
  misc_feature (310)..(310): n is a, c, g, or t
tcagagtatacatacacgaccggtgctcgatttagagtagtgatcagggggctttctgagagtcatggacctcctgcacaaagaacatgagacacctgtggttcttcctcctcctggtggcagttcccagatgggtcctgtctcaggtgcagttacagcagtggggcgcaggactgttgaagccttgggacgaccctgtccctcacctgcgctgtggctggtgagtccttcagtgcttancactggacctggactccgccacgtccccagcggaaggcctggagtggagtggggaaatcaagtcagtggnggatacgaccaactaccaacccgtccctacaagacggccgacgtaccaaccattacgttaggtacggaccacggacgaaacgaacctagttacctaccctagaaaccgtcgaccgtcgtacggtcgacccgccggaccgggaacgaccggactcggttagttaacgtttaactcggttgaccggtaggaaccggtaaggtcgggggcgggtacgggaccgtaaccggtaccgtttaggtaccgggttttcgggggacccgtaacggggtaaccgttcgggtacccgtaaccccggttccgttaacccccggtacgttacccgtttaccccgaacccggtaacccgggtaccccgtaccggttaccccgggtttaccccgttccccccggttaccggg

SEQ ID NO: 41413 - DNA, 852 bp, Homo sapiens
  misc_feature: GYAE6OF02GTQ6H.48.4.A04.1.454.CMB.1.raw
  modified_base (167)..(167): a, c, t, g, unknown or other
  misc_feature (167)..(167): n is a, c, g, or t
  modified_base (268)..(268): a, c, t, g, unknown or other
  misc_feature (268)..(268): n is a, c, g, or t
  modified_base (717)..(717): a, c, t, g, unknown or other
  misc_feature (717)..(717): n is a, c, g, or t
tcagagtatacatacacgaccggtgctcgatttagagtagtgatcagggggctttctgagagtcatggaccctcctgcacaagaacatgagacacctgtggttcttcctcctcctggtgcagttcccagatggtcctgtctcaggtgctagtacagcaggtggggcncgaggtctggttgaacgtccgttcggacgtacccctcgtcccctcaccgtggccgtcgtgtcggcgtggtcgtacgttccttacgagttcgtacgttaacncgtaccgtggtaaccgttcgactccccgaccaccggtccccgaaggaccggaacgggccgtaggtaggtgggtaacgttaggggaaattccgaagttcgaggtagggtacgtactaacctacccgtaaaccgtaacccgacccccgtactacggaacggaccgaccgtactaccctacgtacttaccggtacgtacggaaccgtaaccggaacgtaaaaccgttaaccggttacgtttcccccttaaccggtaaacgtaccggttaacacccggttaacgtcccggttaccgggacccgtacccgggaacgggtaccgtacgggtccgttaaggttacgttaccgttcgttacgggacgtcggaaccgggtacggtacggggtacggggtccgggtacgtaccggtaacggttttaccgtacgggttaccgggttcccggggtaaaccncgggggtttaaccccgtcggtaccccggtttcccgtaacccggtaccccctacgggtaccccccttaccgggaaccccgtacccgggttccccgtaccggtttcccccggttacccccggtttacccgacccggg

SEQ ID NO: 41414 - DNA, 793 bp, Homo sapiens
  misc_feature: GYAE6OF02F30H4.48.4.A04.1.454.CMB.1.raw
  modified_base (169)..(169): a, c, t, g, unknown or other
  misc_feature (169)..(169): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
tcagagtatacatacacgaccggtgctcgatttagagtagtgatcagggggcgtttctgagagtcatggacctcctgcacaagaacatgagacacctgtggttcttcctcctcctggtggcagttcccagatgggtcctgtctcgaggtgcagttacagcaggtgggcncagactgttgagtccttcggacgacccgtgtccctcgacctgccgtctgtcggctggtcgagtcctnaggtctcttancacgtcggacctggatccgccacgtccccagcggaacggtccgtagggtacgtaggtacgttacgggggtaaactcgaaatccgaagttgggtacggattaacccgaaccaaacgttaacccgaaccccgttccctaacgaacggacgacccggaagtccaaccgtacgtcgtttacggtacgggaacgtcgggaacgaacgtaaaccgttgtttacccaccgttacgtaaaccgttaggaacccgtcgtacggtacggtcccggaccgggacccggtaacgccgggtacgttacggttcggttaacgtttaccgttagggttcgtaaccggtacgggtaacggtaaacggtgggggttacccggggttgggaacccgttacggttaccgtttacgggttaccggtttaacgggggtacccgggtaacgggtaacccgttcggttaccgacccggtttacccgccccggttaaccgtaccgtttcccaaccgggtaccggggtaccctaaccggttcccggttaccccgttccccgttaacccggg

SEQ ID NO: 41415 - DNA, 891 bp, Homo sapiens
  misc_feature: GYAE6OF02I587E.48.4.A04.1.454.CMB.1.raw
  modified_base (164)..(164): a, c, t, g, unknown or other
  misc_feature (164)..(164): n is a, c, g, or t
  modified_base (175)..(175): a, c, t, g, unknown or other
  misc_feature (175)..(175): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
tcagagtatacatacacgaccggtgctcgatttagagtagtgatcagggggctttctgagagtcatggacctcctgcacaagaacatgagacacctgtggttcttcctcctcctggtgcacgtccagatgggtcctgtctcaggtgcagtacagcaggtgggcncaggactggtnaacgccttggacgaccctgtccctcactcggcncgtgcggcgttggngtcgtaccttgacgtcgtctactcctcgtcggacctcggacgtccaccgaccgtcccccgaaggtaccggtacggggtccggtggtaacgggttcggaaggttaaggggtaaacgtaactaacgtacgtaaggtcgggtaacggtaaacctaccgtaaaccctaaccctaaacccggtaaccccgttacccgtaacctaacggaaccgaccgtacggtaactaaccctacgttacgtttaacggacggtaaccgaaccgggtacgaaaacgttaacccgtacgtttacccgttaccggtaacgtaaccgtaacccgaccggttcgtacggtcccgggaacccgtccgggtaccggaaccgggtaccggttacggttacggtttacttttaacccgtcggttcggtaacgggaaccgggtaaacgggtacgggtaaggggttaccgggggacgggtttaccgggttacccggttaaccggtttaccgttttaaaggggtttacccggggtttaccgggtaaaccggttaaccgggggtacccggtacgtttaacccgggtaacccggttccctaaccccggttaacggtacccttaaccccggttaacccgggcccggtaacccggtttaaccggtttcccccggttaccccggttcccccggtacccgg

SEQ ID NO: 41416 - DNA, 786 bp, Homo sapiens
  misc_feature: GYAE6OF02FGSFP.48.4.A04.1.454.CMB.1.raw
  modified_base (166)..(166): a, c, t, g, unknown or other
  misc_feature (166)..(166): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtgggcncaggactgttgaagtcctttcggagacccctgtcccctcgacctgccgcgtgtcggtccttgggtcgaaggttcccctttacgacggttcgactttaactcctaaccgtcggacctggacgtccgacccgtacgtccccagccggtaaacgggcctaggtacggtgtaacgttacggggtaaactcgtaaacttccgaagttcgggtaggtaactaaccgaacccgtaaaccttaacccgtaaacccccgttacccctacgaacgtaacggcccgtaggtacccacgtaacttaccggttaggtacggtacgaaccgggtaccgtaaacgtaaacccgtacgtttcccgtaccgtacgtaaaccgtaccggtacccgtccgttacggtcccgaacccggacccggaccggtaccgacccgggcgtttaggtacggttactttacggtcggtacgtaccgggtacgaacggtacggtacggggtccgggttacgtaccgtacggttaccgttacgttacggtttcgggaccgtaacgggtacgtcggtaccgtcccgtccgtaccctacgtcctacccgtaccggtaccggacctacgttccggtacccgttcccgtccgg

SEQ ID NO: 41417 - DNA, 892 bp, Homo sapiens
  misc_feature: GYAE6OF02GJ9V9.48.4.A04.1.454.CMB.1.raw
  modified_base (233)..(233): a, c, t, g, unknown or other
  misc_feature (233)..(233): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcagtggggcgcaggactggttgaagccgttcggagtaccctgtccctcaccgtgcgctgtggctggtgagtcctanagtgtcttatcactcggtacctggactccgcctacgtccccgagacggaacggtccgtagggtacgtgggtaacggtttagggggaaactaccgtaaacgtaccgtaaggttacggggtacgggtaactaaacccgtaaaccccgtaaaaccgttaaaccccgtaaacccccggttaccccttaacggaaaaccggtaccggtacccggtaacggtaccctaaccgtaaacgtttacccggtttaaagggttacgggaaaccgaaccggggtaaacggaaaccggtaaacccgtacgtttaccctacccgtacggtaaaaccgtacgtaaccggtacgttacggtacccggtacccgggtacccggaccgggtaccgtaccgggtacgttaggttacggttaacttacggtggtacgggtacggtaacgggtaacggtaacgggtacgggggtacgggttacgggaccggttaaccgggtaaccgtttagggttacccgggttttacggggaacccgggttaacggggttaacccgttacgggtacccgttaacccggttcccgtaccccgtaccgttacccgttaaccccggtaacccggtaacccgggtacccgtaacccgttcccgggtttaccccgtacccccggttaccccggg

SEQ ID NO: 41418 - DNA, 836 bp, Homo sapiens
  misc_feature: GYAE6OF02IJOXV.48.4.A04.1.454.CMB.1.raw
  modified_base (747)..(747): a, c, t, g, unknown or other
  misc_feature (747)..(747): n is a, c, g, or t
tcagagtatacatacacgaccggtgctcgatttagagtagtgatcagggggctttctgagagtcatcggacctcctgcacaagaacatgagacacctgtggttcttcctcctcctggtggcagttcccagatgggtcctgtctcaggtgcagttacagcaggtggggcgcaggactgttgaacgccgttcggacgtaccctgtcccctcacccttgccgctggtcggcttgggtcgacgttccttcagtgtacttatcactggacctggactccgaccacgtccccagcggaacgggcctggaggtggtagtagggggaaactcgtaagtacgtagtgggtaggtactaccgaaccaaaccgtaccgtaaaccccgtcctacgtaacgacgtacccggtagtacccaacctaccgttacgtttaacggtacgggaaccgtaaccggggaccgtaaaaacggaaacccgttaaccgtttaccccgtaccccggtttacgtaaaaacccgttcgggtaaccccgtcggttaaccgggtacccggaccccggtaccgggtacccggaacccgaccggggttaccttagggttacgttaaccgttacgggttcgtacgtacgggtaacggaacggtaaacgggtcgggggaccggttcgggtaaccgttacgttaccgtttaggttaccgggttttaacggggaccgtaaacggggtaacccgttcgggttaaccccacccggtttacccnccccggtaacggtccctttaacccgaacccggaacccgggttaccccgtaccggttaaccccggtttcccccgttaccccggtcccggg

SEQ ID NO: 41419 - DNA, 921 bp, Homo sapiens
  misc_feature: GYAE6OF02ITDAT.48.4.A04.1.454.CMB.1.raw
  modified_base (205)..(205): a, c, t, g, unknown or other
  misc_feature (205)..(205): n is a, c, g, or t
tcagagtatacatacacgaccggtgctcgatttagagtagtgatcagggggctttctgagagtcatggacctcctgcacaagaacatgagacacctgtggttcttcctcctcctggtggctacgttccagagtgggtcctgtctcaggtgctagttacagacgtaggtcggggcgcgaggtttttttttttttttttttttacgngttagtaacgtccgttcggacgtacccgtccgtccctccaccgtcgtcgtcgtggtcggtcggtcggtcgtacgttccttacgtaggtcgtacttactcgtacgtcggaccgtcggacgtcccgtaccgtaccggtccccgtacggaccggtaaccgggccgtacgggtaagggttacgggtaacgggttaagggggtaaacgtacgtaacgtacgtaacggttgggtaacggtaacgtaaccgtaaaccgtaaacccgtaacccgtaaccccgtacccctaacgtaaacgacggaccgtaccgtacctaccgtaacttacgttaacggtacggtaacgaaccggaacgtaaacgtaaccgtacgttacctacccgtacgtaaaccggtcggtaccgtcggtacggtacccggtacccggaccgggtaccgggaacgtccgtacgttcggttaacgtttacggttccggttgggaccgtacggtaacgggtacgggtaacggttcgggggtaccgggttacggtaaccggttaacgttacggtttaacggggttacccggtttaacggggacccgttaaaccggggtaccccgttacggttacccgaaccccgggttcccgtaccccgggtaccggttaccccgttaccggaaccccggggtacccggtacccgtacccggtttccccggtttcccccggttacccgggtccccgg

SEQ ID NO: 41420 - DNA, 991 bp, Homo sapiens
  misc_feature: GYAE6OF02GLBFP.48.4.A04.1.454.CMB.1.raw
tcagagtatacatacacgaccggtgctcgatttagagtagtgatcaggggctttctgagagtcatggacctcctgcacaagaacatgagacacctgtggttcttcctcctcctggtggcagttcccagatgggtcctgtctcaggtgcagttacagcaggtcggggtccgcgaggtacttcgttgaaacgtcccgttcggacgtaccccttcgtccctcacgttcgccgtcgtggtacgcgttggttacggtacgttccccgttagtaaggttcctacgtttaactcgtacgtcggtaaccgttggaccttccggtcccgtaaccgtccccgtaacggccgtaaacggtcgtcccgtaggtacggtaggtaggtttaaccggggaaatcgtaactcgtaggttacggtaggtaactaaccgaacccgtaaaccgtaccccgttaaacccccgttcccgttaaaccgtaacggaacccgtaccggtaaccgtttacccgaaccttaacgtttaccgtttaacgggtacgggtaaaccccgaacggggtaaacccgtaaaacggtaaccctttaacgggttttaaccccttaccccgttaaaccggtaaaccggttaccggtaaaccccgggttaccgttaaccgggtaccggttaacccccggggacccgtaacccggggtaacccgtaaccccgggttaccggttacggtaacgttttaaacccgtttaaccggttcgggttaaccggtaccggtaaacggtaacggtaaccgggtccgggggtttaccggggtaccggtaaccggtttaccgggtaccgttttaaccggttacccggggtttttaacgggaccccgggttaacgggttaaaccgttcccgggttaaccgtaccccggtttaccccgtacccgtacccgttacccttaccccggaaccggttaacccggtcccggttaacccgttccggttacccccgtttacccccgggg

SEQ ID NO: 41421 - DNA, 888 bp, Homo sapiens
  misc_feature: GYAE6OF02GVWGO.48.4.A04.1.454.CMB.1.raw
  modified_base (128)..(128): a, c, t, g, unknown or other
  misc_feature (128)..(128): n is a, c, g, or t
  modified_base (147)..(147): a, c, t, g, unknown or other
  misc_feature (147)..(147): n is a, c, g, or t
  modified_base (167)..(167): a, c, t, g, unknown or other
  misc_feature (167)..(167): n is a, c, g, or t
tcagagtatacatacacgaccggtgctcgatttagagtagtgatcagggggctttctgagagtcatggacctcctgcacaagaacatgagacacctgtggttcttcctcctctggtggcagttcccanatgggtcctgtctcaggtncagttacagcaggtggggcncaggactggttacgaagtccttaggacgtaccccgtcgtccctacaccgtcgccgtagtcggtggtcggtaggtacggtaccttccgtacggtagtcgttacttaaccgtccgtacggtaccggtacgttacggtacccgtcccgtaccggtaacccggtaccccggaaggaaccgggtaccggtacggtacgggtagggtacggttaacgggttaacgggaaaccttaacggttaacgtaccgtagggtttacgggaaccgtaacctaaacccgtaaacccgtaaaccgtaaccccgtaaaccccgttaccaaacggaaccggtaccggacgtacgaacctaacgtaccgtttagtacggacggaacggacgggtaaccaaacctacgttccgtaccctaacgtaacgtaaccgtaccgtaccggtcgtacgggtaccgaccccgtcggaaccgaccgggtacgtacgtttcggttaaagtttacgttaccggtgtaacggaaccggttagggaaaccgggttacgggccggggtttaccgggacgttaaccgggttacgttacggtttaaccggggtttacggttaacggggaccgggttaaaccgggttacggtcccggttaacccgtcccgtaaccccgtcctaaaccgggttccccaagggtaaccccggtacggtacccggttccggtacccggttccccgtcccggtacccggg

SEQ ID NO: 41422 - DNA, 833 bp, Homo sapiens
  misc_feature: GYAE6OF02GFJSK.48.4.A04.1.454.CMB.1.raw
  modified_base (168)..(168): a, c, t, g, unknown or other
  misc_feature (168)..(168): n is a, c, g, or t
  modified_base (193)..(193): a, c, t, g, unknown or other
  misc_feature (193)..(193): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatgggtcctgtctcaggtgcagttacagcaggtggggcncaggactgttgaagtccttcggganacccttgtccctcacccgttggccgtcgttggtcggccttgggtagtacgttccttcaggtcgtcttatcacgtcggacctggactccgaccgtacgtccccgacggtcggaacgggtcctagggtacggtacgggtaacgttagggggaaacttacggaacgtcgtaaggttacgggtagtaaccgtaaccaacccgtaaacctaaccgtaacccccggttccctaacgaacgaccggtccgaacgttccaacccgtacttacgttacggtacggtaaccgaaccgggtaccgtaaacgtaacccgtacgtttacccgtacccgttagtaaaccgtaccggaacccgtcgttacggtaccggtacccggaccggaccggaccgaccggtcgttacggttagttaacgtttacgtcggttacgacggtaaggtaacgggtaacggtcgggggtaccgggtacggtacccgttaaggttaccgtttgggttaaccggtttaccgggggtaaccgtaacgggggttacccttaccggggtaccgtaaccccggttccgtaccccgtaaccgtcccgttaacccgaaccggtaccggtaccccgttacggttaccccggttacccgttcccccggtacccggg

SEQ ID NO: 41423 - DNA, 751 bp, Homo sapiens
  misc_feature: GYAE6OF02JQSXT.48.4.A04.1.454.CMB.1.raw
  modified_base (171)..(171): a, c, t, g, unknown or other
  misc_feature (171)..(171): n is a, c, g, or t
  modified_base (367)..(367): a, c, t, g, unknown or other
  misc_feature (367)..(367): n is a, c, g, or t
  modified_base (496)..(496): a, c, t, g, unknown or other
  misc_feature (496)..(496): n is a, c, g, or t
tcagagtatacatacacgaccggtgctcgatttagagtagtgatcagggggctttctgagagtcatggacctcctgcacaagaacatgagacacctgtcggttcttcctcctcctggtggctagttccagtatgggtcctgtctcgagtgctagttacagcaggtcgggcnctacggtactgtagaacgtccgttcggacgaccttcgtccctcaccgtgcgtctggtacgtcttggtacgtacgtcccttgacgtcgtacttactaccggtactaggtaccgtacggtactcccgactaccgtccccgtaaggtaccgtagtcgtaccggtggacgtggtaacgggttaacggaatacgaactcgngttacgggtcgtaatacccggaacctaacgtaaccctcccgtaccagtaacggcgtacgtacttacaccttaagttacgacggtacggaacgtacgaaccggaaactccggttactaccctaccggtanaaacccgtcgaaccgtcggtacgtaccgaccggacggtaaccgtacgtacggtacgttacgtgttaaacttcgcgtacgtacgacggtacgtaacgggtcgggcgtacggtacttaacgttaccggtcggttaccgtttacgggaaccttaacggggtccgttacggccccgttacgtacccgtaacccgtacgttccctaacccgggacgttacccggtccgttaaccggttcccggttacccctaccccgggg

SEQ ID NO: 41424 - DNA, 686 bp, Homo sapiens
  misc_feature: GYAE6OF02JXB64.48.4.A04.1.454.CMB.1.raw
  modified_base (158)..(158): a, c, t, g, unknown or other
  misc_feature (158)..(158): n is a, c, g, or t
  modified_base (170)..(170): a, c, t, g, unknown or other
  misc_feature (170)..(170): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
tcagagtatacatacacgaccggtgctcgatttagagtagtgatcagggggctttctgagagtcatggacctcctgcacaagaacatgagacacctgtggttcttcctcctcgtggtggctacgttcccagatgggtcctgtctcgaggtgcagttanagcaggtgggcncaggactgttagagtctacgacgaccctgtccctcacctgcgctgtggntcggtnacgttccttngtctacttanactagtcggactggacctccgcctacgccctcggacgtacgtcgcggtcggtaggtggtacggttagggtaactacgtaatccggtaggtacggtcggtaacaacctaaccgtaacgtaacccctaaccccgttaccaacggaacgtacgaccgtaacctaccgacttacgtacggttacggacggtaccgtaacggacccgtaaacgtaccgtcgtacctaccgtacgtaacgtcgaccgtcgcgtacgccgtacgaccggacgacgtcgttacgttgtacgttacgtggtcgaacggacgtaacggtcgggtaggtccgggtacgtacggttacgtcggtacgttacggttacgggtacgtacgtacggtccggtacctaccgtaccgtccgtacgtaccgtaccgaccggtaccggcttaccggtcgtacccgtccgg

SEQ ID NO: 41425 - DNA, 844 bp, Homo sapiens
  misc_feature: GYAE6OF02GLIBT.48.4.A04.1.454.CMB.1.raw
  modified_base (695)..(695): a, c, t, g, unknown or other
  misc_feature (695)..(695): n is a, c, g, or t
tcagagtatacatacacgaccggtgctcgatttagagtagtgatcagggggctttctgagagtcatggacctcctgcacaagaacatgagacacctgtggttcttcctcctcctggtggcagttcccagatcgggtcctgtctcaggtgcgtagttacagcgaggtggggcgacgagggtacgttggttaggaaacgtccgtttacgggaccgacccttcgtcccctacgaccgttcgccgtcgttggtcgggtcggttgggtacgtacggtttccccgttcgtaaggttcgttacctttagtccgtaaaccgtcggtaacccgttacgggaccttccccggtacccgtaccggtaccccgaggaccggaacgggtccgtagggtacggtagggtaggttaacgggaaactactaacgtcgtaaggttcggtaacggtaactaaccaacctaaaccgtaaccgtaacccgtacccaagaacgaccgaccgtactacctacctacgttacgttacggtacggaacgaaccgggtaacgtaaaccgtaaccgttaccgttcccgttaaaccgtaacggtaaaccgaccgtccgtacgttgggtacccggacccggcgacgggtaccgtcggtacgtgttaacgttacgtcggtacggtacgacggtaacggaccgtagggtccggggtacggtacgntacggttacgttcggtttacggttaccggggacgtaaaccgggttacgtccggtaacccgttccgtaccccgttaccctacgttaccccgtaaccggaaccggtccggttacccgttacggttccccggttaccccgtcccggtaccgg

SEQ ID NO: 41426 - DNA, 719 bp, Homo sapiens
  misc_feature: GYAE6OF02GBQB3.48.4.A04.1.454.CMB.1.raw
  modified_base (165)..(165): a, c, t, g, unknown or other
  misc_feature (165)..(165): n is a, c, g, or t
  modified_base (180)..(180): a, c, t, g, unknown or other
  misc_feature (180)..(180): n is a, c, g, or t
tcagagtatacatacacgaccggtgctcgatttagagtagtgatcaggggctttctgagagtcatggacctcctgcacaagaacatgagacacctgtggttcttcctcctcctggtgcagttcccagatgggtcctgtctcaggtgcagttacagcaggtgggcncaggactgttgaacnccgttcggagtacccctgtccctctacctgccgtcttggtggtcctggttagagttcccctttgaagttcgtccttaatccaacggttcggacccttggaaccttccgccacgtacccccgaggccgtaaacgggcctaggtaggtggtacgtttaggggaaaactcgaaatcagtgggtcgatacaaccgtaaactaaccgaacccgtcccctacgaaggacgtccgacgtccaacctacgtactttacgacggacgtaccggaagaaccgaacctacgttacctcccgttaagtaaacttcggaccgtcgtgttacgacccgacggaccgacgtaccggcttacggttacgttagttaccgttccgagtcgaacggtacgtaacggtggggtacgggtcgtacgtacgttacgttcggtaacggttttcggaccgtaacgggtacgtcggtaccgtacccgtacccgttacccgaaccgtccgttaacccgacccgtaaccggccctaaccgtcccgggtttcccttccccgtccgg

SEQ ID NO: 41427 - DNA, 768 bp, Homo sapiens
  misc_feature: GYAE6OF02G74NN.48.4.A04.1.454.CMB.1.raw
  modified_base (147)..(147): a, c, t, g, unknown or other
  misc_feature (147)..(147): n is a, c, g, or t
  modified_base (167)..(167): a, c, t, g, unknown or other
  misc_feature (167)..(167): n is a, c, g, or t
tcagagtatacatacacgaccggtgctcgatttagagtagtgatcagggggctttctgagagtcatggacctccgtcgcacaagaacatgagacacctgtgttcttcctcctcctggtgcagttccagatgggtcctgtctcaggtnctagttacagcaggtgggcncaggctgtagacgtccttggacgaccctcgtcccctacgacctggccgtcgtggtacggcgttagggtcgtacgtttacccttagagtcgtacttacgacctacgtcggaccgtaggaccgttcccgaccgaccgtccccgaggacggaacggccgtggtacgtggtaggttaacgggaactctaatcgtaacgtgggtaacgtacctaaccgaacctaaccgtacccgaaccccgttccgtaacgaacgacggaccgtacgacctaacgtacgttacgtacgtcggaaccgtacggaacgtaaaccggtacccttacggttaccctacgtaacgaacgtacccgtaccgtggtaccgtcccggtaacccgccggtaacggaccgtacggtacgttacgttaacggtacttacgtcggtacgacggtaaccggtaacgaggggtcccgggtacgggtcgtaccgttacgtacggttacggttacccggttagggaccgtaacgggtccgtacggtaccctcccggtaccacccggttacacccgtttaccccggaccggtacccgtccgtacccgttaccggttccccgttacccggtccg

SEQ ID NO: 41428 - DNA, 780 bp, Homo sapiens
  misc_feature: GYAE6OF02IPJH1.48.4.A04.1.454.CMB.1.raw
  modified_base (215)..(215): a, c, t, g, unknown or other
  misc_feature (215)..(215): n is a, c, g, or t
  modified_base (572)..(572): a, c, t, g, unknown or other
  misc_feature (572)..(572): n is a, c, g, or t
tcagagtatacatacacgaccggtgctcgatttagagtagtgatcagggggctttctgagagtcatggacctcctgcacaagaacatgagacacctgtggttcttcctccctcctggtggcagttcccagagtgggtcctgtctcgaggtgcagttacagcaggtgggcgcgaggtacgttgttgaacgtccgttcggacgaccctcgtccctcnccgtgccgcgtgtggcgtggtgtacgttccttcgagtgtccccccttatcgtacgtcggtacctggactcccgaccgccgtaccccgaggaccggaacgggtccgtagggtcggtaggtaggttagggaaactacgtaacgtcgtaggtcggtacgtactaccgaaccgaaaccgtaacccgtaaccccgtacccgtacgaacgacgccgaccgtaccgacctacgttacgttagacggtaccgaccggaacgaacgaacgtaccgttccgtaccgtaacgtaacgtcgacccgtacgttcggtaccgaccccggccggaccggacgacggtcgttacgttcggttaactttccggngttacgaccggaacgtaaggttacggggtacggggtcggtacggttaaccgtaacgggttacgtttacgggttacggtttaccggggaaccgtaccgggttaaccgggtccggttaccggtccccggttaccccgtaccgtacccgttaacccgtacccgaacccggtccggacccttcgggttccccgttcccgtcccggtacccgg

SEQ ID NO: 41429 - DNA, 612 bp, Homo sapiens
  misc_feature: GYAE6OF01D2WCQ.26.60.F05.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatgtgctgacgcagtctccagccaccctgtctgcctctccgaggggaaanagtcaccatcctccgtggttgggccgtcagtagtattagcagcaacttgcctggcaccagcaagaacctggcaggctccaggcctcctnattctttgatgcctccaccgaggccctagttcggttcccagcctaggttcaggtcgctagtgcgtcgtgcgacagtacgttccacgttcctcaacctataccaacgtacgtcctagacgtacgttctaggtaaagttattttgacttaagttttactacgtgtacacggtactagtacttcgtaatcggaccgtcgggtaccctcttaccgtacccgttcgggaaccgtaacggggaccctaacggtaccgttacgggaagttaaaccggttaaaacggacgttgggacggtactacggaccctaacgtcgttcgttacgg

SEQ ID NO: 41430 - DNA, 494 bp, Homo sapiens
  misc_feature: GYAE6OF01EQDJ2.26.60.F05.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (491)..(491): a, c, t, g, unknown or other
  misc_feature (491)..(491): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgtgtctccaggggaaanagtcaccctctcctgcagggccagtcagagtgttagcgcggcttagcctggtaccagcagacacctgggcagactcccaggctcctcatttangctgcatccacagggccatggtatcccagccaggttcagtggcagtgggtctgggacagagttcactctcaccatcagcagcctgcagtctgaagattgtgactaatttattactgtacagcaatataatacctggcctcgctcacgtttcggcggagggacctaaggttcgagatcaaacgactagtggctagcacntcg

SEQ ID NO: 41431 - DNA, 524 bp, Homo sapiens
  misc_feature: GYAE6OF01EAHA2.26.60.F05.1.454.CMB.1.raw
  modified_base (201)..(201): a, c, t, g, unknown or other
  misc_feature (201)..(201): n is a, c, g, or t
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (521)..(521): a, c, t, g, unknown or other
  misc_feature (521)..(521): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaangtcaccatctcctgtcgggccggtcagagtattagcagcaacttagcctggcaccagcagaaacctgggcaggctccagctcctcatttangctgcatccaccagggccactggtatcccagccaggttcagtgcagtggtctgggacnggagttcacgtctcacatcagcagcctgcagtctgaagtattgtgtactaattttattacctgtcagtacaattataattaccctggcccttaccgcttacctacgtttcgggacggtacgggaacctaagggttgagatacaaacgtacgtacgtacggctagcaccgtntcg

SEQ ID NO: 41432 - DNA, 513 bp, Homo sapiens
  misc_feature: GYAE6OF01AY4I1.26.60.F05.1.454.CMB.1.raw
  modified_base (202)..(202): a, c, t, g, unknown or other
  misc_feature (202)..(202): n is a, c, g, or t
  modified_base (493)..(493): a, c, t, g, unknown or other
  misc_feature (493)..(493): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagngtcacatctcctgtcgggccgtcagagtatagcagcaacttagcctggcaccagcagaacctgggcaggctcccaggctcctcatctttgatgccgtccaccgagggcccacgttcggtttccccagcctaggttcagtggcagtgcgtctgcgacagtagttcactctcaccatcaacagcctgcagtctagaagtattttgctagtttattactgtcagcagtatcatgacgtcggccgctccgaccgttcgggccggggacacgggctacggaaacctaaacgactgnggctcgcacatctgtcttac

SEQ ID NO: 41433 - DNA, 581 bp, Homo sapiens
  misc_feature: GYAE6OF01AZOJP.26.60.F05.1.454.CMB.1.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
  modified_base (409)..(409): a, c, t, g, unknown or other
  misc_feature (409)..(409): n is a, c, g, or t
  modified_base (464)..(464): a, c, t, g, unknown or other
  misc_feature (464)..(464): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatgtgctgacgcagtctccagccaccctgtctgcctctccgaggggaaangtcacatctcctggtcgggccgtcagagtattagcagcaacttgcctggcacagcagaacctgggcaggctccaggctcctnatctttgatcgccgtccacgagggcccacgttcggtttcccagtcccgtaggtttcacggtcggactaggtcgccgtcgtggaccgtacaggtacgtttccacttcctacaaccctataccaacncgcctgacagtctagaattgtttgacttagttttactacgtgtacagtctaagtntacgatcggtacgtcggcctctccgtaccgttccggaaccggaagggtaccaacggtcgttaacggagtaaacggttaaaccgacgttggcgtactacgaccactcgttcgttaacg

SEQ ID NO: 41434 - DNA, 769 bp, Homo sapiens
  misc_feature: GYAE6OF01CZ4G6.26.60.F05.1.454.CMB.1.raw
  modified_base (235)..(235): a, c, t, g, unknown or other
  misc_feature (235)..(235): n is a, c, g, or t
tcagagactatactcacgaccggtgctcgatttagtacgtcatcagggaaagggggaggaactgctcagttaggaccagacggaacatggaagcccagcgcgacgcttctcttcctcctggctactctgctccagactaccacgtggaccaaaatgtgctagacgtcagtctccagccaccctgtctcgcctctccaggggaacagtcacatctcctgtcgggccgtcagagttntacggcagcaacgtagcctaggacaacagtacagaacctggcacggactacccgagggactcctcgacttcttgatcgtcgtccaccgacgggcctacgttcggttttacccagtacccgaagggtttccgacggtcggtctaaggttcgacggtcgtacggacgtacgaggtaacgtttcggaactcgtaactaccactacgtaaccaacgtccttcgacgtacgtacgttacgtaaacgttaaccgttttacgtaaccgttaaggtttttaacgtttaaccgttacgttaaccgttaacggtaaccttaaaactttaacgtttaaaacgtttaccgttacggttaccgtttacgtttccgggttttaaccggggtacccgggggttaaccgttaaccggggtaccggttacggggtaaacgtaacggtaaccgtaaaacccggttaacgtttacgggaaaccgtttaccgggtaccgtaaccggttaacgttaccgttacggtaaccttttccgtaaccggttttacccccg

SEQ ID NO: 41435 - DNA, 658 bp, Homo sapiens
  misc_feature: GYAE6OF01CNS0T.26.60.F05.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (290)..(290): a, c, t, g, unknown or other
  misc_feature (290)..(290): n is a, c, g, or t
tcagagactatactcacgaccggtgctcgatttagtacgtcatcagggaaagggggaggaactgctcagttaggacccagacggaaccatggaagcccagcgcagcttctcttcctctgctactctggctcccagataccactggacaaaatagtgctgacgcagtctccagcccaccctgtctgcctctccgaaggggaaanagtcaccatcctcctgtcgggccggtnagagtattagcagcaacttagcctggcaccagcagaaacctggcaggctccaggctcctnattcttgactgccgtccaccgagggcccacgttcggtttccccagccgtaggttccaggtcggtcaggtcgccgttctggaccgacgtagtacgtttccaaccttcctaccaaccctattaccgaacacgtccctacgactacggttactaggtaaacgttagtttttggacctttaaggtttttaacttacgttagtaccgtaagtacgtaagttacttcgtaagttcgaaccggtcggtcccgtcttaccgtacccggtttccgggaaccgtaacgggacccgtaacggacgtacgggaaagttaaacggtttaaaacccggaggttacggtcggtaccgtaggaaccctactacgttaccgttcg

SEQ ID NO: 41436 - DNA, 475 bp, Homo sapiens
  misc_feature: GYAE6OF01CYYH5.26.60.F05.1.454.CMB.1.raw
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (463)..(475): a, c, t, g, unknown or other
  misc_feature (463)..(475): n is a, c, g, or t
tcagagactatactcacgaccggtgctcgatttagtacgtcatcagggaaaggggctggcgtgggtctcaagtattgatgagaatggtggaagcacattctacgtagactccgtgaagggccgcttcaccatctccagagacaatttcaggagcacgctgtttctgcaaatgaacagcctgagagccgaggacacggccctctatttctgtgcgaaagtctatagcagtgccccctagcgcacttctttgacttcgtgggcaagggaatcctggtcaccgtctccctcagccctccaccaacgggcccatccggtccttcccctggccnccctgcctccgaggacncacctccgagacgcacagccggcccgtcgggcttcgcccgtggtaccaaggtaccttaccttcccagttatacgtctcgtggacggcgggcgtggaccgaaggtccgacgagtacgnnnnnnnnnnnnn

SEQ ID NO: 41437 - DNA, 502 bp, Homo sapiens
  misc_feature: GYAE6OF01C57TV.26.60.F05.1.454.CMB.1.raw
  modified_base (200)..(200): a, c, t, g, unknown or other
  misc_feature (200)..(200): n is a, c, g, or t
  modified_base (374)..(374): a, c, t, g, unknown or other
  misc_feature (374)..(374): n is a, c, g, or t
  modified_base (495)..(495): a, c, t, g, unknown or other
  misc_feature (495)..(495): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccgtcagagtattagcagcaacttagcctggcaccagcagaaacctgggcaggctcccaggctcctcatctttgatgcgtccaccagggccactggtttcccagccaggttcagtgcagtgcgtctgcgacagagttcactctcaccatcaacngcctgcagtctgaagtatttgctagtttattactgtcagcagtatcatgactggcctctcaccgttcggacctaagggaccacgacgtggagtaattaaacgactgtcggctagccacctntcgtacg

SEQ ID NO: 41438 - DNA, 566 bp, Homo sapiens
  misc_feature: GYAE6OF01EK0WD.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctcctcatctttgatgcgtccaccagggccactggttcccagccaggttcagtggcagtgcgtctgcgacagagttcactctcaccatcaacagcctgcagtctagaagtatttgactagtttattactgtcagtctagtatctaatcgacgtcggtccgtctaccgtacccgttccggacccgaaacggggtaccaaccggtacgttacgggaacgtaaacgtttaaaaccggaacgttaggttacgggtacctacggaccctaacccgtagttccgttacg

SEQ ID NO: 41439 - DNA, 529 bp, Homo sapiens
  misc_feature: GYAE6OF01C66EJ.26.60.F05.1.454.CMB.1.raw
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccgacgggccactggtttcccagccaggttcagtgcagtgcgtctgcgacagagttcactctcaccatcaacacgccctgcagtctagaagtattttgctagtttacttactgtcagctagtatcatcgacgtggccnctaccnccgttcggacctaagggaccacggacgtgggaagttaagtaaacgacgttggtacgtcgtacgccaacctgttcgttacg

SEQ ID NO: 41440 - DNA, 534 bp, Homo sapiens
  misc_feature: GYAE6OF01CMY26.26.60.F05.1.454.CMB.1.raw
  modified_base (201)..(201): a, c, t, g, unknown or other
  misc_feature (201)..(201): n is a, c, g, or t
  modified_base (375)..(375): a, c, t, g, unknown or other
  misc_feature (375)..(375): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtatagcagcaacttagcctggcaccagcagaacctgggcaggctccaggctcctcatctttgatgcgtccaccaggccacgtcgttcccagccaggttcagtggcagtgcgtctgcgacagacgttcacgtctcaccatcaacncgtcctgcagtctagtaagtatttgcttagtttatactgtcagctagtatcattcgacgtcggcctctcgtacccgttcgggaccgtaagggacctacgtacgtgggaagtaacgttaaaacgacgttggtacggtctacggacctacctgttcgttcg

SEQ ID NO: 41441 - DNA, 574 bp, Homo sapiens
  misc_feature: GYAE6OF01ADKND.26.60.F05.1.454.CMB.1.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (439)..(439): a, c, t, g, unknown or other
  misc_feature (439)..(439): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgccctctccgaggggaaanagtccaccatcctccgtggtccggggccgtcagagtatagcagcaacttagcctggcaccagcagaacctgggcaggctcccaggctcctnatttangctgcatccacgacgggccacgtggtactcccagccaggttcaggtggcaggtgggtctgggacaggtacgttccacttctccaccatcgagcagcctgcgagttctagaagtattgtagtactaatttattactgtanagactaattaattaacgtaccgtggtccctcgtccttacgtaccgtttccgggacgggtaccgggacgttaagggttcgaagtacgtaacgtaaaccggtacgttggtacggtctacggacctacccgtattccg

SEQ ID NO: 41442 - DNA, 520 bp, Homo sapiens
  misc_feature: GYAE6OF01CVXXU.26.60.F05.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (375)..(375): a, c, t, g, unknown or other
  misc_feature (375)..(375): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaaatagtgctgacgcagtctccagccaccctgtctgcctctccaggggaaangtcaccatctcctgtcgggccgtnagagtattagcagcaacttagcctggcaccagcagaaacctgggcaggctccaggctctcatctttgatgcgtccaccagggccactgtttcccagcccaggttcagtggcagtgcgtctgcgacagtagttcactctcaccatcaacngcctgcagtctgaagtatttgactagttttatactgtcagctagtatcatgactggccgtctccacttccggaccgtaagggaccacggacgtgggaataagttaaaaccggacttaggtacggctacgacaccgattcgttacg

SEQ ID NO: 41443 - DNA, 508 bp, Homo sapiens
  misc_feature: GYAE6OF01E1JQG.26.60.F05.1.454.CMB.1.raw
  modified_base (200)..(200): a, c, t, g, unknown or other
  misc_feature (200)..(200): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgcctctccaggggaaangtcaccatctcctgtcgggccgtcagagtattagcagcaacttagcctggcaccagcagaacctgggcaggctcccaggctcctcatctacggaacatccaaccgggccactggcatcccagacaggttcagtggcagtgggtctgagacagacttcactctcactatcagcagactggagcctgaagtatttgctagtgttattactgtcagcagtatgctacctctactttcccgtgtacttttcggccgtaggggaccaagcgtaggatatacgaaacgacgtgtacggctacgacactatctcg

SEQ ID NO: 41444 - DNA, 730 bp, Homo sapiens
  misc_feature: GYAE6OF01CVYXS.26.60.F05.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggctcccagataccactggacaaaaatagtgctgacgcagtctccagccaccctgtctgcctctcgaggggaaangtcaccatctcctggtcgggccgtnagtagtattagcagcaacttgcctggacaccagcagaacctgggcaggcctcccgaggcctcctcattctttgactgcctccaccgagggccctacgttcggttaccccagtcccgtaagggtttccaggttcgggacctaggtcggtaccgttcgcggaccgtaaccgtaggtaacgttttcccaaccgttcctaccaaccctataccaaccgtacgtcccgtcgaccttacggtacttacggtaaacgttacgtttttacgactttaaggtttttaacttaacgttcgttaccgtaacgtactaggttacttaccgtacgttacggtaaccgttcgggtaccccgttcgttaaccccgtaccggttcccgggaaccgtaacggggtaaccctaaccgggtaacggttaacgggtaaacggttaaacggtttaaaacccgggtaacgttacgggttacgggtacccgtacgtaacccgtaacctacggtttccgtttaccgg

SEQ ID NO: 41445 - DNA, 581 bp, Homo sapiens
  misc_feature: GYAE6OF01C9ZFB.26.60.F05.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccgtnagatatagcagcaacttagcctggcaccagcagaaacctggcaggctcccaggctcctcatctttgatgcgtccaccgagggccacgtcggtttcccagccaggttcagtggcaggtgcgtctgcgacagtacgtcactcctcaccatcaacgacgcctgcagtactgaagttattttcggacttagtttattactgttacagtcagttactacattacggactggcccgtcttccgtaccctttccgggacccaaacggggtaccctacggtaccgtagggtaacgttaacgttaaaacggaaccgtttgggtacggtaccgttacgacctaaccccgtgttcccgtttaccgg

SEQ ID NO: 41446 - DNA, 594 bp, Homo sapiens
  misc_feature: GYAE6OF01AOSX2.26.60.F05.1.454.CMB.1.raw
  modified_base (202)..(202): a, c, t, g, unknown or other
  misc_feature (202)..(202): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagccaccctgtctgcctctccgaggggaanagtcaccatctcctgtcgggccgtcagagtatagcagcaacttgcctggcaccagcaagaaaccgtgggcacggcctcccaggcctcctcattctttgatcgccgtccaccgacgggccctacgttcggtttccccacggtccgtagggtttccaggtcggctaggtcgcgtctcggacgactaggtacgtttcacttctaccaccactaccgaactacgtcctcgactacgtcgtagtaagttacttttcgacgttaagttttacttacgttgtactagtactaagttactactagtcgtacgtcggtccgtctaccgtaccgtcggaccgacggacacggtacgtacggaagtaacgtaacgacgtgtacgtctacgaccactgtcgtcg

SEQ ID NO: 41447 - DNA, 515 bp, Homo sapiens
  misc_feature: GYAE6OF01B5HJQ.26.60.F05.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagcccaccctgtctgcctctccaggggaaangtcaccatctcctgtcgggccgtnagagtattagcagcaattgcctggcacagcagaacctggcaggctcccaggctcctnatctttgatgcgtccaccaggccactggttcccagccaggttcagtggcagtgcgtcngcgacngagttcactctcaccatcaacngcctgcagtctagaagtatttgctagtttatactgtctagctagtatcattgactggccgtctccgtaccgttcggaccgaagggaccacgacgtcggaagtaacgttaaacgacttggtacgacttacgacaccgtatcgttacg

SEQ ID NO: 41448 - DNA, 589 bp, Homo sapiens
  misc_feature: GYAE6OF01B2TXQ.26.60.F05.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
tcagagactatactcacgaccggtgctcgatttagtacgtcatcaggggaaagggggaggaactgctcagttaggacccagacggaaccatggaagccccagcgcagcttctcttcctcctgctactctggctcccagataccactggacaaaatagtgctgacgcagtctccagccaccctgtctgcctctccgaggggaangtcaccatctcctgtcgggccgtnagagtatagcagcaacttgcctggcaccagcagaacctgggcaggcctccgaggtcctcctcattctttgatcgccgtccacgagggtcctacgttcggttcccagccctaggttccaggtggcaggtcgcgtctggcacagtagttccacgtcctacacctataccaacgacgtcctagctagtctagtaagttattttgactttagttttacttacgtcgtacacgtactagttatacgtagtacgtacgtccggtcctcttaccgtaccgttaccggaccgtaacgggacctacggtacgtacgggtaagtaaacgttaaacggacgttagtacggtactcgacctacctgtccgttcg

SEQ ID NO: 41449 - DNA, 567 bp, Homo sapiens
  misc_feature: GYAE6OF01CR7BO.26.60.F05.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (289)..(289): a, c, t, g, unknown or other
  misc_feature (289)..(289): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagccaccctgtctgcctctccaggggaaanagtcaccatctcctgtcgggccggtnagagtattagcagcaacttagcctggcaccagcagaacctgggcaggctcccgaggctctnatctttgatcgcgtccacgagggcctacgtcggttcccagtccagggttccagtcggcaggtcgcgtctgcgacagtacgtttcacgtctcaccatcaacagcctgcagtctagaagtactttgactagtttactacgtgttcagctaagttatcagtcgtagtcggccgtacttccgtaccgttccggacgtaacgggacctaaccggtacgtagggaaataacgttaaaaccggacttagggtcggtaccttggaccctaactaagttccgttacg

SEQ ID NO: 41450 - DNA, 690 bp, Homo sapiens
  misc_feature: GYAE6OF01CPQNY.26.60.F05.1.454.CMB.1.raw
  modified_base (200)..(200): a, c, t, g, unknown or other
  misc_feature (200)..(200): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggaangtccaccctctcctgcagggccagtcagagtgttagtcgcggtcttagctggaccagcagacacgtggacacgacctccaggctcctctatttagcgactgaccacgtcccgaccggggctaccgtggtactcccgacgtccgtacggttcgaggttcggacgtaggtcgggtcgtagggactagacggttcacttcgtaccacgtatcgagtacacgtcctgcgtacgtactagaacgtagttacggtagtacttaaagttttacttaccgttacgttaccgaagtaacgtaaactttaagttaaaccttacccggtaccggttacccctacccgggtaccttacccgttacccggtttacccgggtaacggggtaaccgggtaaacccgttaaaggggttacggtaaaacgtacggttaaaccgaaaccggtaaccggttagggttacggtaccgttacgacccttaaccgtagttacccgtttacgg

SEQ ID NO: 41451 - DNA, 580 bp, Homo sapiens
  misc_feature: GYAE6OF01DY5NS.26.60.F05.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
  modified_base (402)..(402): a, c, t, g, unknown or other
  misc_feature (402)..(402): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctggtcgggccgtcagagtatagcagcaacttagcctggcaccagcagaacctgggcaggctccaggctcctcatctttgatgcgtccaccngggccactggtttcccagccaggttcagtggcagtcgcgtctggcgacagtagttcaccgtctcacctatcaactacgcctgctagttctgaaagtnttttgcttagttttatactgtcagtctagtatcgattgacgtcggccgtcttacccgaccgtttaccgggaccgtaaacgggacctaacggtaccgtaggggtaaagtaaacgtttaaaaccgggaactttacgggacggtacccgttacggaccctaaccgtcgtttcgttacccgg

SEQ ID NO: 41452 - DNA, 539 bp, Homo sapiens
  misc_feature: GYAE6OF01DQAMW.26.60.F05.1.454.CMB.1.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccgaggggaaanagtcaccatctcctgtcgggccggtcagagtattagcagcaacttagcctggcaccagcagaaacctgggcaggctccaggctcctnatctttgatgcgtccaccgaggccacgtggttcccaggtccaggttcagtgcagtgcgtntgcgacagtgttacactctacaccatcaacncgcctgacagtcgtagaactntttcgacttagtttatctgtcagtctagtatctatgacctggccctacgttccgaccgttccggaccgtaaagggcctaacggacgtaggaagttaacgttaaaccgagttggacggtctacgaccactctcgttacg

SEQ ID NO: 41453 - DNA, 534 bp, Homo sapiens
  misc_feature: GYAE6OF01DY2SO.26.60.F05.1.454.CMB.1.raw
  modified_base (201)..(201): a, c, t, g, unknown or other
  misc_feature (201)..(201): n is a, c, g, or t
  modified_base (375)..(375): a, c, t, g, unknown or other
  misc_feature (375)..(375): n is a, c, g, or t
  modified_base (527)..(527): a, c, t, g, unknown or other
  misc_feature (527)..(527): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctccaggctcctcatctttgatgcgtccaccagggccactggtttcccagccaggttcagtggcagtgcgtctgcgacagattcactctcaccatcaacngcctgcagtctagtaagtattttgacttagttttaattactgttacagtctaagttatcatgacgtggccgtctccgacccgttcggaccgaacgggaccacggacgtaggagtaacttaaacggaactggtacggtctacggaccaacctntcgttcg

SEQ ID NO: 41454 - DNA, 604 bp, Homo sapiens
  misc_feature: GYAE6OF01ANK72.26.60.F05.1.454.CMB.1.raw
  modified_base (202)..(202): a, c, t, g, unknown or other
  misc_feature (202)..(202): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccgaggggaaanagtcaccatctcctgtcgggccgtcagagtatagcagcaacttagcctggcaccagcaagaacctgggcaggcctcccgaggcctcctcattctttgatcgccgtccaccgacgggccctacgttcgggtttaccccaggtccctagggttccaggttcggacaggtcgcgtcgtgcgtacgagtacgttcaccttctacacctatccaaccacgtcctgcgtacgtctaggtaagttattttcgacttagtttacttacgtgtacgtagtcgtaagttactctagtcggtacgtccggtcctcctaccgtaccgttccgggaccgaacgggaccgtacggacgtacggaacgttaacgtaaacgacgttaggtacggtctacgacctacgtagtcgttacg

SEQ ID NO: 41455 - DNA, 616 bp, Homo sapiens
  misc_feature: GYAE6OF01BKDQD.26.60.F05.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (429)..(429): a, c, t, g, unknown or other
  misc_feature (429)..(429): n is a, c, g, or t
  modified_base (588)..(588): a, c, t, g, unknown or other
  misc_feature (588)..(588): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatgtgctgacgcagtctccagccaccctgtctgcctctccgaaggggaaanagtccaccatctcctggtcgggccgtnagagtatagcagctaacttgcctgcacagcaagaacctgggcacggcctccgagcctccgtatacttcgttgacgttcgccgtaccgaccgtaggccctacgttccggttaccccaggtccgtaggttcagggttcgacgtaggtcgtcgtacgtggaccgtagtacgtacgttccacgttcctaccacgataccaacncggtcctgacagttcaagtaagttgttttagactttagtttacttcgtgtactagtactaagttatacgtacgtgtaccgtccgggtaccctccgttaccgtacccgttaccgggaaccgaacgggacctaccggtagacggtaactaaacggtaacgngtcggcgtactacgaccactgtcgttcg

SEQ ID NO: 41456 - DNA, 703 bp, Homo sapiens
  misc_feature: GYAE6OF01CLMDR.26.60.F05.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
tcagagactatactcacgaccggtgctcgatttagtacgtcatcaggggaaagggggaggaactgctcagttaggacccagacggaaccatggaagccccagcgcagcttctcttcctcctgctactctggcctcccagataccactggacaaaatgtgctgacgcagtctccagcccaccctgcctgcctctccgaaggggaancgtcaaccgtntcctccgtggtccggggccgtcagagttattaggcagactaacttacgcctggccaccagacaacgaaccgtgggaccaggcctcccgacggtcctcctctattccttgacttcgccgtccaccggcggacctacgtcggtttcccacggtcctagggttctaggtcggactagtcgtcgtacgcggtacgactaggtacgttccgacttcctaccaaccgtctaaccaaccgtcgtaccgtacgtaccgtacggttacgtacgtaacggttattttaccggtactttaaggtttttacttacgttcgttaacgtacgtacttagttacgttaactacgttacggtaccgttcggaccgttacgtacccgttaccggttaacccggaccgtaacggggtaccgtaaccgtacggtacggtaacgtaaaccgttaaacggtccgttagggtaccggtacgtacgacccgttaactcgttccgttaccg

SEQ ID NO: 41457 - DNA, 620 bp, Homo sapiens
  misc_feature: GYAE6OF01C74A9.26.60.F05.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (279)..(279): a, c, t, g, unknown or other
  misc_feature (279)..(279): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (604)..(604): a, c, t, g, unknown or other
  misc_feature (604)..(604): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagccaccctgtctgcctctccgaggggaaanagtcaccatctctgtcgggccggtnagagtatagcagcaatgctggcacagcagaactggcagctccgaggctctnatctttgatgcgtccacgcggccacgtcgttcccagcctaaggttcagtggcaggtcgcgtntcgacganggtattcactctacaccatccaaancgcctagcctagggtctagtaaacgttgttttcgacttagttttaacttcgtacgtctaaggctaagttactacgtaacgttacggaaccgttcgggcccttacttacccgtacccggttaccgggacccgtaaacggggacctaaccgggacggtaacgggtaaacgttaaacgtttaaaacccggaacggtttgggtaaccggtccgtaacggacccttaaaccccgngtttccccgtttaacg

SEQ ID NO: 41458 - DNA, 633 bp, Homo sapiens
  misc_feature: GYAE6OF01EK02K.26.60.F05.1.454.CMB.1.raw
  modified_base (201)..(201): a, c, t, g, unknown or other
  misc_feature (201)..(201): n is a, c, g, or t
  modified_base (332)..(332): a, c, t, g, unknown or other
  misc_feature (332)..(332): n is a, c, g, or t
  modified_base (624)..(624): a, c, t, g, unknown or other
  misc_feature (624)..(624): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccgagggaagngtcaccatctctgtcggccgtcagagtatagcagcaacttgccgtgcaccagcgaacgaaccgtggacacggcctccgaggcctcctctattcttgattcgccgtccacgacggcctcgttcggttacccngccgtaggttcgaggtcggcaggttcgcgtcgtggaccgtagagtacgttaccaccttccgtaccaacctactaccaaactcgtcccgtagaccgtacgttcgtaacggtaagttagtttttcgaactttagtttttaactaccgttgttaccaggttactaggttaactcgtaagttcgtaccgtcggtcccgttctaccggtacccggtccggaacccgaagggtaccaaccggtacggtaggaacgttaaacggttaacgaacgttggtacgtccacggtaccacgttntcgttaccg

SEQ ID NO: 41459 - DNA, 687 bp, Homo sapiens
  misc_feature: GYAE6OF01AY6W5.26.60.F05.1.454.CMB.1.raw
  modified_base (204)..(204): a, c, t, g, unknown or other
  misc_feature (204)..(204): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagcccaccctgtctgcctctccgaggggaaangtcaccatcctcctggtcgggccggtcagagtattagcagcaacttagcctggccaccagcacgaaaccgtgggcacgggcctcccgaggccttcctcattcctttgacttcggccgttacccaccgacggggtccctaacgtttccggttttaccccgacggtcccgtaggggtttccagggtcgggcctagggttcggtccggttcgtggccggaacgtaggtaacgtttccaccttcctaccaacctactaccaacgccggtcctaggcctaggttcctaggtaaagttacgttttacggactttaagttttacgttacgtgtaccgtagctaagttactactagttacggacgtcggtcccgtacttaccgtacccggttaccggaccggaaacgggcctaacggtacggtaggtaaccgtaaacgttaaaccggtacgtacggttacggaccttacgaccctacgtcgttcgttaccg

SEQ ID NO: 41460 - DNA, 540 bp, Homo sapiens
  misc_feature: GYAE6OF01E00YY.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctccctgtcgggccggtcagagtacttagcaagcaacttagcctggcaccagcagaacctgggcaggctcccaggctctcatctttgatgcgtccacaggccactggttcccagccaggttcagtgcagtgcgtctgcgacagtacgttcactctcaccatacaacacgcctcgcacgtctagaagtattttcgctagtttacttacgtgtcgacgtcagtactacagtacgacgtcggacctctaccacccgttcggaccgtaaggaccgacgacgtggaagtaacgttaaaccgacgtcggtacggtctacggaccactatcgttacg

SEQ ID NO: 41461 - DNA, 856 bp, Homo sapiens
  misc_feature: GYAE6OF01AEY9M.26.60.F05.1.454.CMB.1.raw
  modified_base (206)..(206): a, c, t, g, unknown or other
  misc_feature (206)..(206): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatgtgctgacgcagtctccagccaccctgtctcgcctcgtccgaaggggaaacncgtccaacctagttcctccgtgggtccggggcccggttacaaggtacgttaagttacggctaacggtacctaaaaccgtttacggccccgttagggacccaaacccgaggtaccaaaacggtaaaaccccggttgggggaaccaaccggggtcccttaccccgaagggtccccttaccccttaattaaccgtttccgttttaggacttccggacccgttacccgaaccgggaccgggtacccttacgtttccgggtttacccccaggttacccgtacggttacgacggttcggactcgggtcgtaccgttcgtacggtacgtaacgtaggttaccgtttacaacccgttactacccgaacctacgttaacccgaacgtaccgtacccgttcggtaaccgttacggttacgttaaggttaacgttacgttttacgactttacgttttaacgttacgtagttactacggtactacgttactctaacgtcgtaaccggtccggtaacccgttaccgttacccgtacccggttaccggaaccggtaaccggtaacgtaacccgggtacgtaacgggtaaccgttaaacggttaaacggtaaccgttaggtacgggtaccttaccggtaacccgtacttacggttccgtttaccg

SEQ ID NO: 41462 - DNA, 576 bp, Homo sapiens
  misc_feature: GYAE6OF01EOGD3.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaangtcaccatctcctgtcgggccggtcagagtatagcagcaacttagcctggcaccagcagaaacctgggcaggctcccaggcctcctcatctttgatgccgtccaccgagggcctacgttcggtttcccagcctaggttcaggtcggcagtgcgtctgcgacagagttcacttctcaccatccaacacgcctgcctagtctaggtaagttattttacgacttagttttaacttacttgtacagtctagtactctagtcgacgtcggccctctaccgtacccgttaccgggaccgtaaacggggaccaacggtacgtacgggtaagtaaacggttaaacggacgttggtacggtctacgaccaccgtagtcgttacg

SEQ ID NO: 41463 - DNA, 576 bp, Homo sapiens
  misc_feature: GYAE6OF01AVUI7.26.60.F05.1.454.CMB.1.raw
  modified_base (201)..(201): a, c, t, g, unknown or other
  misc_feature (201)..(201): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaangtcaccatctcctgtcgggccggtcagagtattagcagcaacttagcctggcaccagcagaacctgggcaggctcccgaggcctcctcattctttgattcggccgtccaccgacgggccctacgttcggtttccccagtcccgagggttccaggtcggcaggtcgcgtctgcgacagacgttcactctcacatcaacngcctgcagtctagtaagtntttgacttagtttactacgtgtacagtctagtactctagtgtacgtcggccgtcttaccgtacccgttccgggaccgtaacgggtaccaacggtacgtacgggaagtaacgttaaacgacgttggtacggtactacggacctaacctcgttcgttacg

SEQ ID NO: 41464 - DNA, 582 bp, Homo sapiens
  misc_feature: GYAE6OF01EBVWT.26.60.F05.1.454.CMB.1.raw
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagcccaccctgtctgcctctccgaaggggaaanagtccaccatcctccgtggtccgggccggtcagagtattagcagcaacttagcctggcaccagcaacgaaccgtgggcaggctcccgaggctcctnattctttgattcgccgtccacgaggcctacgttcgttcccagtcctaggttcagtggcagtcgcgtcngcgangtctcactcncactanccaacncncctgctacgtctagaagttatttcgacgttagtttacttacgtgttcagtctagtatctagtcgtacgtcggtcctctaccgtacccgttcggaaccgtaacgggaccaacgggtacgtacgggtaagtaaacgttaaacggtaacgtcggtacggtactacggacctaccgtagtccgttacg

SEQ ID NO: 41465 - DNA, 925 bp, Homo sapiens
  misc_feature: GYAE6OF01EK8OL.26.60.F05.1.454.CMB.1.raw
  modified_base (208)..(208): a, c, t, g, unknown or other
  misc_feature (208)..(208): n is a, c, g, or t
tcagagactatactcacgaccggtgctcgatttagtacgtcatcaggggaaagggggaggaactgctcagttaggacccagacggaaccatggaagccccagcgcagcttctcttcctcctgctactctggcctccagataccactggacaaaatagtgctgacgcagtctccagcccaccctgtcctgccctctaccgaaggggaanagtccacctatcctccgtggtccgggccggtcaagagttagttacgcaagtactaacttagccctggccaacagcgaagaaaccgtgggacacggtcctccgagtcctccctactacttctttagacgttccggaccgtacccgaaccggaccggtcccctacggtttacccggtttcccaaccgggtcccttaacggggttacacggttcgggaccgtaggttcggtcccgttacgtacgggaccgtaacggtacgttacgttacccaacgttcctaacccctaaaccgaacgttacccaaaccggacccgtccgacggttacctaaggttcccggttaagttaaaacggttttcgttttaacgtaacggttttaagtttttaaccgttacgtacggtaaccgtacgggtaaccttaacggttaacttaccgtaagttaccccgggtttaccgacccgggttcccccgttaacccgttaacccccggggttacccgtttaaaacccccggggggaacccgggtaaaaaccgggggtttaaccccaaaacccggggggtttacggtttaaaacccggggggtaaaaacccgttttaaaaacccggttttaaaaccccgggggtaaacggttttcccggggggtcccgttaaaccccggttaccggttaaaaaccccgttacccggtttttaaccgttcccgggtttttaaacccccg

SEQ ID NO: 41466 - DNA, 870 bp, Homo sapiens
  misc_feature: GYAE6OF01AW4S8.26.60.F05.1.454.CMB.1.raw
  modified_base (211)..(211): a, c, t, g, unknown or other
  misc_feature (211)..(211): n is a, c, g, or t
tcagagactatactcacgaccggtgctcgatttagtacgtcatcagggaaagggggaggaactgctcagttaggacccagacggaaccatggaacgccccagcgcagcttctcttcctcctgctactctggcctcccagactaccactggacaaaatgtgctgacgcagtcctccagcccaccctgtcctgcctcgtaccgaaggggaaancgtccaaccatcctccgtggtccgggccggtcaggtagttattacgcagtacaacttacgccgtggaccaaccgagaccaacggaaacccgtggggacctagggccctacccgaaggtccttccctacgtactttccgttttggacttcggacccgttacccgaaccggcggggtaccctaccggtttcggtttaccccaacgggtcccgtaaggtttccgaacgggttcgggaccgtaggtcgggtcccgttacgtcgggaccggtaacgtacggttaccgttacccgacttacccgtaccaaacccgttaacgtacccgaaacgtaccggtacccttacggtaccggttaacgttacccgtaagggttaaacgtttacgtttttaacggacgttttaaacgttttaccgttaacgttcggttaaccgtacggtaacgttaacggttactacgtacgttaccgtaccgggttacggaccccgttaccgtacccggttaaccccggttaccggggaacccgtaaacggggtaccgtaacccgggttaacggttaaacgggtaaaccttaaaacgggtaaacccggttaaacgttcggggttaacccggtaccggttaaccggaaccccttaaacccgttgggtttcccgtttaacccgg

SEQ ID NO: 41467 - DNA, 706 bp, Homo sapiens
  misc_feature: GYAE6OF01CKPHN.26.60.F05.1.454.CMB.1.raw
  modified_base (204)..(204): a, c, t, g, unknown or other
  misc_feature (204)..(204): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagcccaccctgtctgcctctccgaggggaaangtcaccatcctctggtccgggccgtcagtagtatagcagcaacgttagcctggcaccgagcaacgaaccgtgggacaggcctcccgaggcctcctctacttcgtttgacgttcgccgtacccgaccgacgggtccctacgttccggtttacccacggtccgtaggttcgaggtcggctaggttcgtcggtactcggacggtaacgtacgtaacgttccaaccttccgttaccaacctacgtaccaaaccgcgtacccgtagaccgtacggttactaggtaattacgttttacgtaactttaaagtttttacgtacgtaggtaacctaacgtaactaaattaacttaaccgttaccgtccgtaccccttaccgtcgttacccgttaccgggttcgggaaccggggtacggtaacccgtaaaggttggaaacgttacgtaaacccgtaaacggtacgttacgggtacggtacgtacgtacccgtaacttgttcgttcgttaccg

SEQ ID NO: 41468 - DNA, 687 bp, Homo sapiens
  misc_feature: GYAE6OF01CF73D.26.60.F05.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccgaggggaaanagtcaccatcctcctgtcgggccggtcagagtattagcagcacttagcctggcacagtagaacctggacagctccaggcctcctntatcgtttgagtcgcctccgacgacgggcctacgttcggtttacccagtacctagggttcaaggtcggacctagtcggcgttcgcggacgtaccgtaggtacgtttccacttacctccgaaccctaacgttacccgaaacgtaccggtcccgttacggaccgtacgttcgttaaggtaaacgtttacgttttacggactttacgtttttagtttaacgttacgtacgtaggtacctagtttaacgtactacgtacgtccggtacggtccgtaccgttccgtaaccggttccgggaaccggaacgggtaccgaaccggtacggtaacgggtacggtaaacgttaaacggtacggtacggtacggtacgtacggacctaccgtacgtttcctcggtttaccc

SEQ ID NO: 41469 - DNA, 783 bp, Homo sapiens
  misc_feature: GYAE6OF01AJ6IN.26.60.F05.1.454.CMB.1.raw
tcagagactatactcacgaccggtgctcgatttagtacgtcatcagggaaagggggagagaggagcccagccctgggattttcaggtgttttcatttggtgatcaggactgaaccgagagaactcaccatggaggtttgggctgagctggcttctttcttgtggtacttttttaaaaggtgtccagtgtgaggtgcaactgttggcgtcgtgggggagtacttggtacacccgtggggggtccctgacgacctctcctgtgcagcctctggattcctacctttagcctaactctgtcagtgggccgtgggtcccgcgagggccggtaccggggaggggctcggggcgtggtactacgtaagttagttggattagagtaagtgggtaggaacgccaacgtagtttaccgtaacggtacgaccgttccggtacggaacgggtcccgtacttacccgaaccgtacttacccgaccgtaaggtaaccgtaaccttaacgttttaccggaacggggaccgtaccgtaacccggtccgttttacggtttactacgaacccgttaaagtaccggaaacctacggtaccgtaggacggtaaccgacccgggtaacggaacccgtacccgggtaccctttacgttacttttccgaggttaccgaacggttaaactcgttaaacgtcgacccgtaccggttccccgaccccccggttacgacccggtaccctttacccgttttaccgtttaccggtaaccctttccggggttccggggaaacgtaaaccgggg

SEQ ID NO: 41470 - DNA, 740 bp, Homo sapiens
  misc_feature: GYAE6OF01COYEW.26.60.F05.1.454.CMB.1.raw
  modified_base (437)..(437): a, c, t, g, unknown or other
  misc_feature (437)..(437): n is a, c, g, or t
tcagagactatactcacgaccggtgctcgatttagtacgtcatcagggaagggggaggaactgctcagttacggaccagacggaaccagtggaacgcccagcgcagcttctcttcctcctgctactcgtcggcctcccagactaccacgtcggacaaaagtgtcgctcgacgcacgtctccagcctaccgtgtctcgcctcgtaccgaaggggaatcgtaccactactcgtccgtacggtccgggccgtgagtagtattacggacagtactaacgttacgccgtcgactacgagacgaacggtaaccgtggggaccacgtccgtaccgagtccttacgcttagttcgtttacgacgttccggaccgtacccgaacggtaccgggtccttaacggttccggtttacccaacggtccgttaaggggtcctaggggtccncgtagggcggtacgtcggtagaccgtacggacgtttctcccgtactacctaccggactaacgtaccacgacgtccacgacttacgtgtaagtacttcgtttacgtacgtttacgttattacgtacggttacacgtacttagtacgtacgttacgtacggtaaccgtcgggaccccttacggttacccgtaccgggttaccggacggtaacggtacccgaggttaacggtaacggttaacgggttaaaccgttcggaacggttccggtaggtaccgtagtacccttacgtcgttacgttacccg

SEQ ID NO: 41471 - DNA, 741 bp, Homo sapiens
  misc_feature: GYAE6OF01A57ES.26.60.F05.1.454.CMB.1.raw
  modified_base (208)..(208): a, c, t, g, unknown or other
  misc_feature (208)..(208): n is a, c, g, or t
  modified_base (446)..(446): a, c, t, g, unknown or other
  misc_feature (446)..(446): n is a, c, g, or t
tcagagactatactcacgaccggtgctcgatttagtacgtcatcagggaaaggggaggaactgctcagttaggacccaggacggaaccatgggaagccccagcgcagcttctcttcctcctgctactcgtcggctcccagactaccactggcaaaatgtgctgacgcagtcctccacgccaccctgtctgcctcgtccgaaggggaancgtcacctatccgtcctgggtccgggacgtcgaggtacgttagttagccagctaacgtttgcccttggccaccgagaccgtacgtaaacccgtggggaccacgggccttaccacggtcctaccgtactactttacgtttgcgttccggtacctcccgaaccggaccgggtccctacggttccggttccccaaggtcccgtaggtttcgaacgggttcggaacgttcgggcgtcgttcncggaacgttacaggttaaccgttccacgttccaactaaccgtataaccgaacgaccgtaccgtcgtacgtacgtacgtaagtaacgttagtttacggtacttacgtttaaactttacgtttaaccgtggttaactaacgtactaaacgttaaccgttaacgtaccgttaccggtccgtacccgtcgttaccgtacggtttaccgggacgggtaccggtacgttaacggtacggtaaacgtacgttaaacgtaacgtaacgtcgtacgtacggtaccacgtacctacgtcgtaccg

SEQ ID NO: 41472 - DNA, 770 bp, Homo sapiens
  misc_feature: GYAE6OF01BEKRG.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagatatcactggagaaatagtgatgacgcagtctccagccaccctgtctgtgtctcccggggaaanacgccaccctctcctgcagggccagtcagagtgtggcagcaacttagcctggtaccaacgacgaaaccgtgggcacggcctcccgaggtcctcttctactcgtacggtcgcactccaccgagggcccacgtcggtacctccccgcgtacggttcagtcggctaggtcggggtcgtacgggggacgtacgtttccacgttcctaccgaaccgtagtccgacgccgtacggcccgttcggccgtacgttccgtacggtaagttacgttttacggtacgttagtttttaaccgttacgttacggttacgtacgtacgtaacgtttaaacgttaaaaaccgttccgggtacccgttacccgggttacgggtaacccgggtttacccgggtaaccgggtaaaccggggtaacccggttaaaggggttaaccgggtaaaacgttaaccggaaaacgggtaaccgttagggttacgggtaacccgttacggtaacccggtaacccgttaacgttacccgtttacgttacccgtttaccttaacccgtttccccgttaccccggtccgttaaacccg

SEQ ID NO: 41473 - DNA, 713 bp, Homo sapiens
  misc_feature: GYAE6OF01A25W2.26.60.F05.1.454.CMB.1.raw
  modified_base (202)..(202): a, c, t, g, unknown or other
  misc_feature (202)..(202): n is a, c, g, or t
  modified_base (694)..(694): a, c, t, g, unknown or other
  misc_feature (694)..(694): n is a, c, g, or t
tcagagactatactcacgaccggtgctcgatttagtacgtcatcagggaaagggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaangtccaccctctccgtgcgagggcccaggtcaggtacgttggttacggtccggcgggtctttacggccgttgggtacccagccgacgtaccaccggtgggaccacggtacctccccgagggccctttcccgtactagttttacgtcgctggccactcccggacgacgggtccacgttcggtactccccgagcccgtaggttcaggttcggcctaggggtcgggttcgtacgggactaggttacgttccgaaccgttcctccgacctagtaccgacgacctacggtcctacggcctacgtttccgtaggtaaacgttagtttcgtcgttaacttaatttttacttacgttacgttacgaacgtaacttaagttaaccgttaacttacccggttccggtaccctccgtacccttacgtccggtttcgggaccgggtaacgggtacgtacgggttcgaacgttctaaccgaaacggttacgtacggtacggtaccncgtaaccctacgtcttcgg

SEQ ID NO: 41474 - DNA, 543 bp, Homo sapiens
  misc_feature: GYAE6OF01BA4N4.26.60.F05.1.454.CMB.1.raw
  modified_base (292)..(292): a, c, t, g, unknown or other
  misc_feature (292)..(292): n is a, c, g, or t
  modified_base (526)..(543): a, c, t, g, unknown or other
  misc_feature (526)..(543): n is a, c, g, or t
tcagagactatactcacgaccggtgctcgatttagtacgtcatcagggaaaggggctggcgtgggtctcaagtattgatgagaatggtggaagcacattctacgtagactccgtgaagggccgcttcaccatctccagagacaatttcaggagcacgctgtttctgcaaatgaacagcctgagagccgaggacacggccctctatttctgtgcgaaagtctatagcagtcgccccctacgcgcacttctttgacttcgtggggcaagggactccgtggtcaccgtctcctcncgccctccgaccgaacgggccctacgttccggtcccttcccccgtcgggcccgcccctcgcctcccgaggacgcccgaccctccggaaggacgacccaccgaggcccggccccggttcggggcctcgggccgttacgggtaccgaaacgggtacccttaaccttacccgtaagttacgttacgtccgttcgtaggacgggtccgggcgttcggacgaacggtccgcgagtaggnnnnnnnnnnnnnnnnnn

SEQ ID NO: 41475 - DNA, 573 bp, Homo sapiens
  misc_feature: GYAE6OF01EAHXH.26.60.F05.1.454.CMB.1.raw
  modified_base (201)..(201): a, c, t, g, unknown or other
  misc_feature (201)..(201): n is a, c, g, or t
  modified_base (358)..(358): a, c, t, g, unknown or other
  misc_feature (358)..(358): n is a, c, g, or t
  modified_base (389)..(389): a, c, t, g, unknown or other
  misc_feature (389)..(389): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaangtcaccatctcctgtcgggccggtcagagtattagcagcaacttgcctggcaccagcagaaacctgggcaggctcccaggcctcctcatctttgatcgcgtccaccgagggcctacgttcggtttcccagtcctagggttcaggtgcgagtgcgtcngcgacgagacgttcactctccaccatcaacngcctgactaggtactagaagttattttgctttaagttttacttactgttaccagtctagtatcgatcgacgtcggcctctaccgtacccgttccggaccgtaacgggacctacggtaaccgtggtaagtaacgttaaaaccggacgttcggtacggtctacggactacccgtatccgtttaacg

SEQ ID NO: 41476 - DNA, 904 bp, Homo sapiens
  misc_feature: GYAE6OF01DEU2B.26.60.F05.1.454.CMB.1.raw
tcagagactatactcacgaccggtgctcgatttagtacgtcatcagggaaagggggaggaactgctcagttaggacccagacggaaccatggaagccccagcgcagcttctcttcctcctgctactctgctcccagactaccactggactaaaatagtgctgacgcagtctccagccaccctgtctcgtcctcgtaccgagggaagcgtaccacctatcctccgtggtccgggccggtcgagtacgttattagacctagaccgtaacttacgccgtacggacaaccacgacgaacgaaccgtggacgtacgccgtaccgacggtccttccgtacctacgtttcgtttacgagttccggtaccgtacccgaccggtaccggtaccgttaccggttccgtttaccccgaacggtaccctaaggtttcgaacggttcggactacggtcgtcggtacgtacggaccgacgttaacggtaccgttacctaccgttacccgttccgaaacctaaccgtttaaccgaaaccgttacccggaccgtttacccggacggtttaacgttacccgggtttaaggttaaaaccgtttttaggttttacccgggtaaccctttttaaaggggttttttacttaaaccccggtttggggttaaccctaaccggttaaaggttacgtttttaacccgaagttaccgtttaacccggggtacgttaaccccgggttccccgtaacttttaaccccggggacggttttaccccgggtaaaacccggaaaggggtttaccccccggaaagggttaaacccggtttaaacggggttaaaaccaaacggttttaaaccccgggggacttttcgggaaacgtttccccgacctaaaccgttaccgtttcgtaccccggttttacg

SEQ ID NO: 41477 - DNA, 705 bp, Homo sapiens
  misc_feature: GYAE6OF01C5GJ7.26.60.F05.1.454.CMB.1.raw
  modified_base (218)..(218): a, c, t, g, unknown or other
  misc_feature (218)..(218): n is a, c, g, or t
  modified_base (326)..(326): a, c, t, g, unknown or other
  misc_feature (326)..(326): n is a, c, g, or t
tcagagactatactcacgaccggtgctcgatttagtacgtcatcaggggaaagggggaggaactgctcagttaggacccagacggaaccatggaacgccccagcgcagcttctcttcctcctgctactctggcctcccagactaccactggactaaaatgtgctgaacgcagtctccagccctacccgtgtcctcgcctcgtaccggaaggggaaacncgtccaacctattccctccggtacggtccggggtccggttacaaggtacgtattacgcacgactaacgttcgcctcggaccaacgagtacaacggaaccgtgggaccncggacctccccggagtccttccctactacgtttccgtttagacgtcgtaccctcccgaaccgacggtaccctacggtttccggttacccacgtaccgtacgggtcagggtcgactggactcgtactacgtcggacgactacgtactaccgactccaaccacccgtataccgaccgtacgctacgctagtcgtaacgtaagttacttacgtacgttaatttacgtacgtagttaccgagttactaagttacacgttacgtaaccgtcgtaccggacttccggtaccgtacccgtacggaaccgtaccggaacgtaccgtaaggaccgttaaacgtaacgtaaccgtacgtacggtacgtactaacgcctactcgttaccg

SEQ ID NO: 41478 - DNA, 710 bp, Homo sapiens
  misc_feature: GYAE6OF01BN44A.26.60.F05.1.454.CMB.1.raw
  modified_base (198)..(198): a, c, t, g, unknown or other
  misc_feature (198)..(198): n is a, c, g, or t
  modified_base (644)..(644): a, c, t, g, unknown or other
  misc_feature (644)..(644): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggcctcccagataccactggacaaaatagtgctgacgcagtctcagccacctgtctgcctctcgagggaanagtcactatctccgtggtccgggccggtcagagttagtacgcagacctaacttcgccgtggcaccgagaccaacggtaaccgtgggaccacggtcctacccgaggtcccttacccgtctacgtttcgttttacggacgttccggtacccggtacccgaacccggtaccgggggtcccttaacgggtttcccgggtttaccccgacggtacccgttagggtttccgaagggttcggacgtacggtacgtccggtacgtacgtacgacgttaaggtacgtttaccgcttaccctccgtaaccactaccgtaaccgacgtacccgtggacctacgttacgtaacgtaagtttacgtttgttaccgttaagtttttcgttaactcgtacgagttcgtaagttactactacgtcgtacgtccgtccttacctcctaccggtcggaaccggngaccgagtacgtacggtaataacgttaacggactcggtacgtacacggtacctctagttcttaccg

SEQ ID NO: 41479 - DNA, 651 bp, Homo sapiens
  misc_feature: GYAE6OF01B8N40.26.60.F05.1.454.CMB.1.raw
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
  modified_base (441)..(441): a, c, t, g, unknown or other
  misc_feature (441)..(441): n is a, c, g, or t
  modified_base (482)..(482): a, c, t, g, unknown or other
  misc_feature (482)..(482): n is a, c, g, or t
tcagagactatactcacgaccggtgctcgatttagtacgtcatcagggaaaggggggaggaactgctcagttaggacccagacggaaccatggaagccccagcgcagcttctcttcctcctgctactctggctcccagataccactggacaaaatgtgctgacgcagtctccagcccaccctgtctgcctctccgaggggaaangtcaccatctcctggtcgggccgtnagagttatagcagctaacttcgcctggcaccagacacgaaaccgtgggcaggcctcccgaggcctcctnattcgttagctcggccgtcccacggacggcctacgttcgttcccagccgtaggttcaggtcggcgtaggtcgcggtctacggacgacgagttcgtccaccttcctaccactactacaccgcgctgactacgtcgtagtaattntttcgacgtttagttttatctgtacgtagtactaagttctntacgtacgtcgtcggtcctacgttcccggtaccggggttcccggggaacccggggaccttaacggggtaccctaaaacggggtaaacccgtaaacgggttaacgttcgggtcccgggtacttacccggaccttaacccgtttagcccgtttttccgtaccgtttacccg

SEQ ID NO: 41480 - DNA, 769 bp, Homo sapiens
  misc_feature: GYAE6OF01APCCM.26.60.F05.1.454.CMB.1.raw
  modified_base (157)..(157): a, c, t, g, unknown or other
  misc_feature (157)..(157): n is a, c, g, or t
  modified_base (243)..(243): a, c, t, g, unknown or other
  misc_feature (243)..(243): n is a, c, g, or t
  modified_base (725)..(725): a, c, t, g, unknown or other
  misc_feature (725)..(725): n is a, c, g, or t
tcagagactatactcacgaccggtgctcgatttagtacgtcatcagggaaaggggaggaactgctcagttaggacccagacggaaccatggaacgccccagcgcagcttctcttcctctgctactctggctcccagactaccactggacaaaatgtnctgacgcagtctccacgccctacctgtctcgcctactaccggaaggggaaatcgtccacctattcctccgtggtccgggccgttanagtacgttatacgcagtacctaaacgttcgccgtggaccaaccgaaacgtaacggtaaccgtgggacctacggtcccgtacccgacggtcccttacccttacgtaatttcccgtttaggaccttccgggtacccggtacccgaaccggtaccgggtacccttaccggttttccgggttaccccacgggttacccgtaaggtttccgacgggttcggaccgtacggttccgcgttacgacggtaccgaacgtacggtacttccaccgttacctaccgaacctactacccgaactcgtacccgtacgtacgtacgttacgtagttaagttccgtttagttaacgttacttttacgtacttacgtacgtacgtaacgtacttatacgtacgtcgaccggttccggtccttaccgtacccgtaccggtaccggtaacggaacccggtccgtaacgtacggtaacgtaacgttaacgtaaaccggtntacggtacgtactccgtaacacccgttgtttcccgtagttaccc

SEQ ID NO: 41481 - DNA, 689 bp, Homo sapiens
  misc_feature: GYAE6OF01AMQTI.26.60.F05.1.454.CMB.1.raw
  modified_base (203)..(203): a, c, t, g, unknown or other
  misc_feature (203)..(203): n is a, c, g, or t
  modified_base (318)..(318): a, c, t, g, unknown or other
  misc_feature (318)..(318): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtcctccagccaccctgtctgcctctccgaggggaaangtccaccatctcctggtccggggccggtcagtagtattacggcagcctaacgtttagcctaggccaccgagaccaaggaacccgtgggaccacggcctcccgaaggcctccctanactttcctttggacttcgaccgtccgaccgacgggccctacgttcggttaccccagtcccgtaggtttccaggtcggccgaggttcgccgtcgtgacgaacgtgtacgttccacttcgaccacactaccacacgtccgtacgtcgtacgtacgtagtacgttacgttttacgacgttacgttacttacgttacgtacgtacgtacgtacttaacttaacgttaacgttacgtacggttccgttacggtttaccgggtttccggggacccgggggttaaccgtacggtccggtacggtacgtaacggtaacccgtaacggtacgttcggtacgtccgtacgtacctacgttaccgttcttcgttcttacccg

SEQ ID NO: 41482 - DNA, 667 bp, Homo sapiens
  misc_feature: GYAE6OF01DUN53.26.60.F05.1.454.CMB.1.raw
  modified_base (319)..(319): a, c, t, g, unknown or other
  misc_feature (319)..(319): n is a, c, g, or t
  modified_base (363)..(363): a, c, t, g, unknown or other
  misc_feature (363)..(363): n is a, c, g, or t
  modified_base (545)..(545): a, c, t, g, unknown or other
  misc_feature (545)..(545): n is a, c, g, or t
  modified_base (570)..(570): a, c, t, g, unknown or other
  misc_feature (570)..(570): n is a, c, g, or t
  modified_base (640)..(640): a, c, t, g, unknown or other
  misc_feature (640)..(640): n is a, c, g, or t
  modified_base (658)..(658): a, c, t, g, unknown or other
  misc_feature (658)..(658): n is a, c, g, or t
tcagagactatactcacgaccggtgctcgatttagtacgtcatcagggaaaggggaggaactgctcagttaggacccagacggaaccatggaacgccccagcgcagcttcctcttcctcctgctactctggcctccagactaccactggacaaaatagtgcgtgacgcacgtcctccacgccctacccttgtcctcgcctacgtccggaaagggggaaactacgtaccaccctatccgttccgttaggtcccggggccggttacaggtattaacgttacgacgacgtactaaccgtttacgccgtacggaccaccgaanaccgaaacgaaaccggtggaccacggtcctacgacgtcctaccnttacgttccgttgctcgaccgtccacggacggtacctcggttccgttaccgacgtacgtaggttcgaggtcggacgtacgtcgtcgccgttgaccgtaggtacgtctttcgaccttccgtaacaaccacgtactaaccgtcgtcctacggtctaacgttccgtaaggttaatttcgtacgtnttttaacgttactgtcgtacacgtntacgtactgactcgcgttcgaccttctacgtcgtacggacgacgacgagacgaggtacttaaagacgtcngtacgtctacgacctatntccgttacg

SEQ ID NO: 41483 - DNA, 710 bp, Homo sapiens
  misc_feature: GYAE6OF01BHTMY.26.60.F05.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgcctctccgagggaaangtcaccatctctgtcgggccgtnagagtatagcagcaacttgcctggaccaccagcaagaaaccgtgggacaggcctcccgaggcctccgtcacttcgtttgattcgaccgtccgaccgacgggcctacgttcggtttcccacgtccgtaggttcgaggtcggacgaggtcgcgttcgtgacgactaggtacgttaccacttcgtaccacctacgtaccaaaccgtcgcccttacgactacgtcgtaacgtaagttcgtttacgtactttaagttttattacgttagtaccgtaagtaccgttagttactacgtaacgtaccggtaccgttaccggtcccgttaccgttacccgtaccccggttacccgggaaccggtaaaccgggtaccggaaccgggtaccgttaacggggtaaggttaaaacccgtttaaaacgggaaacccgttttacgggtaacgggttaccaaccgggttaaccctaaacccggttacgtttccgtttacccgg

SEQ ID NO: 41484 - DNA, 788 bp, Homo sapiens
  misc_feature: GYAE6OF01BWYA7.26.60.F05.1.454.CMB.1.raw
  modified_base (218)..(218): a, c, t, g, unknown or other
  misc_feature (218)..(218): n is a, c, g, or t
  modified_base (783)..(783): a, c, t, g, unknown or other
  misc_feature (783)..(783): n is a, c, g, or t
tcagagactatactcacgaccggtgctcgatttagtacgtcatcagggaaagggggaggaactgctcagttacggacccagacggaaccatggaagccccagcgcagcttctcttcctcctgctactctggctcccagactacccactggacaaaagttgtgctgacgcagtcctccacgccctaccttgtcctcgccctcgtaccggaaggggtaancgtaccacctactcctccgtcgggtaccgggccggtacaaggtgttagtacgacctaaacgtttacttagtttacgccgttaaggtaaccaaacgagtacgttcgccggacgtaccggtcccctacccggtctacccgtactacgttacccgaaaccggtaactaccgtaccccggaaccgggccctaggtaccggaccctaaccggtacccgtaacggaaccgttcgggtttacgacggttaccgggtcggttaccggggttcggggttaacctggaaaccggtacgtaaccgtttaccctttaccgtaacctacctaactaaccgttacgtaacccgggtacacggtaaacggtaccggtcgggtaacccgtaacgtttagttaaacgtttgttactacgttagttacgttaattccgtaagtctaagtcgtagttctaccgttccttaccgttccttacggttccgttacgtttacggtcggaacggtacgaccgtagtcgaggtaactacggtaactaaggtacgttggaccggtctacgacctacgttagttcgttcgtntaccc

SEQ ID NO: 41485 - DNA, 715 bp, Homo sapiens
  misc_feature: GYAE6OF01CGVXB.26.60.F05.1.454.CMB.1.raw
tcagagactatactcacgaccggtgctcgatttagtacgtcatcagggaaagggggaggaactgctcagttaggacccagacggaaccatggaagccccagcgcagattctcttcctcctgctactctggctcccagactaccactggacaaaatagtgctgacgcagtcctaccacgccctacccgtgtcctcgcctctaccggaaggggaaacgcgtccaaccgatccgtccgtcggtaccggggccgtacaacggtagtatacgacacgactaacgttacgccgtacgcaccgacgacaacgaacgtggacacgccgtccgacgtcctctactattcgtgacgtcaccgtaccgaccggacggtcctacgttcggtaccagtccggtaagtcgaggtcgacgtaggtcgtcgtacgtcggacgacgtagttaccgtctaactcccgtaaccaccttacgtaacccaacgaccgtcgtcgacgtactaaggttacgttaacggttactttaggtaccgtttaaatttccgttagttacgtaacgtacgtactaagtttacattacggtaacgtcccggttacggccctttaccggtacccttaccgggtacccggaacggttaccgggaccttaacggtaccggtaacgttaaacggttaacgtaacgggtaactcgggaacgtcctaacgggtcctaacgtgtttccgtacg

SEQ ID NO: 41486 - DNA, 844 bp, Homo sapiens
  misc_feature: GYAE6OF01DFP5K.26.60.F05.1.454.CMB.1.raw
  modified_base (217)..(217): a, c, t, g, unknown or other
  misc_feature (217)..(217): n is a, c, g, or t
  modified_base (833)..(833): a, c, t, g, unknown or other
  misc_feature (833)..(833): n is a, c, g, or t
tcagagactatactcacgaccggtgctcgatttagtacgtcatcagggaaagggggaggaactgctcagttaggacccagacggaaccatggaacgccccagcgcagcttctcttcctcctgctactctggcctccagactaccactggacaaaatgtgctgacgcagtctccacgtccctacccgtgtcctcgccctcgtaccggaaggggaaacncgtaccacctacgttccgtccggtcgggtccggggtacccggtacgtaaggtaacgtttacgttacggcgtaacggtacctaaaccggtttccggaccgtacgggaccaaccgaggtaaccgaaacgggtaaaccggtggggaaccgaccggtacccgtcccggacggttaccctaccttacgttaacgtttcgttttacggacgttcccggtacccgtaacccgaacccgggtaccggtaccccgttaacggttttcccgggttaaccccgacggttacccggttaacgggtaccgtaacggggttccggaaccgttacggggtcggttacccggtcgttaccggaacggttaccggtgttaacccggtttacccacccgttaaccgtaccaaaccgtacgtaccaacgtcccgtacgttacgacgtacgtacgtaattaccgggttatttacggtactttacgtttaacgcgttacgacgtacgtaacgtacgttataccgtaagtccggtacctccgggtaccctagtaaccctacggaccggtaacggtacgaacctaggtaacgtacggaaattaaccggtagtacgttcggactactacccgatacgttntcggttaaccc

SEQ ID NO: 41487 - DNA, 784 bp, Homo sapiens
  misc_feature: GYAE6OF01EYNE0.26.60.F05.1.454.CMB.1.raw
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
tcagagactatactcacgaccggtgctcgatttagtacgtcatcagggaaagggggaggaactgctcagttacggacccaggacggaaccatggaacgcccccagcgcagcttctcttcctcctgctactctggctcccagataccactggacaaaatgtgctgacgcagtctccagccacctgtctgcctncgagggaaangtcaccatctccgtgtcgggccgtnaagatatagcagactaacttagccnggaccacgagacagaaaccgtgggacacgctcccgaaggtcctactactacttcgtttaggacttcggtaccgtaccaaccggacgggtcctaaacggttcggtttaccccagacccgttaaggtttccaacggttcgggacacggttcggcgttaccggtaggaccgtaacgacggttaacgtttccgaacctttaccgtaccgaaacctaacgtttaacgaaacccgtacggccccttaagaccgaaacggttcgtaagggttaaaagtttcgtttttaacgtaccggtttaaattttaaggttttaccctaggttacgtaacgggtaccttaaagggtttacaacccgttacggttaccggtaacgtttccgggggacccttaaaccttcccgggaaccccgtttaacgggaaccgggaaaacgggtaacctaacggtaaccggtttacggaaaaaggttaaccctaaaaaggggtacctagggttaccggtaccttaagacccgttaaccgtaaacttccggttaacg

SEQ ID NO: 41488 - DNA, 757 bp, Homo sapiens
  misc_feature: GYAE6OF01DAB1F.26.60.F05.1.454.CMB.1.raw
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggcctccagactaccactgacaaaatagtgctgacgcagtcctccacgccctacctgtcctcgcctcgtaccgaaggggaaacacgtacacctagtcctccgtcggtccggggccggttcaaggacgttagttacgcaagtacctaaacgttacggccgtacggaccaaccgngaccgaaacgaaccgtggaccacggcctaccgagtcctcctactagtttccgtttanacgtcgtccgtacccgaacgtacgggaccttaccggttaccggttacccacgtccgtaacggttccgagggttcgacgtagtcgtacgttcgtacgcgtaactaggtctaccgtactacctacgaactacgtaccaaaccgtcgtcccgttacggacttacggtagttaacgtaagtttttaccgttgtaaccgtttaagttttaccgttacgtgttaacgtacgtattaaccggtataccgttaaggctaacggttccggccttacttccggtaccgtaacccggtaacggaaccgtccgaaacggtacggtacggtaaaaactttacggtaaaacccgtgttaaccgggtacgtaccccgtttaacgacccttaaccggttccctttagttaaccccg

SEQ ID NO: 41489 - DNA, 654 bp, Homo sapiens
  misc_feature: GYAE6OF01AZZYX.26.60.F05.1.454.CMB.1.raw
  modified_base (235)..(235): a, c, t, g, unknown or other
  misc_feature (235)..(235): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagccaccctgtctcgcctctccgaggggaaagcgtccaccatcctccgtggtccgggccggtnaggagtattagcagcaacttgcctggcaccagcagaacgnggcnggctccgngctctnatctgntgcnccacgcggccacgtgttcccagtccgtagttcgagtcggcaggtcgcgtctggccgaacgagtcgtttccacttcctaccaacctactaacccgaactccgtcccgtgactacggtctaacggtaatttccgtttagtaccttaagttttacgttacttacggtacgtaggtactaaggttactacgtattaccgggtaaccttcggggcccttaccgttacccgtaacccgtttacccgggaaaccccgtaaacggggaccctaaaccggtaacgttacgggtaagtaaacggtttaaaccggaacgtttcgggacgttacgtacgacccgtaccgtatcccggtttacg

SEQ ID NO: 41490 - DNA, 713 bp, Homo sapiens
  misc_feature: GYAE6OF01AO0GU.26.60.F05.1.454.CMB.1.raw
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
tcagagactatactcacgaccggtgctcgatttagtacgtcatcagggaaagggggaggaactgctcagttaggacccagacggaaccatggaacgccccagcgcagcttctcttcctcctgcttactctggctcccagactaccacgtggacaaaatgtgctgacgcagtctccagcccacccgtgtctgccctctaccggaaggggaaangtaccaacctattccgtccgtggtaccggggccggtnaaggtagttatacgcagtcctaaattcgcccttggacctaccaaggacctaaggtaaaccgtgggacacgggtcctacccgaggcctctactacttctttgactccgccttaccgaccggtacggtcctacggttcccggttccacggtacgttagtcgtaggttccgcgtacggtcgtccgtacgtcggactacgaacgtcgtttaccacctccgtacacctaataccgaactaccggtcctagtaccgtagttaccgtagtaagttacttttggaactttacgtttacttacgtagttacgacgttagtacgttactctacggtacggtaccgtccgcccgttacctaaccgtcccggttacggaccgaaccggtacgtaacgtacggtaacggttagtaaacggttaaacccgtcggttggaccggtttacacgggttacctaccgttgttacccgtttcg

SEQ ID NO: 41491 - DNA, 727 bp, Homo sapiens
  misc_feature: GYAE6OF01ED9FY.26.60.F05.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagcccaccctgtctgcctctccgaaggggaaangtccaccatcctccgtgtcgggccggtcagagtattagcagcaacttagcctggcacagcaagaaaccgtgggcaggcctccgagcctccnctatcttgntacgccgtccaccgacggcctacgttcggtttacccagtcgtacggttcgacggtacggcgtaggtcgtccgtcgtcggacgtaacgtaggtacgttctaccgttcctaccgtaacctacgtacctaaaccgacggttccctggtaccgtaggttaccgttaaggtaacgtttacgttttacgacttttaaggttttacttacgtacgttacgaacgttacctaaggtaaccttacgtaacgttaccggtacgttacccggtcccgtaccgttaccgtaacccggttaccggaaacccggtaacggggtaaccctaccgggtaaaccggttacggggaaacgtttaaacggttaaaacggtccggttaaggggtccgttaaccggtacctaacccggtaaccttacggttcccgtttacccgg

SEQ ID NO: 41492 - DNA, 865 bp, Homo sapiens
  misc_feature: GYAE6OF01DV83E.26.60.F05.1.454.CMB.1.raw
  modified_base (206)..(206): a, c, t, g, unknown or other
  misc_feature (206)..(206): n is a, c, g, or t
tcagagactatactcacgaccggtgctcgatttagtacgtcatcagggaaagggggaggaactgctcagttaggacccagacggaaccatggaagcccagcgcagcttctcttcctcctgctactctggctccagataccactggacaaaatgtgctagacgcagtcctccagccaccctgtctcgccctcgtaccgaaggggaancgtccacctatccttcgtggtccgggccggttacgagtagttattacgactagactaacgttacgccgttacggaccaaccgaacgaccgtaaaccgtaaaaccgggtcggggaaccgtaccggaccgtaccccggtaacggtccccttacccttacttacgttttaccggtttacgtaacccgttcccgggtacccggttacccccgaacccggtaccggggttaaccccgttaaccggttttccccggttttacccgaacgggttaccccggttaagggttttcccggaaggtttccggggtacgtaccggttacccgggttcgttccggtacgggtaaccccggtaacgtacggttaaccgtttcccgtaacccgtttacctcccgaaaccgttaacctccgaacggtcctaaccggtacccgtacgggttaacgtacccgttaacgggtaactttacgtttccgttaacgttttacgttttaccgtacgtttacgtacgacggtacgtagtccgtacggtactaccgttccgtccttacgttaccgttacgggtccgggacggtacgggaccggtagggacgtacggtaacgtacgggtaacgtacgtaaccgggtggaccgttacgacccgtactacggttcttcggttacccg

SEQ ID NO: 41493 - DNA, 831 bp, Homo sapiens
  misc_feature: GYAE6OF01B9D1L.26.60.F05.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
tcagagactatactcacgaccggtgctcgatttagtacgtcatcagggaaagggggagagaggagcccagccctgggattttcaggtgttttcatttggtgatcaggactgaaccgagagaactcaccatggtagttgggctgagcgtggcttcgttcttgtcgttagtttttaaaggngtcctagtgtagnggtgactactggtcggtcgtcggtcggggtatacgttcggtaccgacccgggtcgggggtccctagacgtaccttccgttccgtgtacgccgtacgtccgttcgtaggtacttacctaaccgtttacgtacctaacttccgttacgttacgtacggtcggggtccgttcgggtaccccgtaccggaccgggtaccggggtaaccggggggacgggtcgtcggggtccgggtcggttacgtacggtaagttagtacggaagtacggtaaggtagtacgggtacgaacgtcgtaacttagtaccgtaacgtacgtaccgtggtaacggaccggtcctaactaccgctacgtactaccgagtaactacgttacttacggacggacgtacgtacgttcgtttacggtaccgtaagtaacgtaacggaaccgtaacgaccggttacgtaacggacgggtaccgtacggaaccgtacccgggtacccttaccgtttacgttacgtttacgtaggttaaccgtaacgttacgttaacgtcgtaaccgtacccgtaccgtaccccggtaccccggtacgttaccgttaacgtttacccgtttacgtaccggtttaccggtacgggtaacgggtaacggtaacccggg

SEQ ID NO: 41494 - DNA, 858 bp, Homo sapiens
  misc_feature: GYAE6OF01CYZ75.26.60.F05.1.454.CMB.1.raw
  modified_base (516)..(516): a, c, t, g, unknown or other
  misc_feature (516)..(516): n is a, c, g, or t
  modified_base (541)..(541): a, c, t, g, unknown or other
  misc_feature (541)..(541): n is a, c, g, or t
tcagagactatactcacgaccggtgctcgatttagtacgtcatcagggaaagggggaggaactgctcagttaggaccagacggaaccatggaacgcccagcgcagcttctcttcctcctgctactctggcctccagactaccacgtggaacaaaatagtgctagacgctacgtcctccacgccctacccttgttccttcctccgtaccggaaagggggaaacgtcgttaccaccgtacttccgtccgtcgggtccggggccggtacgtaggtaacgttagttacggacacgtaccgtaaacgtttcgaccgtcggaccaaccgaacgaccgaaacggtaaacccgggtacgggaccgaacgggtacccgtacccggaacggtccctttaccgtacgttactttcgttttacggcttccggtacccgtaccgacccggtaccgggtacccgttaacggttcccggtttaccgaccggtaccggtacggttcgtacggtcgacgtcggtcgtcggtcncggtacgaacgttcggtaccttccnccgtttaccaccgtaacctactaccaaccggtaccgtccgttaccgacgttacgtaacgttacgttaacgtttacgtttacgttacgttttaactttacgttacgttcgttacgacttacgacgtttactcgtaccgtacgtaacggtcccgttaccgtcccgttacccggtaccggtacccgggtaaccgggtaaccggaacccgggtaacgttacgggtaaacgtaaaccgggttaaacgttaaaccgggttcggttacgggaccgtacggtcccaaaccgttctttaaaccgttcccgttttaacgttaccccg

SEQ ID NO: 41495 - DNA, 731 bp, Homo sapiens
  misc_feature: GYAE6OF01BN0WP.26.60.F05.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagccaccctgctgcctctcgagggaangtcacatctcgtgtcgggccgtnagtagtattagcagactaacttagcctggacaccagacaagaaaccgtgggacacggtcctacccgacggctacctactattccgtttaggacgtcggaccgttacccgaaccggtaaccgggcccgttaaccgttccggtttacccccgaaggtacccgtaagggttccgtaaggttccgggacgtagggtcggtacgttaccgtaggacccgtaacgtaggtacgttaccgactactaccaacctactaccaacgtacgtccgtacgaccgtaaggttactaaggttaacgtttacgtttagaccgtttaagttttaacgtaccgttaggtaccaggtactaacgttaacttcgaacgttacgaccgttaccggaccgttaccgtaccgtacccgttaccgggaaccggtaaacggtaccgaacggtacgtaacggtaacgtaaacgttaaacggtacgttcggtaacggtacgtaccgtaaccgaacgttaacgtcgtttaaccgg

SEQ ID NO: 41496 - DNA, 657 bp, Homo sapiens
  misc_feature: GYAE6OF01B7RQE.26.60.F05.1.454.CMB.1.raw
  modified_base (205)..(205): a, c, t, g, unknown or other
  misc_feature (205)..(205): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
tcagagactatactcacgaccggtgctcgatttagtacgtcatcagggaaagggggaggaactgctcagttaggacccagacggaaccatggaacgccccagcgcagcttctcttcctcctgctactctggctcccagactaccactggacaaaatgtgctgacgcagtctccagccacctgtctgcctctaccgaaggggaaangtacaaccatccgtccgtaggtccggggccggtacaaggtacgttatagccagctaaacgttagcctggaccaccagcaacggaaaccgtgggacacggacctcccgaaggtcctccctactaattccgttttagaacttcggtaccgtacccaccggacgggtccctaaccgttcggtttcccagtacccgtaaggttccaggtcggcaggtcgtcgtctgacgagagtacgtcacttcnctaacgntccaagccacgtcngtacgtagtcgtaagtaagttgtttacgtacgtaactttaagttttaacgtaccgtagttaacagtaacttaaattaactaactacccgtcggtaccctcgtacgtccgtaacgttcgggacggtacggtaacgaggttcaaggtaacctacgaaacgtacgtggtacgacttacgactacgtgttaccg

SEQ ID NO: 41497 - DNA, 878 bp, Homo sapiens
  misc_feature: GYAE6OF01B3K46.26.60.F05.1.454.CMB.1.raw
tcagagactatactcacgaccggtgctcgatttagtacgtcatcaggggaaaggggggaggaactgctcagttaggacccagacggaaccatggaagccccagcgcagcttctcttcctcctgctactctggctcccagactaccactggacaaaatagtgctgacgcagtctcacgcccacctgtctcgcctctaccggaaggggaaagcgtaccacctattccgtccgtcgggtccggggccggtcaaggagttattagccagacctaacgttacgccgttacgggccaccgacgtaccgaaacggtaaacccgtggggacccgacgggtccctacccgacggtacctccccgtactatttcgtttacgacgttccggtacccgtacccgaacccggtacggggtacccctaccggtttacccgggtttaccccgaggtacccggttacgggttaccgtacgggtcgggtcgtacgggttccgtcccggttacggtccggacccggtaacgtaaacggttaccggtttaccctaccttaccctaccccgtaacctaaccttaaccggaacccgtaccggtacccgtaacggtaccgttaacggggtacccgtttaaaggttacggttttaacgttttaccggtacgttttaacgggttttacttaaccgtttcaacggtaacgttcgtaaacgttaacgtcgtaaccgtcggtaccgggtcccggtacccttaccggttacccgtaccggtaccgggtacccgtaaaccggggtacctaaccgggtacggttaacgggtaaacggttttaaaacggtaacccggagggtttcgaccggtactacccggtaactacccgtttacggtcgtttacccg

SEQ ID NO: 41498 - DNA, 491 bp, Homo sapiens
  misc_feature: GYAE6OF02I10S3.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcagcagcctgcagtctgaagattgtgctaatttattactgtcagcaatataatactggcctccgctcactttcgcggaggaccaaggttgagatacgaaacgatgtggctgcaccatcg

SEQ ID NO: 41499 - DNA, 498 bp, Homo sapiens
  misc_feature: GYAE6OF02JCUMS.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccgtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtatttgctagtttattactgtcagcagtatcatgacgtggccgctcaccgttcgccgaagggacacgacgtggagtattaaacgacgtgtcggctgcactatcgtcg

SEQ ID NO: 41500 - DNA, 499 bp, Homo sapiens
  misc_feature: GYAE6OF02G0DSP.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccgtcagagtattagcagcaacttagcctggcaccagcagaaacctgggcaggctcccgaggctcctcattcttgatgcgtccaccgagggccactggttcccagccaggttcagtggcagtgcgtctgcgacagagttcactctcaccatcaacacgcctgcagtctgaagtattgtgactaatttattactgtcagcaatataatacctgcctcgtctctacgttcggcggaggaccaggttgagtatacgaacgtactgtcggctgcacatctcg

SEQ ID NO: 41501 - DNA, 601 bp, Homo sapiens
  misc_feature: GYAE6OF02I9RPG.26.60.F05.1.454.CMB.1.raw
  modified_base (151)..(151): a, c, t, g, unknown or other
  misc_feature (151)..(151): n is a, c, g, or t
  modified_base (175)..(175): a, c, t, g, unknown or other
  misc_feature (175)..(175): n is a, c, g, or t
tcagagactatactcacgaccggtgctcgatttagtacgtcatcagggaaagggggagagaggagcccagccctgggattttcaggtgttttcatttggtgatcaggactgaaccgagagaactcaccatggagtttgggctgagcggtgngtcttacgtgtgacttttaaaggngtcagtgtgaggtgcaactgttggcgtctgggggagacttggtacacccgtggggggtccctgagctctcctgtgcagcctctggattcacctttagcaactctgcatggctgggtccgccgaggcgtccggggaagggctgggcgtgggtctcgaagtattgatgagaatgggtaggaagcactatttcaacgtagaccttccgtaggaacgggcctcttcaccatctccaagacgactaatttcgaaggagcacgtcttcgttctgactaatgaaactcgacctggacgacggaccgaggaccgaccggcccttcttactttcgtcgtcgacgtaaacgtctagtagtacgtacgtacccgaccccgtacgccgtaccttaccgtttcgtttacgtaccgtttcggtacggggtactaacgggg

SEQ ID NO: 41502 - DNA, 494 bp, Homo sapiens
  misc_feature: GYAE6OF02H1YAN.26.60.F05.1.454.CMB.1.raw
  modified_base (349)..(349): a, c, t, g, unknown or other
  misc_feature (349)..(349): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtcngcgacagagttcactctcaccatcaacagcctgcagtctgaagtattttgctagtttattactgtcagcagtatcatgactggccgctcaccttcgccaagggacacgacgtggagataaacgactgtcggctgccactatctcg

SEQ ID NO: 41503 - DNA, 991 bp, Homo sapiens
  misc_feature: GYAE6OF02IJ1UA.26.60.F05.1.454.CMB.1.raw
tcagagactatactcacgaccggtgctcgatttagtacgtcatcagggtaaagggggtaggggaactggctccagttaggacccaggacggtaaccagtggtaacgcccctaggcgcagcttctcttcctacctgctacgtctggcctcccaggatttaccgactggcaaaattaggttgccttgtacggcttaaggtctccagtccaccctggtctggccttctaccagggggaaaagtacgtcgaaccgaagttccttaccgtcggtacgggcccgggttcggaccgaggtaagtttaacgcctacgtcgtaacgttagccgtcggtccaccgacgtccaacggtaaaaccctggggaccaacgggaccctaccccgtaaggacctttcccgtacgttaacgttcccgttttcggaacggttccggacccggttaacccggaacccgggaacgggtccccgtaacgggttcggggttttacccccaaggtacccggtaacggtttacgttaacggtacgggtccgtaagggttacgtttacccggtaccttacggtaacccgtaacgaacggtaacgttaccctaaccgttccgtaaccgaaccccgtaatttaccaaacccgtacggtaccccgttacgacggtaacgttaccgttacggaaacggttaacgttttttacggtaacctttaacggttttttaaacttaaccgtttcggttaaaccgtaacggttaccgtaaagggtttaacttacccggtaaacgttacgggtaaacccggtttccgggttacccgttaaccgttttacccgtacccggttttaacccggggacccgttaaaacgggggacccttaaaccgggtacccggttacggggtaaacgttaaaccgggttttaaaaaccggtaaccggtttttacggttaaccggggtttaccgtttaaccggcccgtttaaaccggttaccgggtttacctttaaccgggg

SEQ ID NO: 41504 - DNA, 499 bp, Homo sapiens
  misc_feature: GYAE6OF02HF6ZD.26.60.F05.1.454.CMB.1.raw
  modified_base (201)..(201): a, c, t, g, unknown or other
  misc_feature (201)..(201): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (495)..(495): a, c, t, g, unknown or other
  misc_feature (495)..(495): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagcccaccctgtctgcctctccaggggaaangtcaccatcctcctgtcgggccggtcagagtattagcagcaacttagcctggcaccagcagaacctgggcaggctcccaggctcctcatcttgatgcgtccaccagggccactggttcccagccaggttcagtggcagtgcgtctgcganagagttcactctcacatcaacngcctgcagtctgaacgtntttgactagtttatactgtcagtcagtatcatgactggcnctcnccgttcggccaagggacacgacgtggaatacgttaaacgatgtcggctgaccaccgtatntacg

SEQ ID NO: 41505 - DNA, 534 bp, Homo sapiens
  misc_feature: GYAE6OF02G80FZ.26.60.F05.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
tcagagactatactcacgaccggtgctcgatttagtacgtcatcagggaaagggggaggaactgctcagttaggacccagacggaaccatggaagccccagccgcagcttctcttcctccgtgctactctggctcccagataccactggcaaaatagtgctgacgcagtctccagcccaccctgtctgcctctcaggggaaangtcaccatctcctgtcgggccgtnagagtattagcagcaacttagcctggcaccagcagaaacctgggcaggctcccgagctcctcatctttgatgcgtccaccgagggccacgtcggtttcccagtccctaggttcaggttcggctaggtcgcgtctgcgacagacgttcactctcacctatcaacacgcctgacagtctagaagtatttgctagtttattacgtgtcagtctagtatctatgtactcggacctctccaccgttcggaccgaacggactacgacgtaggaagtaacgtaaacgacgtgtacggctcgactactactctcg

SEQ ID NO: 41506 - DNA, 489 bp, Homo sapiens
  misc_feature: GYAE6OF02FRCD4.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttatactgtcagctagtatcatgactggccgctcaccttcggccaagggacacgactggagataacgactgtgctgcaccatctcg

SEQ ID NO: 41507 - DNA, 572 bp, Homo sapiens
  misc_feature: GYAE6OF02JV68K.26.60.F05.1.454.CMB.1.raw
  modified_base (204)..(204): a, c, t, g, unknown or other
  misc_feature (204)..(204): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatgtgctgacgcagtctccagcccaccctgtctgcctctaccgaggggaaangtcaccatctccgtgtcgggccgtcaggagtattagcagcaacttagcctggcaccagcagaacctggcacggctcccaggcctcctcattcgttgactgccgtaccaccgacgggtcccacgttccggttcccacggtcctaggttcaggtcggcaggtcgcgtctcgacgacngtacgttcacttccgtacacctanaccaacacgcctgacctagtctagagttatttgacttagtttatctagtcagtctaagttatctatcgtacgtcgccgtacttccgtaccgttccgacgtaacggaccacggtacgtaggaactaacgtaaacggacttaggtccgactacgcctacgtactcgttacg

SEQ ID NO: 41508 - DNA, 502 bp, Homo sapiens
  misc_feature: GYAE6OF02GVGTF.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctcctcatctttgatgccgtccaccagggccactggtttcccagccaggttcagtggcagtgcgtctgcgacagagttcactcctcaccatccaacacgcctgcagtctgaagtatttgctagtttattacttgtctagtctagtatactatgactggcctctcaccttcgaccaggacacgactggatactaaacgactgtcgctcgacactatctcg

SEQ ID NO: 41509 - DNA, 525 bp, Homo sapiens
  misc_feature: GYAE6OF02GOKR9.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctcctcatctttgatgcgtccaccagggccactggttcccagccaggttcagtggcagtgcgtctgcgacagagttcactctccaccatccaacacgcctgcagtctagaagtattttgctagtttattacttgtcagtctagtatcatgactcggcctctccaccgttcggaccgaagggaccacgacgtggacgtaacttaaacgaacttggtacggtctacgccaactacgtcttaccg

SEQ ID NO: 41510 - DNA, 490 bp, Homo sapiens
  misc_feature: GYAE6OF02HKKYS.26.60.F05.1.454.CMB.1.raw
  modified_base (200)..(200): a, c, t, g, unknown or other
  misc_feature (200)..(200): n is a, c, g, or t
  modified_base (432)..(432): a, c, t, g, unknown or other
  misc_feature (432)..(432): n is a, c, g, or t
  modified_base (463)..(463): a, c, t, g, unknown or other
  misc_feature (463)..(463): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctcctcatctttgatgcgtccaccagggccactggttcccagccaggttcagtggcagtgcgtctgcgacagagttcactctcaccatcaacagcctgcagtctgaagtatttgctagtttattactgtcagcagtatcatgactggccnctcaccttcggaccaagggcacgacgtgganataaacgactgtgactgcactatctcg

SEQ ID NO: 41511 - DNA, 489 bp, Homo sapiens
  misc_feature: GYAE6OF02FN9J1.26.60.F05.1.454.CMB.1.raw
  modified_base (201)..(201): a, c, t, g, unknown or other
  misc_feature (201)..(201): n is a, c, g, or t
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctcctcatctttgatgcgtccacagggccactggtttcccagccaggttcagtggcagtncgtctgcgacagagttcactctcaccatcaacngcctgcaggtctgaagtattttgctagtttattactgtcagtcagtatcatnactggcnctcaccttcgccaaggcacgacgtggacgataacgacttgngctgcacntntcg

SEQ ID NO: 41512 - DNA, 569 bp, Homo sapiens
  misc_feature: GYAE6OF02FVY3D.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccgtcagagtattagcagcaacttagcctggcaccagcagaacctgggcaggcctcccaggcctcctcattctttgatgccgtccaccgagggccacgttcggtttcccagcctaggttcaggtggcaggtcgcgtctgcgacagtacgttcacttctcacccatcaacacgcctgcagtctagtaagtattttcgcttagtttattacttgtcagtctagttatctagtacgtacgtcggcctctcctaccgttcggacccgtaacgggaccacggacgtagggaacgtaacgttaaaccgtaacgttaggtacggtacctacggacctaaccgtacttccgttacg

SEQ ID NO: 41513 - DNA, 578 bp, Homo sapiens
  misc_feature: GYAE6OF02JB1WS.26.60.F05.1.454.CMB.1.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (317)..(317): a, c, t, g, unknown or other
  misc_feature (317)..(317): n is a, c, g, or t
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
tcagagactatactcacgaccggtgctcgatttagtacgtcatcagggaaagggggaggaactgctcagttaggacccagacggaaccatggaagccccagcgaccagcttctcttcctcctgcctactctggctcccagactacccactggcaaaactagtagctgacgcagtctccagccaccctgtctgtcctctccgaggggaaanagtcaccatcctcctgtacgggccgtnagagtattacgccagctaacttacgcctggccacagcaagaacctggcaggcctccgagctcctcatcttgatgctcacnggccactcggttccngccaggttcagtcgcaggtcgcgtcnggcgacgagtagtttacctcgtccaccataccaacgacgccctagcacgtgtagtaaagtactttgacttagtttaacttacgtgttcagctacgtatcagttcgactcggccgtctccgtaccgttaccggacgaacggcaccggtacgtaggtaacgtaacgttaaaccgtacgtacggtacgtcgtcgtaaccgtaccgtacttcgttcggtttacc

SEQ ID NO: 41514 - DNA, 495 bp, Homo sapiens
  misc_feature: GYAE6OF02FIZLA.26.60.F05.1.454.CMB.1.raw
  modified_base (201)..(201): a, c, t, g, unknown or other
  misc_feature (201)..(201): n is a, c, g, or t
  modified_base (439)..(439): a, c, t, g, unknown or other
  misc_feature (439)..(439): n is a, c, g, or t
  modified_base (467)..(467): a, c, t, g, unknown or other
  misc_feature (467)..(467): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctcctcatctttgatgcgtccaccagggccactcggtttcccagccaggttcagtggcagtgcgtctgcgacagagttcactctcaccatcaacagcctgcagtctagaagtatttgctagtttattactgtcagtctagtatcatgactggcctntctccttcggccaaggcacgacgtgganattaaacgactgtgctgacaccatctcg

SEQ ID NO: 41515 - DNA, 651 bp, Homo sapiens
  misc_feature: GYAE6OF02JY0E6.26.60.F05.1.454.CMB.1.raw
  modified_base (202)..(202): a, c, t, g, unknown or other
  misc_feature (202)..(202): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccagggggaaangtcaccatctcctgtcgggccggtcagatattagcagcaacttagcctggcaccagcagaacctggcaggcctccaggctcctcatcttgatcgcgtccaccgagggccacgttcggttccagcctaggttcagtcggcagtcgcgtctggcgacgagtacgttcactctacacctataccaacgacgcctacgtacgagtacgtagtaacgttacgttttagacttaagttttacttacgttacggtactaacgtccttaaggttacttactagttacgtaaccgttcgggacccgttcgttacccgtacccggttaccgggtaacccgtaacggggtaccgtaccggtaaccggtaacgggtaaacggtaacgtttaaaaccggtaacgtttcgggttaacgggtccgttaccggtaaccctaaccggttacgttacccgttaccgg

SEQ ID NO: 41516 - DNA, 557 bp, Homo sapiens
  misc_feature: GYAE6OF02HH4TF.26.60.F05.1.454.CMB.1.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctctcatctttgatgcgtccaccgagggccacgtcggttcccagccaggttcagtggcagtcgcgtctgcgacngtagtcactcncacntcagcacgcctgcagtctagaagtattgtacgtacttaatttacttacgtgtcagtacaaattactaactaccgtcgtcctccgtcgttactacgtttcgggacggtacgggtaccgtaagggttggaacgtaacgtaaccgtaaacgtaacgttggtacggtacttacggacctaccagttccg

SEQ ID NO: 41517 - DNA, 589 bp, Homo sapiens
  misc_feature: GYAE6OF02IM17H.26.60.F05.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (340)..(340): a, c, t, g, unknown or other
  misc_feature (340)..(340): n is a, c, g, or t
  modified_base (493)..(493): a, c, t, g, unknown or other
  misc_feature (493)..(493): n is a, c, g, or t
tcagagactatactcacgaccggtgctcgatttagtacgtcatcagggaaagggggaggaactgctcagttaggacccagacggaaccatggaagcccagcgcagcttctcttcctctgctactctggctcccagataccactggacaaaatagtgctgacgcagtctccagccacctgtctgcctctcgaggggaaangtcacatctctggtcgggccgtnagagtatagcagcaatgcctgcacagcagaacnggcaggcncgagctcnatcttgatcgctaccacgaggccacgttcgtcccagtcctaggttcaggtcgactaggtcgtcggttcnggaccgaacgtaggttactttacctccgtaccaaccgtataccgaaacgacgtccgtcgaccgtacgtacgttaacggtaagttacgtttacgacgttaagtttaacttacgtgtacgtacgtactaggtactgtagtacgtacgtcggtccncgttaccgtaccggtacgaccggaacggtaccgacgtacgtggaacgtaacgttaaacgtacgttacgtgacgtacgctaacgtctacgtgttacc

SEQ ID NO: 41518 - DNA, 531 bp, Homo sapiens
  misc_feature: GYAE6OF02FIMAB.26.60.F05.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgatgacgcagtctccagccaccctgtatgtgtctccaggggaaangtcaccctctcctgcagggccagtcagagtgttagtcgcggcttagcctggtaccagcagacacctgggcagactcccaggctcctcatttangctgcatccaccagggcccatggtactcccagccaggttcagtggcagtgggtctgggacagagttcactctcacctatcagcagcctgcagtctagaagtattgtgactaattttattactgtacagctaaatataactacctggacctccgtcttctacgtttcggacggtacgggacctaaggttggagtagtaccgaaacgtacgttacggtaggtcctggccacctattccg

SEQ ID NO: 41519 - DNA, 574 bp, Homo sapiens
  misc_feature: GYAE6OF02IU4IP.26.60.F05.1.454.CMB.1.raw
  modified_base (203)..(203): a, c, t, g, unknown or other
  misc_feature (203)..(203): n is a, c, g, or t
  modified_base (392)..(392): a, c, t, g, unknown or other
  misc_feature (392)..(392): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatgtgctgacgcagtctccagccaccctgtctgcctctccgagggggaaanagtcaccatcctcctggtcgggccgtcagagtattagcagcaacttagcctggcaccagcagaaacctgggcaggctcccaggctcctcatctttgatgccgtccaccgagggcctacgttcggttcccagcctaggttcaggtcggcaggtgcgtctgcgacagtacgttcactctcacctatcaacncgtcctgctagtctagaagttatttcgacttagtttatactgtcagtctagtactcatgtacgtcggccgtctccgtaccgttccggaccgtaacgggacacggtacgtagggtaacgtaaacgttaaaccggtaacgttcgggtaggtccgttacgaccgtaacccgtagttcgttaccgg

SEQ ID NO: 41520 - DNA, 616 bp, Homo sapiens
  misc_feature: GYAE6OF02GYNCM.26.60.F05.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
tcagagactatactcacgaccggtgctcgatttagtacgtcatcagggtaaagggggtagggaactgctcacgttagggacccacgacggaaccattggaagccccagcgcagcttctcttcctcctgctactctggctcccagataccactggcgaaaatagtgctggtaccgtcagtctcctaagccaccctgtctgcctcnccagggaangtcaccgatctctgtcgggccgtgagacgtattagcagctaacttgcctggcaccagcaagtaacctgggaccaggcctcccaggcctccgtctacttcttagactggaccggtccaccggagggtcctacgttccggtttacccagtcccgtaaggttccaggtcggctaggttcgcgttctagcgacgaggtacgttcgacgtcgtaccacctanaccaacncgtcctgactagtactagaacgttagtttgacttatttacttacttacgtactagtactaagtatactagtacgacgttcggcctactccgtaccgttcggaccgtaaggaccgtacgtacggtaggtaacgtaacgttaaccgacgttggtcgtcgtcgtacgtaccgtagtcgtacg

SEQ ID NO: 41521 - DNA, 630 bp, Homo sapiens
  misc_feature: GYAE6OF02HLOTA.26.60.F05.1.454.CMB.1.raw
  modified_base (203)..(203): a, c, t, g, unknown or other
  misc_feature (203)..(203): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagccaccctgtctgcctctccgaggggaaanagtcaccatctcctgtcgggccgtcagagtatagcagcaacttagcctggcaccagcaagaaacctgggacaggcctcccgaggcctcctcattctttgattcgccgtccaccgacgggcctacgttcggtttcccagccgtaggttcaggtggcagtcgcgtctgcgacagtacgtcactctacacctatccaacgacgccctagcagttctaggtaacgttattttgacttaagttttacttacgtagttaccagtcgtaagttacttcgtagttcggtaaccttcgggccctacgttccgtacccgtttcgggaacccgtaacgggtaccgtaaccggtaacgttacggggaaacttaaaccgttaaaaccggaacgttaggtaccgggtacgtaccggtaaccaaccgttacgttccgttacg

SEQ ID NO: 41522 - DNA, 649 bp, Homo sapiens
  misc_feature: GYAE6OF02G98U3.26.60.F05.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaangtcaccatctcctgtccgggccgtcagagtattagcagcaacttagcctggcaccagcagaacctgggcaggctcccaggctccnatcttgatgcgtccaccgagggccacgttcgttaccccagtcccgtaggttcaggtggcctagtcgcgtcgtggaccgagagtacgtttccacttcctccaaccataccaaccgtacgccctagcctacggttcgtacggtaaagttacgtttttacgacgtttaagttttactttaaccgtgttacctagtacgtagttaacttacgtaagttcggtaaccgtccgggtacccgtccttaaccgtacccgtttacgggacccgtaacgggtacctaccggtaacgtgggaaacgttaaccgttaaaaccggtaacgttggtacggtaccgtacggacccgtaccgtacgttccgtttaccgg

SEQ ID NO: 41523 - DNA, 552 bp, Homo sapiens
  misc_feature: GYAE6OF02JC6O6.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctggcaggctcccaggcctcctcatctttgatcgcgtccaccgagggccacgtcggtttcccagcctaggttcagtgcagtgcgtctgcgacagacgttcactctcaccatcaacacgcctagtagtctagaagtatttgactagtttattacgtgtcagtctagtatcatacgacgtcggccgtctctaccgttccggaccgaacgggtaccacgacgtagggaacgtaacgttaaacgaacgttggtcggtacgtacgacctaaccgtactccgttcgttaccg

SEQ ID NO: 41524 - DNA, 651 bp, Homo sapiens
  misc_feature: GYAE6OF02IPRS0.26.60.F05.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaangtcaccatctctgtcggccgtcagagtatagcagcaacttagcctggcaccagcagaaacctgggcagacctcccaggtcctcctcaattttangccttgcctatcccaccgagggcccagtcgggtactcccagccctaggttccaggttggacctagggttcggggtctggggaacaggtaacgtttccaccttctaccgaacctatccgaggccaagtccccgttaggcctagttccgtagaacgtattggtaggacttaaatttttacgttacgtcgttaccgaagtacgtaaggttacttacgaagttcggaacgtttcggggaccccgtactccgtacccgtttccggggacctaaacgggggtacccaacgggttacgtacgggaacttaacggtttaaaccggacgttacggttaccggcgttaccggacctacccgtaacg

SEQ ID NO: 41525 - DNA, 560 bp, Homo sapiens
  misc_feature: GYAE6OF02GNYQ6.26.60.F05.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
  modified_base (551)..(551): a, c, t, g, unknown or other
  misc_feature (551)..(551): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccgtcagagtattagcagcaacttagcctggcaccagcaagaacctgggcaggctccaggctctnatcttgatgcgtccaccgaggcctacgtcggttcccagtccaggttcaggtgcagtgcgtctgcgacaggtacttcactctcaccatacgaacacgcctgctagtctgaagtactttgacttaagtttacttacgttgtacagtctagtatctaatgacttcgggccctacgttcctaaccgttcgacccgtaagggtaccacgtacggtacggtaaagtaaccgttaaaaccggacgttacggtggacctacgaaccgtacctntaccgttcg

SEQ ID NO: 41526 - DNA, 600 bp, Homo sapiens
  misc_feature: GYAE6OF02FUOU9.26.60.F05.1.454.CMB.1.raw
  modified_base (214)..(214): a, c, t, g, unknown or other
  misc_feature (214)..(214): n is a, c, g, or t
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagagactatactcacgaccggtgctcgatttagtacgtcatcagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggcgtcgtggggganacttggtacacccgtggggggtccctgagactctcctgtgcagcctctggattcacctttagcaactctgtcagtgggctgggtccncaggccgtcggggagggctggcgtggtcncaagtntgatgagagtggtggancanattcagtnactcgngacggccnctcacatcncagacacattcgagancacgcttgttcngacaagtcgaacacgcctagacgacgacggacggaccgaccgggccctacgttacgtttcgtacggttacgaaccgtaacgttctacgtacgaccgtaacggtcccgacccccgttaacggccgtaccgttacccgtttccgtttaacgtaccgtttaccgggtacggggtaccgtaaaccgggg

SEQ ID NO: 41527 - DNA, 636 bp, Homo sapiens
  misc_feature: GYAE6OF02IVA92.26.60.F05.1.454.CMB.1.raw
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (480)..(480): a, c, t, g, unknown or other
  misc_feature (480)..(480): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatgtgctgacgcagtctccagcccaccctgtctcgccctctccgaggggaaangtcaccatcctcctggtcgggccggtnagagtatagcagcaacttgcctgcaccngcaagaactggcaggctccaggcctcncattcttgatcgccgtccaccgaggccctacgtcggttacccagccgtagggttcacgggtcgacgtaggtcgtccgtcgtgacggaactaggttacttccgaacttcctaccgaaccctaagtaccaaaccgtacgtcctcggactacggtctaggtaaacgtttctttcgactttaagtttactttacgtntaccgagtactagttactacacgtcgtaccgtcggacccttccgtcccgtaaccggttccggaaccgtaagggaccctaacggtacggtacggtaaacggttaaacttaaaccggagttcgggtaccgtacgtacgaccgaccttagttccgtacg

SEQ ID NO: 41528 - DNA, 582 bp, Homo sapiens
  misc_feature: GYAE6OF02GS9W3.26.60.F05.1.454.CMB.1.raw
  modified_base (202)..(202): a, c, t, g, unknown or other
  misc_feature (202)..(202): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccgaggggaaanagtcaccatctctgtcgggccgtcagagtatagcagcaacttagcctggcaccagcagaaacctgggcaggcctcccgaggctcctcatcttgatgcgtccaccgagggcctactcggtttcccagtccgaggttcagtggcagtgcgtctgcgacagagttcactctcaccataccaacacgcctgctacgtctagaagtatttgacttagttttaacttactgtacagtcgtaagttatcaattcggtaccgtcgggtccgtccttcctacccggttcggaaccgaacggggtaccaaccggtaccgtagggaacttaacgttaaaacgtaccgttaggtcggtaccttaggaccctaaccttacgttacgttaccgg

SEQ ID NO: 41529 - DNA, 669 bp, Homo sapiens
  misc_feature: GYAE6OF02I7GLL.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagcccaccctgtctgcctctccaggggaangtcaccatcctcctgtcgggccgtcagagtatagcagctaacttgcctgcacagcagaaacctgggcacggctcccgaggtacctcctactacttcgttttggaattcggtcgtaccccgaccggaggggtaccctacgtttccgggtttcccaacggtccgtagggtttccaggttcggctaggtcgtcgttcgacggacgactacggtacggttccacctcctccgaactacgtcaaccgtacgtcctaggcctaggttccgtaggtaaacgttacttttcggactttaaggttttacttacgtcgtactaggtacgtaagttactagtacgtcggtacgtcggccttaccgttccgaaccggttcgggacgggtaacgggtaccgtaagggttaggactaacgttaccgtaaaacggtaccgttgggtactcggtaaccgaccgttacgttaccgtccgttaccg

SEQ ID NO: 41530 - DNA, 568 bp, Homo sapiens
  misc_feature: GYAE6OF02H92UY.26.60.F05.1.454.CMB.1.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (399)..(399): a, c, t, g, unknown or other
  misc_feature (399)..(399): n is a, c, g, or t
  modified_base (504)..(504): a, c, t, g, unknown or other
  misc_feature (504)..(504): n is a, c, g, or t
tcagagactatactcacgaccggtgctcgatttagtacgtcatcagggaaagggggaggaactgctcagttaggacccagacggaaccatggaagcccagcgcagcttctcttcctcctgctactctggctccagataccactggcaaaatagtgctgacgcagtctccagccaccctgtctgcctctaccgaggggaaaactcgtcacatctccgtggtccggcggtcacgngtattagctagctaactagcctggcacagcagaactgganacgctccaggctctcatttangctgacacgtccacacgggccacgtggttacncccgagtccgngttccagtggacagtcgggtctgggactaggtgttcacgtctacgacagtcagctaggcctnacgtgtactggaatacgtttgacgtacgtattatactgtcaagctaaattacgtagtacctcggtacctaccgtcttacgtacgtttacggcgacggttaaccgngttaaggactaacgtaaccgaaaacggtcttacgggtcgacgttaccggacttccgtattccgg

SEQ ID NO: 41531 - DNA, 547 bp, Homo sapiens
  misc_feature: GYAE6OF02GVTKO.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccggtcagagtattagcagcaacttagcctggcaccagcagaaacctgggcaggctcccaggctcctcatcttgatgcgtccaccagggccactcggtttcccagcctaggttcagtggcaggtgcgtctgcgacagtagttcactctacaccatcaacacgcctgcagtctgaagtatttgcttagtttacttactgtacagtctagtatacgatcgactcggccgtcttccaccgttcgggaccgaacgggactaaccggtacgtggaacgtaacgttaaaccgaacgttggtacggtcgtacgacctaaccgtacgtcttacg

SEQ ID NO: 41532 - DNA, 533 bp, Homo sapiens
  misc_feature: GYAE6OF02G1X7R.26.60.F05.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
  modified_base (379)..(379): a, c, t, g, unknown or other
  misc_feature (379)..(379): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccgtcagagtattagcagcaacttagcctggcaccagcagaacctgggcaggctcccaggctcctcatcttgatgcgtccacgngggccacgtcggttcccagcctaggttcagtcggcagtcgcgtctgcgacagacgttcactcacaccatcaacncgccttgctagtctagaagtgtttgacttagtttacgttatcgtcagtcagttactnagtcgacgtcggtccnctctaccgttccggacaacgggacacgtcgtcggaagtaacgtaaacgacgttgtacggtctcgtacgacctagtcttacg

SEQ ID NO: 41533 - DNA, 577 bp, Homo sapiens
  misc_feature: GYAE6OF02G20M2.26.60.F05.1.454.CMB.1.raw
  modified_base (201)..(201): a, c, t, g, unknown or other
  misc_feature (201)..(201): n is a, c, g, or t
  modified_base (396)..(396): a, c, t, g, unknown or other
  misc_feature (396)..(396): n is a, c, g, or t
  modified_base (428)..(428): a, c, t, g, unknown or other
  misc_feature (428)..(428): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaanagtcaccatctcctgtcgggccgtcagagtatagcagcaacttgcctggcaccagcagaaacctgggcaggctcccaggctcctcatctttgagtgccgtccaccgacgggccacgttcggtttcccagcctaggttccagtggcagtgcgtctgcgacaggtagttcactctcaccatcaacagcctgcagtcngaagtctttgcttagtttatactgttcacgtnagttactctagttcgaacgtcggacccgtcttccgtaaccgttccgggaaccgtaacgggtaccgtacggtaaccgtagggaacgttaaccgttaaaacggtaaccgtggttacggtaccgtagacccgtaacctacgttctttaccgg

SEQ ID NO: 41534 - DNA, 773 bp, Homo sapiens
  misc_feature: GYAE6OF02JCDFC.26.60.F05.1.454.CMB.1.raw
  modified_base (199)..(199): a, c, t, g, unknown or other
  misc_feature (199)..(199): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggctcccagataccactggcaaaatgtgctgacgcagtctccagccaccctgtctgcctctccaggggaaanagtcaccatctcctgtcgggccgtcagagtatagcagcaacttagcctggcaccagcagaacctgggcaggcctcccgaggctcctcattctttgatcgcgtccacgagggccctacgttcggttcccagcctaggttacaggtcggcgtaggtcgccgtcgtggccgtaacgaggtaacgtttccaccgttcctacccgaacccacgttacccgaaaccgtaccggtacccgttaggacccgttaacggttaccgttaacggtaaacggtttacgttttttcggaacccgttttaaggtttttaaacctttaccggttacgtttaccgtaaacgttaccgttaaggtttaacctaccgttaacggttacggtaaacccggttcccggggtaaccccgttacccgtttaaccccggtttaacccccggttttacccggggaaacccgggttaaaccggggtaccccgtaaccggttaaccggttaacggggtaaacgttaaacggttaaacccggtacgtttacgggtacggtaccgttacgaacccgttaacccgttacgttacgtttaccgg

SEQ ID NO: 41535 - DNA, 557 bp, Homo sapiens
  misc_feature: GYAE6OF02G80JN.26.60.F05.1.454.CMB.1.raw
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
tcagagactatactcacgaccggtgctcgatttagtacgtcatcagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggcgtcgtgggggagacttggtacacccgtggggggtccctgagactctcctgtgcagcctctggattcacctttagcaactctgtcatgggctgggtccncaggctccggggaaggggctggcgtggctcgaagtattgatgagaatgggtgaagcanatctacgtagactcgtgaagggccncttcaccatcctccagacgacaatttcaggagcacgctgttcngcaatgacagctgagagccgaggaccacgccctctatttcgtgtcgacgaagtctatagcgtacggtccgcccccgtacggccgtacctacctttcgtttcgtacccgtttcggttcggggactaacgggg

SEQ ID NO: 41536 - DNA, 744 bp, Homo sapiens
  misc_feature: GYAE6OF02G3ZDM.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaangtcaccatctcctgtcgggccgtcagagtattagcagcaacttagcctggccaccagcaagaaacctgggacaggcctcccgaggctcctctatctttgatcgccgtccaaccgacgggccctacgttcggtttcccagtcctaggttcaggtcggactaggtcgccgttcgtcggaccgtaacgtaaggtacgtttccacttcgtacccgaaccctaattacccgaaacgtaccggtacccgtaggacccgtacggttaccgttaggttaaacggttacgttttttacggaacctttaaggtttttaaactttaccgttacggttaccgaaacgttacgtaaacgtttactaacgttaacgtttaccgtaccggttaccggtccccgttaccgttaccgtaccccgtttaccggggaacccgtaaaccggggtaccgaaccgggtaacgttaacggggtaaacgttaaacggttaaaacccggaaccgttttaggaccgggttactaccggtaaccctaacccgttacgttaccgttaccgg

SEQ ID NO: 41537 - DNA, 596 bp, Homo sapiens
  misc_feature: GYAE6OF02JATYE.26.60.F05.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (590)..(590): a, c, t, g, unknown or other
  misc_feature (590)..(590): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagccaccctgtctgccctctccgaggggaaangtcaccatctcctggtcgggccgtcagagtattagcagctaacttagcctggcaccagcagaaaccgtgggcaggcctcccgaggcctcctnattctttgattcgccgtccaccgagggcctacgttcggttcccagccgtagggttcagtcggctaggtcgccgttctcggacgacgtagtacgtttccacgttccacacctaataccaacgacgtccctgacgtacgttctagtaacttgtttcgacttaggttttatacgttgtacacgactagttactcacgttcgactcgggccctacgttccaccggttcggaaccgtaagggacctacggacgtggaaacgttaacgttaaaccggcttggtacgcttacgcctaactnttctcg

SEQ ID NO: 41538 - DNA, 697 bp, Homo sapiens
  misc_feature: GYAE6OF02H12FF.26.60.F05.1.454.CMB.1.raw
  modified_base (205)..(205): a, c, t, g, unknown or other
  misc_feature (205)..(205): n is a, c, g, or t
  modified_base (276)..(276): a, c, t, g, unknown or other
  misc_feature (276)..(276): n is a, c, g, or t
  modified_base (691)..(691): a, c, t, g, unknown or other
  misc_feature (691)..(691): n is a, c, g, or t
tcagagactatactcacgaccggtgctcgatttagtacgtcatcagggaaaggggaggaactgctcagttaggacccagacggaaccatggaagccccagcgcagcttctcttcctcctgctactctggctcccagataccactggacaaaaatgtgctgacgcagtcctccagcccaccctgtctcgcctctccgaggggaaanggtacacatctctcgtcgggccgtcagagttatagcaagcaacttagcctggcaccagcaacgtaaaccgnggacagacctcccgaggctcctctacgtctttcgattcggccgtaccaaccggcgggaccctacgttcgggttaccccacggtccgtaagggttccaaggtcggactacggttcgcgtactcggacacgaggtcgttactacctcgacccaacctaactaccgaaactacggtccctacggtaccctaaggttaccgtaagttaaacgttagttttacggaacgttttaacgttttaagttacccttaggttaccaacgttacgaacgttaataccggtaacttacggtcgttaccgggacccttaccgttccgacccggtttaaaccgggaccgtaaacgggaccaaccggtacgaacgggtaaagtaacgttaaaccgtaacgttggaccgtagtccgactaaccgtacgttnttaccg

SEQ ID NO: 41539 - DNA, 801 bp, Homo sapiens
  misc_feature: GYAE6OF02JPFKS.26.60.F05.1.454.CMB.1.raw
  modified_base (165)..(165): a, c, t, g, unknown or other
  misc_feature (165)..(165): n is a, c, g, or t
  modified_base (206)..(206): a, c, t, g, unknown or other
  misc_feature (206)..(206): n is a, c, g, or t
  modified_base (639)..(639): a, c, t, g, unknown or other
  misc_feature (639)..(639): n is a, c, g, or t
tcagagactatactcacgaccggtgctcgatttagtacgtcatcagggaaagggggaggaactgctcagttaggacccaggcggaaccatggaagccccagcgcagcttctcttcctcctgctactctggctcccagactaccactggacaaaatagtgctgacncagtctccagcccaccctgtctgcctctccgaaggggaaangtccaccatcctccgtggtccggggccggtcaaggtagtattagcacggactaacttacgccgtcggccaccgagaccaacggtaaaccgtggggacctaacgggcctacccggacggccttccctactacttcgtttacgagttcggaccgttacccgaaccggacgggccctacgtttaccggtttccccaggtacccgttacggttacgaacggtcggtacgtacggtcggtccgttcgtacgggtaccgtaacgtacgggttaaccgtttcccgtaaccgttacctacccgtaacccttaacgttacccaaaccggtaaccggtcccgtacgtacgtaacggttccgtaacgttaaacggttacgtttttacggacgttttaacggttttaacgttaccgttacgttaccgtacgtacgtacgtttacncggtacgttcgtaccgtacggtcctacgttccggtacgttacggacgtaacgggtactacggtacggtaacggttaaacggttaaccgttaaaacggaccggtttagggtacccggtaaccgttaccggacccgttaaccttaccggttcccgtttaaccgg

SEQ ID NO: 41540 - DNA, 541 bp, Homo sapiens
  misc_feature: GYAE6OF02GL53R.26.60.F05.1.454.CMB.1.raw
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
tcagagactatactcacgaccggtgctcgatttagtacgtcatcagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggcgtctgggggagacttggtacaccctggggggtccctgagactctcctgtgcagcctctggattcacctttagcaactctgtcatgggctgggtccncaggctccggggaagggctggcgtgggtctcaagtattgatgagaatggtgaagcacattctacgtanactccgtagaagggccgcttcaccatctccagacgacaatttcaggagcacgctgttctgcaaatagaacagcctagagagccgaggacaccggccctctactttctgtcgacgaagtctatagcagtcgccccctacgaccgactacttctttcgacttcgtagggctaacggg

SEQ ID NO: 41541 - DNA, 657 bp, Homo sapiens
  misc_feature: GYAE6OF02I2B8O.26.60.F05.1.454.CMB.1.raw
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
tcagagactatactcacgaccggtgctcgatttagtacgtcatcagggaaagggggaggaactgctcagttaggacccagccggaaccatggaagccccagcgcagcttctcttcctcctgctactctggctcccagactaccactggagaaatagtgatgacgcagtctccagccacctgtctgtntcncgagggaangtcacctncctgcaggccngtcagngtgttagcgcgcttagcctaggtaccagcaacgacnccgtgggacacgaccgtcccgtaggccttccgtntaagttttacnggacttgactacgtaccaccgaggcctaagtggttaacccnccgacgccgtagttcaggtcgacgtggtcggtacgaggactaggtacgtacaccgtccaccgacctagtaccgacgtactacgtaccgtacgtacgtagttacgtaacgtaacgttacgttcgtacgttactttaacgtttacgttacgtacgtacgtagtaacgttaaacttaacgtaaccgtaccgttccgtaccgttaccgttaccggttacgtaccggttcgggtaccggtacggtacggttaacggtacggacgtaacgtaacgaacgttacggtacgtcggttaccgacgtacctacgtagttcg

SEQ ID NO: 41542 - DNA, 776 bp, Homo sapiens
  misc_feature: GYAE6OF02FHO1R.26.60.F05.1.454.CMB.1.raw
  modified_base (202)..(202): a, c, t, g, unknown or other
  misc_feature (202)..(202): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagactaccactggcaaaatgtgctgacgcagtctccagccaccctgtctgcctctccaggggaaacngtcaccatctcctggtccgggccgtcagagttattacgctagctaacttacgcctggccaccagcagaacctggcaggcctcccgaggcctcctcacgttctttagactcgtcgtaccacgacgggtcctaacgttcgtttacccaacgtccgtaaggtttcaaggtcggactagggtcgcgttcgtcggacgtaacgagtacgtttcaccgttcctaccgaacctactaccaaaccgtacgcccttaggacctaaggttaccgtacggtaaaacgtttcgtttttacgaaccgttttaacggtttttaacttaccgtttcggtaaccgtaacggtaccgtttaaacggtttaacttaccgtaacgtttacggaaacccgtttccgggggtaccctttaacccgttaccccgttaaacccggttttcccgggaaacccgtaaaccgggggttaccaaaccgggttaccggtttaaacgggaacgtttaaaaccggttaaacccggtaaccgtttagggttaccggttaccgttaccggtacccttaacccggtacttttacccggtttacccgg

SEQ ID NO: 41543 - DNA, 715 bp, Homo sapiens
  misc_feature: GYAE6OF02I4POF.26.60.F05.1.454.CMB.1.raw
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (324)..(324): a, c, t, g, unknown or other
  misc_feature (324)..(324): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (418)..(418): a, c, t, g, unknown or other
  misc_feature (418)..(418): n is a, c, g, or t
  modified_base (532)..(532): a, c, t, g, unknown or other
  misc_feature (532)..(532): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggcctcccagataccactggacaaaatagtgctagacgcagtctccagccaccctgtcngcctnaccgagggaangtcacatctctgtcgggccgtnagtagttatgaccagacctaattacgcctaggaccaccgaggacctaaaggaacctgggacacggtcctacccgaggtaccttcacctaattcgttagnttccggaccgtcccacggtaacggcctacgtcgtttacccagtccgtaggttacgnggttnacctaggttcgaccggtctcggacgttaaacgngttcgtaccgactttacgcccaactactaaccaacgtaccgtcccgtaggacttaacggtccttaaggaacgtttagttacgtaactttaacggtttatttaaccgctttacgngtaaccttaaggtctaactacggttactacggtaccgttccggtactacccgtacccgtaaccgggagtaaccgggaaccctacggtaaccgggtcggttaaaaagtaccccggttaaagtacccgtttaggggtccctaaaccgtccgttaaacccgggtactttaaccctccggtttacgg

SEQ ID NO: 41544 - DNA, 644 bp, Homo sapiens
  misc_feature: GYAE6OF02G3AIF.26.60.F05.1.454.CMB.1.raw
  modified_base (201)..(201): a, c, t, g, unknown or other
  misc_feature (201)..(201): n is a, c, g, or t
tcagagactatactcacgaccggtgctcgatttagtacgtcatcagggaaagggggaggaactgctcagtttaggacccagacggaaccatggaagccccagcgcagcttctcttcctcctgctactctggctcccagataccactggcaaaatgtgctgacgcagtctccagccacctgtctgcctctccgaggggaaanagtcaccatctcctggtcgggccgtcagagtatagcagcaacttagcctggcacagcaagaaccgtgggcaggcctcccgaggcctcctactacttcgtttgacttcgccgtccaccgacgggcctacgttcggtttacccaggtcctaggttaccaggtcggcgtaggtcggtcgttcgtacggccgaacgagtacgttaccacgttcctaccgacctaacgtaccgaacgtaccgtccgtaggacttacgtacgtagtaacgttacgttttagaccgtttaagttttacgttacgtcgttaccagtacgtagtactagtacgtcgtacgtcggaccgtcttaccgtaccgtaccggaccgtaacggacctacggtacgtaggtaacgttaacggtaaacgtacgttaggtacggtacgtacgaccctactacgttcttacg

SEQ ID NO: 41545 - DNA, 662 bp, Homo sapiens
  misc_feature: GYAE6OF02IVQ8O.26.60.F05.1.454.CMB.1.raw
  modified_base (175)..(175): a, c, t, g, unknown or other
  misc_feature (175)..(175): n is a, c, g, or t
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (516)..(516): a, c, t, g, unknown or other
  misc_feature (516)..(516): n is a, c, g, or t
tcagagactatactcacgaccggtgctcgatttagtacgtcatcagggaaaggggaggaactgctcagttaggacccagacggaaccatggaagcccagcgcagcttctcttcctcctgctactctgctccagactaccactggacaaaatagtgctgacgcagtctccaagccncctgtctgtcgtcctcgaggggaaanagtccacctcctccgngacgacgggccacgtcagtaggtaggttagcggtcggtcttacgccgtagggttaccaggaccaacggtaccaccggtcggggactacgaccgtaccccgaacggtcctcctacttactttagtcgtctcgactacgtcccacgtacggcctacgtcggtactccgacgtccgtagtcaggtgccgtaggtcgggtacgtacggaacgtaggttactcgtaaccgtctaaccgtaccagtcgaacgtcgacgttccgcgtactacgttcgtacgaagttagtgtacgtactttaaattntactgtacagtactaataacgtactacgtcgtcccgttcgtaccttcgtaccgttcgggacggttacgggaaccgtttagggtacgtaacgaacgttaaccgaaacgtacggtaccggtagacccgtacgaccgtactgttaccgg

SEQ ID NO: 41546 - DNA, 783 bp, Homo sapiens
  misc_feature: GYAE6OF02FSFR4.26.60.F05.1.454.CMB.1.raw
  modified_base (177)..(177): a, c, t, g, unknown or other
  misc_feature (177)..(177): n is a, c, g, or t
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
tcagagactatactcacgaccggtgctcgatttagtacgtcatcagggaaagggggaggaactgctcagtttaggacccagacgggaaccatggaagccccagcgcagcttctcttcctcctgctactctggctcccagatattaccggaaaaatatgatgactcagtctccaggcnccctgtctgtgtctacgaaggggaangtccaccctntcctgcagggcctagtcagagtgttaagaacaacttgcctaggtaaccagccaagaacctggccaggctcccgaggtcctcctnactctcgtggtnacctaactccgaaccgacgggcccaagttcggtaccgtccccggactaagatttcgaggtcggtcggacggggttctagggactaacggtaactttcgaccgttacctaccgaacctactacccaaccggtacgtaccctaggacctaggttacgtaaggtaagtttacgttttcgtaactttaacgttttacgttaccgttacgtaccgttaacggtacctaaacggttaaccgaaccgtaaaccgttccggtacctttaccggttacccgttacccggtttaacggggtaccggggaaaccggggtacgttaacggggggtaacggtaacggttaaccggttaaccgaaccgggtaacggttaaccggttcggggttaaccggtactttaaccggtaacccgtaaccgtttaacggtccgttttacggttaccgtttaaccttcccggttttacccgtccccgtttaaccgg

SEQ ID NO: 41547 - DNA, 826 bp, Homo sapiens
  misc_feature: GYAE6OF02IUU18.26.60.F05.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccgaaggggaanagtccaccatcctcctgtccgggccgtnagagtatagcagacaacgttgcctggaccaccgagaccgaacgtaaaccgtggggccaagggcccctaccccgaggtccccttaccgtacctacgtttaccgtttaggacgttcggacccgttacccgaacccgggaacgggggtacccccttaacgggttttcccgggtttaccccccaagggttcccccgttaagggtttcccgaaaggggttccggaccctaaggggttccgtacccgggtttaccgtcggggtaaacccggtacggttaacgggtaaccgttttaccgaaacccgttttcccgacccgttaaaccccgtattaccccgtacccgtaccgtacccgttacggaccgtacggttaccgttaacggtaaacggttaacttttccggaacttacggttaccttaacgttaccgttcgtaacgacgtaaccgtaaactttaagttaaccgtttacgtacggttaccgttccgttaccggtttacggggacccggggtaacctaggtccgtacggtacgtaaccgtaccgtaaacccggtagtccggtacgtccgtacgcctacctacgttccgttacgttcttaccg

SEQ ID NO: 41548 - DNA, 827 bp, Homo sapiens
  misc_feature: GYAE6OF02IIXP2.26.60.F05.1.454.CMB.1.raw
  modified_base (207)..(207): a, c, t, g, unknown or other
  misc_feature (207)..(207): n is a, c, g, or t
tcagagactatactcacgaccggtgctcgatttagtacgtcatcaggggaaagggggaggaactgctcagttaggacccagacggaaccatggaagccccagcgcagcttctcttcctcctgctactctcggctcccagataccactggacaaaatagtgctgacgcagtctccacgccaccctgtctcgcctctccgaggggaaanacgtcaccatcgtccgtcggtcgggaccggtcaagtacgttattagcgacgtactaaccgttacgtccgtcggaccacccgaagtaccaaacggaaaccgtggggcaacgggtccccacgaccggtcctccgtactacgttccttaggacttccggccgttacccgaacgtccgggtaccccgtaacggtttcccggttttacccgaaccggtaccgtaacgggttttcggaaccggttcggaccgtaaccggtggcccgttaccggaccgacgggtaaaccgttaaagggtaccgtttacccgtaaccttccgttaccccaaccctaataacccccgttaacggacccgttaacccggaccgtttaccgaccgggtacttaaacgggttagtttaacttttcgggacttttaaaggttttacgtttaccgttgtacccgaagtaccgttaacggttacttagacgttaccgtaacgtcccggtccgtaccttacccgtacgttacccgggaaccgtaagggaccctaacgggtggttaaacggaacttaaacggttaaacccgttacggttacgggtcgtaacggtccgaaccggttaaccgttaccgtcgtttaccgg

SEQ ID NO: 41549 - DNA, 671 bp, Homo sapiens
  misc_feature: GYAE6OF02JKIZY.26.60.F05.1.454.CMB.1.raw
  modified_base (203)..(203): a, c, t, g, unknown or other
  misc_feature (203)..(203): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagcccacctgtctgcctctccgaaggggaanagtcaccgtatccgtcctggtccgggccgtcgagtagtattaggcagcaacttagcctggcaccagcaaggtaacctcgggacaggcctccgaggcctaccgtctaacgttcttagactcggccgtaccacggtacggcctacgttcgtttacccgagccgttaggttaccnggtcggctaggtcgcgttcgngacgactagtcgttacnctcaccanacgtacaacgtacgctagacctacggtactaggttaacttgttaccgtacttaacggtttactttacgtcgttacaacggtctaaggtttaccagttagtaccggtacctacgggtacccttcccgttaacggttacccgttaccgggaaccgtaaccggtaccgtaacggttacctaaggggtaacttaaacgttaacccggtaggtcgttacccgtcgtaaccgtccgaaccttaggttccttaccgg

SEQ ID NO: 41550 - DNA, 977 bp, Homo sapiens
  misc_feature: GYAE6OF02IWQA5.26.60.F05.1.454.CMB.1.raw
tcagagactatactcacgaccggtgctcgatttagtacgtcatcaggggaaagggggaggaactgctcagttacggacccagacggaaccatggaacgccccagcgcagcttctccttcctcctgccttactctcggcctcccagactaccacgtggaacaaatgtggctagacgctagttcctaccacgaccctacccttgtctcgcccttcgtaccggaaggggtaaactcgtactaaccctatcccgttcgtacggggtaccgggccgtactaggtagttacgtacggaccagtacctaaacgttccggtaccgtcgggaccaacctacggtaccgtaaacggtaaccggtgggtaaccaacccggtcctaaccccggtaccggtcgttacccgttacgttaacgtttccgttaggtaacgcccggtacccgttacccgaaccggtaccgggtaccttacccgggttttaccggttaccccaacggttccccggtaaagggtttcccgtaacgggtccggtaaccggtacggtttccggacccttacggtccgggtaaacttaaccggtaacgttacccgttaacgttacccccgttccggtaaaccaacccgtaccgtaagtaaacccgtcccgtacgttccggttaaccgtacgttacggtaacggttaaacggtttcgttttaacggtaaccgttttcggtttttaaacgtttacccgggttacgggtttaccgtaacggttaccttaacgggtttaactacccggtttaccggtttacgtaccgggttaccgttaccccggttcgtttaacccgaccgggtttaacccgggaaccggttaaccgggttaaccctcggggtaacgttaacccggggttaaacgttaaaccgtaaaccgggtttaccgttcgggttaacccgttaccggttaaccgacccggttaaccggtttaccttccgggtttaacccg

SEQ ID NO: 41551 - DNA, 828 bp, Homo sapiens
  misc_feature: GYAE6OF02IUSE8.26.60.F05.1.454.CMB.1.raw
  modified_base (150)..(150): a, c, t, g, unknown or other
  misc_feature (150)..(150): n is a, c, g, or t
  modified_base (211)..(211): a, c, t, g, unknown or other
  misc_feature (211)..(211): n is a, c, g, or t
  modified_base (376)..(376): a, c, t, g, unknown or other
  misc_feature (376)..(376): n is a, c, g, or t
  modified_base (572)..(572): a, c, t, g, unknown or other
  misc_feature (572)..(572): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggaanaaatagtgatgacgcacgtcctccagcccacctgtcctgtctcctacggaaggggtaaacncgtacctaccctctcctcggcgacgggacctagtcaacgtaggttacggttacgtccggtccggtacttcggtacccgttacgggtacccaacggccgaacgaccgtaccggtacgggactaacggtacccgtacccgacggtcctaccgttactaacgtttacncgtaccgttacgactaaccgtaccccgacggacggtacccgtagttaccggtaactaccccggacgtaccggttacgggtttaccgaggtaccggtaacgtggggttaccgggttaaccggttgggaaaacccgtaggtttaccggtacctacggtccctaccgtaacctagaccgaacggttcccaggttacccnggtacttccggtagtaagtaaacgttcgttacgtaagttaaccgtttaaacttttagacctaggggtaactaaccggtaaataaacggttttaacctaaccgttacccgggtccgttccccgtttacgtaccccgtttaaaggttaccgggtaacccgggtaacggggtaccgaacggttttacggaaaggtaacgttacccggtaaacgtaaccggtgtacgtacccggtgtaaccctcgtaaccttagggttcc

SEQ ID NO: 41552 - DNA, 727 bp, Homo sapiens
  misc_feature: GYAE6OF02FMISU.26.60.F05.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggagaaatagtgatgacgcagtctccagccaccctgtactgtgtctccaggggaaangtcaccctctctgcagggcagtcagagtgttagtcgcggcttagcctggtaaccagacagacaccgtgggcagaactcccgaaggcctcctntactttancgtactcgtcgaacttccgaaccgacggccaacgtggtaacctcccagcctaggttcaggtggactaggtggtactgggaatagtacgtttcaccgttcctacgaacctagtaccagtacacgtacctggaccgtagttccgaaggtaaacggtcgttacgtggtaactaaacgtttttagttaccttaagtactaacggtaaccttaaaagttaaaccgttaaaccgttaaccccgttacggttacccccgttaccggttacccttaacgttaaccccgggtttttaccgggggaacccggggttaacggtaacccgggtttaaacgggttaacggtaaccggtaaacgttaaacccggtaaaaaccgttaacggttacggttacggggtacctaccgggtacctaacccgttagttaacccgg

SEQ ID NO: 41553 - DNA, 581 bp, Homo sapiens
  misc_feature: GYAE6OF02GKI3J.26.60.F05.1.454.CMB.1.raw
  modified_base (300)..(300): a, c, t, g, unknown or other
  misc_feature (300)..(300): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatgtgctgacgcagtctccaagccacctgtactcgcctctccagggggaaaatacgtcaaccagtctcctggtccgggccgtcaagagttattacgctagccaaacgttagcctggcaccagctagaaacctggcaggctccgagctcncatcttgatgcgtccacgaggctatggttccagctaggtcagtgcagtgctntgcgtacagagttcacgtnccgtaacatacaactagcctagacgtagtctagaagtacttttgacttaggtttactacgtagttacagtcctaggtactacgagttacgacgtgggacccgtacttacctaaccgttcggaccgaaacgggtaccaccggtaacgtgggtaactaacgttaaaaccgagttcggtacggaccgttagaccggtaacccagttcgtaccg

SEQ ID NO: 41554 - DNA, 665 bp, Homo sapiens
  misc_feature: GYAE6OF02JQWK6.26.60.F05.1.454.CMB.1.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (511)..(511): a, c, t, g, unknown or other
  misc_feature (511)..(511): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggacaaaatagtgctgacgcagtctccagccaccctgtctgcctctccgaaggggaaangtcaccatcctccgtggtccgggccggtcagagttacttagcagcaacttgcctggactaccgagacaacggaaacccgtggggaccacgggtcctcccgaggtacctcctnaacgttctttgactcgccgtacctaccggacggtaccctacggttccggttaccccgacgtccgtaaggttcgaacggtcggacctagggtcttccggtctcggacgacgtacgtacgttcacttccgactaaccgntacgaccncgtacctgactagtatagtaacgttgtttacgcgttaagtttacttacgngtacgtgtacgtatacgtacagtacgtacgtcgtccctacgtcgttaccgtacggacgtaacgggtaccacggttacgtacgggtaacttaaacggttaaccgtacggttggaccgttacggtccttaaccgaaaccgtttgtcccgttaacgg

SEQ ID NO: 41555 - DNA, 701 bp, Homo sapiens
  misc_feature: GYAE6OF02I3SNQ.26.60.F05.1.454.CMB.1.raw
  modified_base (204)..(204): a, c, t, g, unknown or other
  misc_feature (204)..(204): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
  modified_base (687)..(687): a, c, t, g, unknown or other
  misc_feature (687)..(687): n is a, c, g, or t
tcagagactatactcacgaccggtgctcgatttagtacgtcatcagggaaagggggaggaactgctcagttaggacccagacggaaccatggaagccccagcgcagcttctcttcctcctgctactctggctcccagataccactggcaaaatgtgctgacgcagtctccagccaccctgtctcgcctcgtccgaaggggaaancgtaccactatccttccgtggtccgggccgtcaggtacgttagttacgcgaacgctaaacgttgccgtaggcctaaccgaggacaacggtaaaccgtggggaccaacggtcccttacccggagttcctccgtactacgttctttaggacttcggccgtacgacccggacgggtaccctaccggtttccggttaccccgagtaccctaggggtttaccacgggttggacgtagtcggtcgtctacgcgactacgtcgttacncgtacnccacctagtaccacgtacgcctagactgtctagtacgttagtttcgacttaacgttacttacgtcgtaacgctacgtagtactacgtacgttcgtacgtacgtcccgttaccttaccgtacccgttacgggaacctaacgggaccgtacggtaccggttaaggtaacgttaaacgttaaccgtacgtttaccggacgtacggttacaccggttacnccttacgttacccg

SEQ ID NO: 41556 - DNA, 415 bp, Homo sapiens
  misc_feature: GYAE6OF01EPHUK.15.20.B09.1.454.CMB.1.raw
  modified_base (402)..(415): a, c, t, g, unknown or other
  misc_feature (402)..(415): n is a, c, g, or t
tcagtctacgtagccacgaccggtgctcgatttagtgtagtgtgaagggactggaggtggattggatatatctattacagtgggggcaccaactacaacccctccctcaagagtcgagtcatcatttcagtagacacgtccaagaaccagttctccctgaagatgagctctgtgaccgccgctgacacggccgtctagttattgtgcgagacatcggcacctaagttggttcgacccctggggccagggaacccggtcaccgtcgcctcagcctccaccaagggcccatcggtctccctggcacctctccaagagcacctctgggggcacagcggccctgggctgcctggtcaaggactacttccgctacgtagactgagcgggctgggcaaggcgcatagnnnnnnnnnnnnnn

SEQ ID NO: 41557 - DNA, 517 bp, Homo sapiens
  misc_feature: GYAE6OF01BHSDK.15.20.B09.1.454.CMB.1.raw
  modified_base (416)..(416): a, c, t, g, unknown or other
  misc_feature (416)..(416): n is a, c, g, or t
  modified_base (484)..(484): a, c, t, g, unknown or other
  misc_feature (484)..(484): n is a, c, g, or t
  modified_base (498)..(498): a, c, t, g, unknown or other
  misc_feature (498)..(498): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacgtatgaattggttgagacaggccccggagaggggcttgagtggatgggatggatcagcccttacggaactaaaacagagtatgcagagaagttccgagggcagagtcatcatcaccgcggacacatccacgagtacagcctacatggaactgagagcctnagatctgacgacacggcacttatacgtgcgacgagagattattgctactcggtctggtctcgtaaccncgcttggcgggacncgtcggggcctaaccgggg

SEQ ID NO: 41558 - DNA, 556 bp, Homo sapiens
  misc_feature: GYAE6OF01DZNNF.15.20.B09.1.454.CMB.1.raw
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccactacggtatgaattggttgagacaggccccggagaggggcttgagtggagtgggatggatcagcccttaacggaactaaaacagagtatgcagagaagtcgagggcagagtcatcatcaccgcggacacactccacgagtacagcctanatggaactgaggancctanagatctagacgacgacggcctaacttactactgacgacgaagataattagtcgactacgttcggtccgtggtacttacggtaaacctacggtcgtttgggtacgggaccgtaccggtgggggccccgtaaaccgggg

SEQ ID NO: 41559 - DNA, 708 bp, Homo sapiens
  misc_feature: GYAE6OF01D722G.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaagccgtggggcctcagtgatggtctcctgcagtgcttctggttactattccttttccaccttacggttatagtaatttggttgagtacgacgggccccggaggaggggtcgttggaggtgggagtggggagtggtactcgacgtacccgtaacggaaactaaaacgagtaagtagtagacgaggaacgtaacgttaccggagggtacgaaggtacgtacaacgttacctaacgtacccgacccggacggtaaccaccgtaaccgtaccgaacggtaactaccgaacgtacctaacgagtaacggtaacgtaggaaccggtacgcctacgacgtacgtacgtacggaaccgaccgtaaccggtaacccttaacgtttacgtacgtacggaccgacggtaagtagtatttagtaccgcgttacgtccgttccggttcggtaccgttacgtaaacccgcggttacggttcggtacgggtacctaccggggttcgggcccggtaaacccgggg

SEQ ID NO: 41560 - DNA, 688 bp, Homo sapiens
  misc_feature: GYAE6OF01D6U9F.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaagcctggggcctcagtgatggtctcctgcagtgcttctggttacattccttttccaccttacggtattgtaagttggtttgagtaccgacgggcccccgggaggacggggtcgttggaggttgggaagtggggagtgggacgtcgacgtacccgttaacggaaactaaaacgagagtatgacagagaacgttccgagggacagtagtcatactataccaccggacggaccaccacgtacccaacgaacgtaaccacgacctaacgagtaacggaacgtggaacggacgtacccgtacgacgtagtccgacggacgaaccgacggtacccttaactttaacgttaccgtacgaccggacgtaaggaacgttacgttagttacgaccgttaaccggttcgggttacccgttcgggtaccgttacgtaaacccgtcggttccggtttggtcggggaccgtaccgggttccggggacccggttaaccccgggg

SEQ ID NO: 41561 - DNA, 659 bp, Homo sapiens
  misc_feature: GYAE6OF01EKVLR.15.20.B09.1.454.CMB.1.raw
  modified_base (345)..(345): a, c, t, g, unknown or other
  misc_feature (345)..(345): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacaggccccggaggaggggcttggagtggagtgggatggatcagcccttacggaactaaaacagagtangacagagaagtccgaggcagagtcatcatcaccgcggacacactccgagacgtaacacgacctacagtacggaactggaaggacgacccgtacgacgtagtccgtaggaacccgaccgaaccgggtaccctaaccgtttaacgtttaccgtacggaccggtacggaaggtaacgggttaactttagttaccggtacctaaccggttcgggttcccgttagggtacccgttaacggttaaccccgtaacggttaccggttcgggttcggggtaacccggtacgggttcggggggaaccccgttaaaccccggggg

SEQ ID NO: 41562 - DNA, 869 bp, Homo sapiens
  misc_feature: GYAE6OF01DHZZX.15.20.B09.1.454.CMB.1.raw
  modified_base (214)..(214): a, c, t, g, unknown or other
  misc_feature (214)..(214): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcattcctttttcttggtggcagcagcaacaggtgcccactcccaggttcacctggtgcagtctggagctgagctgcagaagccgtggggcctnagtgatggtctcctgcagtgtcttcgtggttactactttccttttaccaccgttacggtatagtaagtttggtagaacgacgaccgggccccggaggacgggtcgttaggaggttaggagtgggagtaggactcgtacggtacccgtttaaacggaaaacttaaaacgaaggtaagtaagtacggacgaaagggtaacggtaaaccggtttaccgaaagggggtaccaaaggtaacggttacaacgtaaccgtaacgttacccggaacccgggtaaccggaaacctaacctaaccgttacccgaaacggtaaaccgtaaccgaccgtaacccgtaacgaaggttaccgggaaaccgttagggaacgggtaccgtacccgttaacgaaacggttaacctttaccggaaccggtaaacccggaacccggtaaccccggtaacccgtttaaaccgttttaaccgttttaaacccgacgggttaacccggacggtaaacgggttaacgtttaactttacggttaccgaacccgtttaaccgggttaccgggttaccccgttagggttacccttaaccggtaacccgttacggttcccggtttaggggtacccgggaacccgtaccggggttaccggggtacccggttaaaccccggggg

SEQ ID NO: 41563 - DNA, 653 bp, Homo sapiens
  misc_feature: GYAE6OF01EIW4Z.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagagcctggggcctcagtgatggtctcctgcagtgcttctggttacattcttttccaccttacggtatgtaattggttgagacgacgggccccggaggacgggtcttggaggttggagtgggagtggatcgacgacccgttaacggaactaaaacgagaagtagtagacgagacgtaacgtcgaggcgagagtcatcactaccgacgcggacacactaccgaacgtacgtacacgtacctacgagtacggaacgtaggacggaccgtaccggtagaagtacgttccgtacggaaccgacggaccgtacctaacgtttacgttacgtcggaccgacggaagtacgtaatttacgtcgaccgtacgttcggttccgttacgggtaccgttaccggtaaccgtaccgttcggttacgggtacgggtaccgttacgggtccggggtcccggtaaacccggg

SEQ ID NO: 41564 - DNA, 663 bp, Homo sapiens
  misc_feature: GYAE6OF01BXXB9.15.20.B09.1.454.CMB.1.raw
  modified_base (459)..(459): a, c, t, g, unknown or other
  misc_feature (459)..(459): n is a, c, g, or t
tcagtctacgtagccacgaccggtgctcgatttagtgtagtgtgaaggggacccaaaaaccacacccctccttgggtgaatcccctagatcacagctcctcaccatggacgggacctggagcatcctttttcttggtggcagcagcaacaggtgcccactcccaggttcacctggtgcagtctggagctgagctgcagaagcctggggcctcagtgatggtctcctgcagtgcttcgtggttacattctttccacctacgtatgaattggttgagacgacggccccggagacgggtcttggagtggtagtgggatggactcgacgtacccgttaacggaactaaaacgagtagtatgacgagagtaacgttccgagggacagagtcatcagtaccacgacgacacataccgacgacgtacacgacctacgaacgtacggaactggacggacgtccgtanacgtactccgtaggaccgtaaccgaccggtacccttaacgtttacgtaccgtacggaccggtacggtaaggtacgtaaagtttacgttacggtaccttaaccggttcggttacccgttagggtaccgttaaccggtaacccgtacggttccgtttacgggtcgggtaccgtaccgggtccgggggtacccggttaaacccgggg

SEQ ID NO: 41565 - DNA, 604 bp, Homo sapiens
  misc_feature: GYAE6OF01D7KZ0.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaagcctggggcctcagtgatggtctcctgcagtgcttctggttacacttccttttccaccttacggtattgaatttggttgagacacggccccggagagggcttgagtggagtgggatggatcgacgcccgtttaacggaactaaaacgagagtatgacagagtaacgtccgagggcagagtcatcatcaccgacgacacactaccaacgagtacagcctacgagtaggaactggacggacgccctacagagtctacgacgaccgacgaccttacttactacgtcgcgacgaaggtagtacgtttagtgtccgtaacgttcgggtcctagggtccgttaacgtaacccgtcggtaccgtttcggggtacggaccggtaccggtcgggggtcccggtaaacccgggg

SEQ ID NO: 41566 - DNA, 981 bp, Homo sapiens
  misc_feature: GYAE6OF01ESC5J.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaacgccgtggggcctcagtgagtggtcctctgcgtagtgtctttcgtaggttacacgtttccttttaccaccgttaggttataggtaaagtttgggttagacgtaccgaccgggtacccccgggaggacggggtcgttaggagggttagggaggtagggggtagtacgggtacgtacgtaaccggtaccccgtttaaaccgggtaaaaccttaaaaaccgtaaggtaaaggtttaacgttacggaacgtaacgggaaacggttaaacggttaccggaacggggaaccgtaaggtaacggtaactaacgttaccgtaacgttacccggaaccccggaaccggtaaacccgttaaccgaaccgttaccccgaaacggtaaaccggtttaaacccgaaccggtaccccgtttaaaaccgtaacgggttaaccgggtaaaaccgggttcgggtaaaaccgggtccgggtaaaccccgttaaacccggtaacggttaaaccgttaccggttaacccgggttaaacccggaaacccggtaaccccgggtaaccccgtttaaaccgttttaaccgttaaccgttaccggacccgggtaaccggttaacggtaaacggtttacgtttaaacgttccgggtaaccgttaacccggtttccggggttaaccgttaccgggttacccgtttaacccgggtaaacccgttacccgggttcggtttaacccggggtaccgggttaccgggtacccggttacccggggggaaccccgggtttaaaacccccgggggg

SEQ ID NO: 41567 - DNA, 650 bp, Homo sapiens
  misc_feature: GYAE6OF01DWBPI.15.20.B09.1.454.CMB.1.raw
  modified_base (252)..(252): a, c, t, g, unknown or other
  misc_feature (252)..(252): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcattcctttttcttggtggcagcagcaacaggtgcccactcccaggttcaccgtggtgcagtctggagctgagctgcaggacgccgtgggcctcagtgatcggtcctacctgcagtgtcttcgtagttacncttccgtttccaccgttagtattgtagttggtagacgaccgccgggacccggaggacgggtcttggaggtggaggtggtagtggacgtcgaccgtaccgttaacggaaaactaaagagtacgttagacgacgaaggaacggtaacggtaccggaggactaggtacgtactaatcgtaacgtaccgaaccggaccgtacacgtactaccgaacgtacgtaaccacgtacctagtaagtacggaacgtaggacgacgtcctacgagtacgtcgaacggaccgaaccgtacgtaacctacgttagtacgtcggacgcggaatagttacgttatcgtaccgtagttcggtcgtcggtacttcgaaccgttgtcgtggacgacgtcgggtcggacgttaccgg

SEQ ID NO: 41568 - DNA, 780 bp, Homo sapiens
  misc_feature: GYAE6OF01BZTG8.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacggacctggagcatccttttctggtgcagcagcaacaggtcgcccactcccaggttccacctggtgcagtctggagctgagctgcaagacgccgtggggccctgaggtgagtcggtcctccgtgcaggttcgtcctttcgtcggttacactttccttttacccaccgttacggtatacgtaagtttgggtgaacggacgaccggggccccggagggcgggtacttggaggtggagtgggatggactcgacgtacccgtaagaaacctaagagtagtagtgacgaggacgtaagtccggagggcaacgtcgtacacttacacgtaccgaccggtacgtaccacctaccgtaccggaacgtacggtaacccgacgtacccgtaacgtaacggttacggaacctacggggaacgtaccgtccgtaacgtagaccgttcgaacccggaacgtacccggaacggtcccttaacgtttacgtaccggtcggtaccggtaaccggtagggtaccgttaaagttccgttacggacccgtttaccgggttaccgggtccggttacccggttacccggttacccggttaaacccggttcgggttacccgggtttccggggaacggggtaccccgtaccgggggtttccggggggtaacccctttaaaaccccccggggggg

SEQ ID NO: 41569 - DNA, 779 bp, Homo sapiens
  misc_feature: GYAE6OF01BIGTS.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaagtccgtggggcctcgagtgatggtctcctgctagtcgtctttcgttaggtactacgtttccttttacccgaaccgttacggttattagtaagtttggttagacgaccgaaccggcccccgggtaaggaacggggtcgttggacggtgggtagtggggtagtaggacttaccgaacgtaccccgttaaacgggaaaactaaaacgaaggtaagtaagtacggaccgaagtaaacggaaggttaccgaaggggtactaaggacgtacgaacttacgaacgtaccggaacccggtacgaaaccgtaactaacgtacccgtaaacggaagttaacccgaacgaaccgttaaacccgtaggtaacggtaaacgtacgggtaagggaacctcccggtaacgtaacggtaaccttaccggtaacgacggttaaaccggacggaaccttaacgttaactacggtacgacggtccgaaggtaagtactttaacgtcgtacgttacgttcggtcccgtaggttaccgtacgtaaaccgttcggttaccgttaggacggttaccgacgggttccggggcgtaaacccggg

SEQ ID NO: 41570 - DNA, 778 bp, Homo sapiens
  misc_feature: GYAE6OF01DQC8Z.15.20.B09.1.454.CMB.1.raw
  modified_base (193)..(193): a, c, t, g, unknown or other
  misc_feature (193)..(193): n is a, c, g, or t
tcagtctacgtagccacgaccggtgctcgatttagtgtagtgtgaaggggacccaaaaaccacacccctccttgggagaatcccctagatcacagctcctcaccatggacggacctggagcattcctttttcttggtggcagcagcaacaggtcgcccactcccgaggttccaccgtggtgcagttctggganctggagctgcgaagacgtccgtggggcctcgagtcgtagtcggtcctccgtgctagttctaccttcgttacggttaactctttccttttaccgaccgtttaaggttataggttaagtttcggttagaacgaaccggaccggtaccccggtagggtacggggttccttaggtagggtagggtaacggtaggggtacgtaggtacgttaccggaaccgttaacccggtttaaacgaaaaccgtaaaacgtaaggtaacgttagtacggaaccgtaagtaacggtaacggttcggaagggttacaaggtacgtactaacggtacctacgtacccggaaccggacgtaaacgtcctaaccgtaccgaaacggtactaaccgtacggtacctaacgttaacggtaacggaacggttacgacggactaccgtaactaggtacaacgtcgaacgaccgtacgtacttaacgttactagtcgacgtagtacgtatacgttagtcgtaccgtagtaccgtcgtaggttcctaaacggtcccgtaggttaccgtcgggtaacgtacgtaccgggcgggttaaccgtaaccccggg

SEQ ID NO: 41571 - DNA, 863 bp, Homo sapiens
  misc_feature: GYAE6OF01BKJGE.15.20.B09.1.454.CMB.1.raw
  modified_base (249)..(249): a, c, t, g, unknown or other
  misc_feature (249)..(249): n is a, c, g, or t
tcagtctacgtagccacgaccggtgctcgatttagtgtagtgtgaaggggacccaaaaaccacacccctccttgggagaatcccctagatcacagctcctcaccatggacggacctggagcatcctttttcttggtggcagcagcaacaggtgcccactcccaggttcacctggtgcagtctggagctgagctgcagagccgtggggcctcgagtgagtcggtctcctgctagtgtcttcgtgttactnttcctttccaccgttacggtatagtaacgttggttagacgacgaccgggtacccggagggtacggggtcgttaggtaggtacgggtaggtagggtagttacgggtaactcggtaaccggttacccgttaaacgggaaaacctaaaacggtaggtaaagttacgtacggaaccggtaaggtaacggtaaaccggttcggaacgggacgtaaaggtacgtactaacgtacgtaccgtaccgacccggaccgtaacaaccgtaccgtaccgaacggtaaccgttaccgaaccgtacctaacgtaagggttaacggaacggttaggaaccgggtaccgtacccgttaacgacgttaccgtccgttaaccggaaccggtacccggtaacccgtacccgtttaaacgtttaccgtacccggtacggtaccggtaaacggtaacggttacggttaaacttttccggacggttaacccgttaccgggtttttcccgggtaaccccgttacggggttaaccccgtttaacggtaacccccggtacggtttcccgggtttacgggtacccgggggtaaccgttacccgggggttaccggggaccccggtttaaacccccggggg

SEQ ID NO: 41572 - DNA, 822 bp, Homo sapiens
  misc_feature: GYAE6OF01A5U8T.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacggacctggagcattcctttttcttggtggcaggcagcaacaggtcgcccactcccaggttccacctgggtgcagtctggagctgagctggcagagcctcggggcctcagtgagtcggtctccgtgactagttgtctttcgttcggttactctttccttttacccgaccgttacggtataggtaacgtttgggttacgaaccggaccggaccgggtacccccggtagggtacggggtcgttagggtacggtagggtaggtggggacgttggaacgtcgaaccggtacccgttaaacgggtaaaacctaaaacgaggtaacgtacgtaggtacgtaaggaacgtaacggttaccggaggggacgtaggacgtacacgttacaacgtaccgaacccggtacgaaaccaccgtaacgtacccgaacggtaagttacccaaccgtaaccgtacgtaacgaaggtaacgtagggaacggactacgtacgtaagtacgttacgaacgtaacccggaccgtaacccgggtacctttaaccgtttaaccgtcgttaaccggaccgtaacgggaacggttagtaccgttaacggttacgtaccggttaccggttcggtccgttaacgggttaccgttaaacccggttacgtaccggtttacgggttcggggtaccggtaacccgggttcgggtaaccccgggggtacccggttaacccgggg

SEQ ID NO: 41573 - DNA, 848 bp, Homo sapiens
  misc_feature: GYAE6OF01BEJ0Z.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacggacctggagcattccgtttttcttgggtggcagcagcaacaggtgcccactcccaggttcaccgtggtgcgagtctggagcgtgagctggccaggacgcccgtacggggcctacgagtgtagtcggttccttccgtagccgtaggttcgtccgtttcgttacgggtttaactccgttttcccgttttttacccgacccgtttagggttacttacggttaaagttttggggttaacgaccggtaaccggtaccccggggacccccgggtaaggggtaccgggggttccgttaggggaacggtttggggtaacgttacgggggtaagtttacgggtacgtacccggtaaccggtaacccccggtttaaaacgggtaaaaacctaaaaccggtacgggttaacggtttaacgtacgaacggtaaaagggtaacggtaaacggttacgaacggggtacaacggtacgtacctagtaccgacgtaccgaccggacgtacgaactaccgtacccgtaagaccgtaacgtacgtacccgtaagtacgtaacggaaccgtaggtaaccggccgttaccgacgtacgtacgttcgaaccggaaccgtacccgtaccggacccgtttaatttaccgtacgtcggaccggttacgaagtacgttacttagacgtccgtacggttcggcgtaggtctaaccggaccgttcgtcgtacggtcgggacccgtcggccgggtcgtaaccggg

SEQ ID NO: 41574 - DNA, 668 bp, Homo sapiens
  misc_feature: GYAE6OF01ASO3J.15.20.B09.1.454.CMB.1.raw
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (296)..(296): a, c, t, g, unknown or other
  misc_feature (296)..(296): n is a, c, g, or t
tcagtctacgtagccacgaccggtgctcgatttagtgtagtgtgaaggggacccaaaaaccacaccccctccttgggagaatcccctagatcacagctcctcaccatggacgggacctggagcatcctttttcttggtggcagcagcaacaggtgcccactcccaggttcacctggtgcagtctggagctgagctgcagaagcctggggcctnagtgatgtctcctgcagtgcttntggttacnttctttccactacgtntgaattggtgagacgacggcccggagagggtcttgngtggagtgggatgactgacgcccgttaacggaacctaaaaacgaggtaagtactagacgaaggtacgaaacgttaccgaaggggactaacggaagtaccgaagttaccgaactaccgtaaccccggaccgggaaaccaacaaccgtacccgacggaacgttaaccgaaccggtaccctacgtaagttacggaaacgtgaacggacgtcctacgagatactagaaccgtaccgaccgtactaaccttagtaacgtagaccggagacggtagtaacgtttattacgtaccgtacgttacggccttaggacggtacgttaacccggagttacggttcggacgggtacgtacggtccggggtccgtaaacccgggg

SEQ ID NO: 41575 - DNA, 798 bp, Homo sapiens
  misc_feature: GYAE6OF01DXXZT.15.20.B09.1.454.CMB.1.raw
  modified_base (155)..(155): a, c, t, g, unknown or other
  misc_feature (155)..(155): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcattccttttcttgggtggcagcagcaacaggtncccactccaggttcacctggtgcagtctggagctgagctgcagacgccgtggggacctgagtgatggtctccgtgctagtgctttcgtggttactattccttttaccacgtacggtatgtaattggttagacgacgacgggcccggaggacggggtcttacggaggtgggtaggtacggggagtagggtactacgtacgttaccccgtttaaacgggaaaaccgttaaaacgtaaggtaaagtactacggacgtaaggtaaacggtaaacgttccggaaggggacctaagggtactactaaacttccgaaacgtacccgaacccgggacggaacctaaaccgtaaccgtacccggtaaacggaaacgttaacccgtaaaccgtccttaaacgtacgtaacgggtaacgtaacgggaacggttacgtccctagaacgttagtaccgtaacgaaccggtaccgacccggttaacttaaccgttttacggtaaccgtcgggtaccggtacggttaaacggtacgttaaagtttccggtaacgttacccgtggtttaccgggtccgttaggttcgttaacccggtacctacggttcgggttcgggttacgggtacggtaccgggtcgggggtacccgttaacccggg

SEQ ID NO: 41576 - DNA, 840 bp, Homo sapiens
  misc_feature: GYAE6OF01EZ7PG.15.20.B09.1.454.CMB.1.raw
tcagtctacgtagccacgaccggtgctcgatttagtgtagtgtgaaggggacccaaaaaccacaccccctccttgggagaatccccctagatcacagctcctcaccatgggacgggacctggagcattcctttttcttggtggcagcagcaacgaggtcgccccactcccaggtttccacctgggtgcagtcgtggagctgagctgcagacgccgtggggcctgagtgatggtcctccgtgctagttcgtcctttcgttaggttacctcgtttcccttttaccaaccgtttacggtattaggttaagtttggtacgacggaccggacccgggccccggagggtacgggtcgttaggaggtagggtaggtggggtagtacgggtacgtaccgtaccggtaacccgttaacggaaaactaaaacgagttaaggtatcgacgtaaggtaacggtaaggtacccgggaagggacgtaagtacgtacgtaacgtaccgtaaccgtacccgaacccggtaacccggaaccctaccgtaacccgtaaccccggaacggtaacccgggtaaacctaccggtaacctaaacggtaacggttaaacgggaaccggttagggaacccgggtacccgttaaccccgtacggtaaccgtaccgttaacggaacccggtaaccccggaccggtaacccggtaaccctttaaaccgttacgttaccggtacggtacggtaccgtaaggtaacggttacttaggtccgtacgtaccggttcggtaccgtacgggtacctacgtaaccgtccgttggttcggtcggaccgtgggtacccgggaccggttaacccggg

SEQ ID NO: 41577 - DNA, 870 bp, Homo sapiens
  misc_feature: GYAE6OF01EU1AI.15.20.B09.1.454.CMB.1.raw
  modified_base (208)..(208): a, c, t, g, unknown or other
  misc_feature (208)..(208): n is a, c, g, or t
  modified_base (281)..(281): a, c, t, g, unknown or other
  misc_feature (281)..(281): n is a, c, g, or t
tcagtctacgtagccacgaccggtgctcgatttagtgtagtgtgaaggggaccaaaaaccacaccctccttgggagaatccctagatcacagctcctcaccatgggacgggacctggagcagttcctttttcttgggtggcagcaggcaaagagggtcgccctactcccgtaggttcaccgttgggtgctagttcgtgggagtctggngctgccgaaggacggtccggtggggccctgaggtgagttggtcgtcgtgactaggtcgtctttcgtcgttacnctttccttaccgacgttagttactagttagttggtgaacgtaccgaccgggaccggggtaggtacggggttcgttagggacgggtaggggtaggtggggtacgttacggacgtaccggtaacccggtaacccggtttaaaaccgggaaactttaaaacggcggttaagtacgtcgggtacgaaggtaacggttaaacggtcggaaccgggtagtaacgttacgtacgtaacgtacctaaccgggttaccggacccggtaacggtaaaccctacggtaacccgttaccggggaacgtttaacccggaaccgtaacccggtaacgttaccgggttaaagggtaaacgttaaccgggcgggtaacgggtaaccgacggtacctaggttaacgtaacccggtagaacccgggtaccgtaacgttaacctttaacgttacgtccggtaggacccggttagaacgtacgttagttaccggtgtaaccggttccggttacgggttcgtaccgggttaactccggttaaaccgcggggttacttaccggggtcgggaaacccggttacggggtcccggggtaaccgttacccggggg

SEQ ID NO: 41578 - DNA, 708 bp, Homo sapiens
  misc_feature: GYAE6OF01D6F3O.15.20.B09.1.454.CMB.1.raw
  modified_base (227)..(227): a, c, t, g, unknown or other
  misc_feature (227)..(227): n is a, c, g, or t
  modified_base (229)..(229): a, c, t, g, unknown or other
  misc_feature (229)..(229): n is a, c, g, or t
  modified_base (466)..(466): a, c, t, g, unknown or other
  misc_feature (466)..(466): n is a, c, g, or t
tcagtctacgtagccacgaccggtgctcgatttagtgtagtgtgaagggacccaaaaaccacaccccctccttgggagaatcccctagatcacagctcctcaccatggacggacctggagcattcccgtttttcttggtggcagcagcaacaggtgcccactcccaggttccacctgtgcagtctggagctgagctgcagagccgtgggcctcagtgatgtctcctncngtgcttcgtgttactcttcttttccaccgttacgtatagttaatttggttgagaccgacgggccccggaggagggtcttaggaggtggtagtggggtagtggacgttcgacgtcccgttaacgaaactaaacgagtagtatgacgaagtaacggtaagttcccgaagggacgaaggtacgtctaagtacctagtacccgacccggtacggaaacacctacgacccgagtaaccgtanaccgtacctactaagtacggaactagggacgtacgcctagacgtacttacggtacgaacccgtaacgtaaccgtacccgttaacgtttacgtaccgttggtaacccggtacgtaacgtacggttaattacgttcggaccttaccggttaccggtcccgttacgtacgttaaccggaaacccgttcggttacgtcggttcccggggtaagtccccggggtacgggtcccgggtaaaccccggg

SEQ ID NO: 41579 - DNA, 528 bp, Homo sapiens
  misc_feature: GYAE6OF02GB35K.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatgcagagaagttccagggcagagtcatcatcaccgcggacacatccacgagtacagcctacatggaactagaggacgcctcgagatctagaccgacacggcctacttattactgcgcgaagagtattatgacacgtggtcctggctacgtaaccagtccttggtcgggcacggtggggcctaacgggg

SEQ ID NO: 41580 - DNA, 681 bp, Homo sapiens
  misc_feature: GYAE6OF02HAZX0.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacacggcccccggaggaggggcttggagtgggagtggggatggatcgacgtacccgtttaacggaaacttaaaacgaggtaagtagtcgactaggagaaagttccgaagggcaagagtacagtacatccgaccgcgacacactaccgacgacgtaacgacgaccctaacaacgtacggaaacgtggaacgggacgtacccttacgaagacttacgtacgaaccggtaaccgaccggtaccctaacgtttaacgttaaccgttcggaccgtacggaaaggtaacgttaatttacgttacggacctacggttcgggttcccgttggtaccttaccggttaaacccgtaccggttacgtttcggggtaccgggtacccgtacgggttaccgggggacccgtaacccgggg

SEQ ID NO: 41581 - DNA, 586 bp, Homo sapiens
  misc_feature: GYAE6OF02JJOEO.15.20.B09.1.454.CMB.1.raw
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaacagagtatgcagagaagttccagggcagagtcagtcatcaccgacggacacatcccgacgacgtacagaccctacagtggaaactggaacggancccgtnagatcctaggtacgaccgaaccgggcctaaccgtttattaccgtagaccggccgaagagtaatttatacggctaaccgtcggtcgtacgggtaccttacgtaacccgacggtacttgggaccggtacggaccgttcgggggacctaacccgggg

SEQ ID NO: 41582 - DNA, 647 bp, Homo sapiens
  misc_feature: GYAE6OF02F9L1K.15.20.B09.1.454.CMB.1.raw
  modified_base (167)..(167): a, c, t, g, unknown or other
  misc_feature (167)..(167): n is a, c, g, or t
  modified_base (605)..(647): a, c, t, g, unknown or other
  misc_feature (605)..(647): n is a, c, g, or t
tcagtctacgtagccacgaccggtgctcgatttagtgtagtgtgaagggactggagtggattggatatatctattacagtgggggcaccaactacaacccctccctcaagagtcgagtcatcatttcagtagacacgtccaagaaccagttctccctgaagatggcnctgtgcgccgctcacgacgccggtcctattattagtgcgacgacactcggtccgacctaacgttaggtttcggtacccccgtacccggggtccgggaccgggaaacccgggggtaccccggtacccgtacccggtcccgtcctacgaccgtccccctaccccaaaaccgggaccccggacccctacggttcccggtttccccccctttcccccgggtcggaccccccttaccccctttcccccaaaccgaaagggccgaccccttacccgttcgggggggtaccggggacctaaaccgcggggcccccgtcccggggtcggtcgtcccgtccggttcggtaaacggaacggtacctttcccgtccgtaccgtttaacggacgtacgtaggacgggggccggtacggtcgggaaacggaccgggcccacgtaagtcgcnnnnnnnnnnnnnnnnnnnnnnnnnnnnnnnnnnnnnnnnnnn

SEQ ID NO: 41583 - DNA, 653 bp, Homo sapiens
  misc_feature: GYAE6OF02G7JWD.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacacggcccccggagaggggcttgaggtggagtggggatgggatcgacggtccccgttaacggaaactaaaaacgaggtaacgtaagtaggacgaagaggtaaacgttacccgaaggggacagacgtacagtcaagtccgacccggcggaaccacaactacccgaacgaacgtaaccaacgtaccctaacgacgtacgggaaacctggaacgggacgaccctacgagacttccgtagaaccgaacgaccggtacctaacgtttacttacgtcggacgaccgtaagacgtaattacgtgactacgtcggtcctacggtctaccggtaaccgtacggtcgtttagggtcgggtaccgtacggtacgggacccgtaaccggg

SEQ ID NO: 41584 - DNA, 513 bp, Homo sapiens
  misc_feature: GYAE6OF02IVJMW.15.20.B09.1.454.CMB.1.raw
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggagaggggcttgagtggatggggatggatcagcccttacggaactaaaacagagtatgcagagaagttccagggcagagtcatcatcacgcggacacatccacgagtacagcctacatggaactgaggagcctcagatctgacgacacgccacttatactgcgcgagagtaattntgcactggtctgctgtaaccncgcttcgtgggcctacgtgggcctacgggg

SEQ ID NO: 41585 - DNA, 724 bp, Homo sapiens
  misc_feature: GYAE6OF02JUN0P.15.20.B09.1.454.CMB.1.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
tcagtctacgtagccacgaccggtgctcgatttagtgtagtgtgaaggggaccaaaaccaacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtcncctgcagtnccttctaggttacattcttttccgaaccgttacggtatgtaattggtgagtacacggcccccggaggaggggtcttggaggtggagtgggatggatcgagtcccgttaacgggaaactaaaacgagaagtatgacgagaagtaacggttccgaaggggtcagggactacggactacgtacgttacccgacggaccgggacaaccgtacgttacccgaacggtacgtaaccaacgggtaccctaacgagttacggaaaacgttcgaaagggccgtaccttacggaaagtcgttaccgacggaaccgtaaccggtcccggtaaccctaaccgtttaaccgttacggttacggaacccgttcggaaacgttaaggtaatttacgttcggtaacctacgttcgggttacccggtacgggtaccgttaccggttaaaccggcgttacccggtttgggaccgggttaccctagggtacccggggaccccgttaaccgggg

SEQ ID NO: 41586 - DNA, 553 bp, Homo sapiens
  misc_feature: GYAE6OF02JHJ5M.15.20.B09.1.454.CMB.1.raw
  modified_base (261)..(261): a, c, t, g, unknown or other
  misc_feature (261)..(261): n is a, c, g, or t
  modified_base (365)..(365): a, c, t, g, unknown or other
  misc_feature (365)..(365): n is a, c, g, or t
  modified_base (513)..(513): a, c, t, g, unknown or other
  misc_feature (513)..(513): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtntgaattggttgagtacaggcccccgagaggggcttgagtggatgggatggatcgagcccttacggaactaaaacagagtatgcagagagttccagggcagagtnatcatcaccgcggacacgatccacgagtacagaccctacatggaacttggagaacgccttcagattctgaccgactacggcctaacttacttacgtgccgtacgagacgatttacgttgacacgtggtccctggacttcgtaaacccncgacgtttggtgggtacctacggttcggggcctaacgggg

SEQ ID NO: 41587 - DNA, 619 bp, Homo sapiens
  misc_feature: GYAE6OF02F90H6.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggaggacggggcttggaggtggagtgggagtggatcgacgtcccgttaacggaaactaaaaccgagagtatcgacgagagtaacgttcgagggtcaggagtcatcatcgaccgtcgacacactccacgacgtacacgacctacgagtacggaacgtggaacggacgaccttacgagtactcgtacggacgaaccgaccggtacctaacttacgttaacgtcgaccgtacgaaggtagtaagttactcggactacgtcggttcccgtaggtccgttacgttaccgacggttcgttcgggtacggtcgtaccgggttcggggaccctaacccggggg

SEQ ID NO: 41588 - DNA, 665 bp, Homo sapiens
  misc_feature: GYAE6OF02JO50Y.15.20.B09.1.454.CMB.1.raw
  modified_base (337)..(337): a, c, t, g, unknown or other
  misc_feature (337)..(337): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagtacaggcccccggagaggggcttgagtggatgggatggatcgagccttacggaactaaaacngagtatgcagagaagtcgagggtcagagtcagtcatacgaccgacggactacactaccgaacgacgtaacacgtaccctaagtaacgtagggtaaacctaggaacggacggtacctaacgtaaaatccgtaacggtaaccgaaccgaccgggtaccctaattaaccgttaccgtagaccggtacggtaagtaacgtaaagttacgttacgacgtaccgttcgggttacccgtacgggttacttaacggtaaacccaccggttaccggttacggttaccggggacccgtacgggttcgggggtacccggtaacgggtttaacccccggg

SEQ ID NO: 41589 - DNA, 628 bp, Homo sapiens
  misc_feature: GYAE6OF02I7HF6.15.20.B09.1.454.CMB.1.raw
  modified_base (401)..(401): a, c, t, g, unknown or other
  misc_feature (401)..(401): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacgtatgaattggttgagacaggcccccggagaggggcttgagtggagtgggatggatcgagcccttaacggaactaaaacgagagtatgacagagaagtcgaggcagagtcatcatcacgcgacacactcacgagtacagcctaanatacggaactggaaggacgtccgtacgaagtctcgtacgaaccgtaaccgaccgggtacaaaccctttagttaacccgttggacccggacgtaaggtaacgtattttaaggttaccgacgttacgtacggggtttacccttgggaccctttacgtaaaaccccgtcgggttacgttttcgggtccggggaacctaccgggttacggggccccgttaaacccgggggg

SEQ ID NO: 41590 - DNA, 643 bp, Homo sapiens
  misc_feature: GYAE6OF02JGB4L.15.20.B09.1.454.CMB.1.raw
  modified_base (342)..(342): a, c, t, g, unknown or other
  misc_feature (342)..(342): n is a, c, g, or t
tcagtctacgtagccacgaccggtgctcgatttagtgtagtgtgaaggggacccaaaaaccacgacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacattcttttaccactacgtatgaattggttgagacaggtcccccggagaggggccttggagtcggagtgggatgggatcgagtccctacggaactaaaacngagtatcgacagagtacgttccgaggacagagtcagtcatcgaccgtcggaccactacgtaccacgagtacacgcccgtaacgaagtcggaaacgtggaacgggacgaccgttagacgtaattccgtacgtaacgaccgtaaccggtaccctaacgtttaaccgttaagtcgtacgggtacgaagtaacggtaacttaagttcgactacggttcggggtacccttcggggtacttaccggtaaccgtaccggtacgtttccgggagggtacccgacggtcggggtacccttaacccggggg

SEQ ID NO: 41591 - DNA, 649 bp, Homo sapiens
  misc_feature: GYAE6OF02IXL7E.15.20.B09.1.454.CMB.1.raw
  modified_base (248)..(248): a, c, t, g, unknown or other
  misc_feature (248)..(248): n is a, c, g, or t
  modified_base (324)..(324): a, c, t, g, unknown or other
  misc_feature (324)..(324): n is a, c, g, or t
  modified_base (354)..(354): a, c, t, g, unknown or other
  misc_feature (354)..(354): n is a, c, g, or t
  modified_base (564)..(564): a, c, t, g, unknown or other
  misc_feature (564)..(564): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaagcctggggcctcagtgattggtcctctgcgagtgcttcgtggttaacntcgttttccacgttacgtatgaagttggttgagacgacggccccggaggagggtcttagaggttgaagtgggaagnggtatcgagtcccgtaacggaactaaaacngagtatgacaagaggaaacgttcgagggtacaggacgttacagtacacgtcgaaccggacggaccaacgtaacgtaccgaacggacgtaacgaacggtaccaacgtagttacggaactagggacgacgtccgagaacgtactacgtacgaccgaccgaaccggaccttaacgtacgtttacggcgacgtacggaagtacgtaagtttacncggtactaggttcgggtaccgtggtacttacggaaccgtcggtcgtacgggacgtccggaacggttccggggacctaacccgggg

SEQ ID NO: 41592 - DNA, 670 bp, Homo sapiens
  misc_feature: GYAE6OF02HF1SD.15.20.B09.1.454.CMB.1.raw
  modified_base (391)..(391): a, c, t, g, unknown or other
  misc_feature (391)..(391): n is a, c, g, or t
tcagtctacgtagccacgaccggtgctcgatttagtgtagtgtgaagggggacccaaaaaccacacccctccttgggagaatcccctagatcacagctcctcaccatggacgggacctggagcatcttttcttggtggcagcagcaacaggtgcccactcccaggttcacctggtgcagtctggagctgagctgcagagcctggggcctcagtgatggtctcctgcagtgcttcgtggttacattccttttccacgttacggtatgtaattggttgagtacgacggtccccggaggagggtcttggagtggacgtgggagtggagtcgacgtaccgtaacggaaacgtaaacgagtagtagtgagaagagtacgttcgaggacgagacgtnacgtacgacgtacgtaccgacgacacgactaccgagacgtaccgacgcctaacgagtcggtaacgaggaacggactaccgtacgacgtaactcgtacgtaccgacgtaccggacccttactttacgtaccgtcggaccgtacggtaacgtaagtaacgtttacgttaccgacgttaccgtacgggttccgtacgggttaccgtaaccggtaacccgttacggtccggtttcgggtacggttaccccgggtagggtacccggggtaccgttaacccgggg

SEQ ID NO: 41593 - DNA, 638 bp, Homo sapiens
  misc_feature: GYAE6OF02HXEMJ.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctaggtatgtattggttagagtacgacggcccccggaggaggggcttgagtggatgggagtggatcgagccgtacggaaactaaaacagagtatgacgagtagaagttccgagggcaggagtacactacgataccgaccggcgaaccactacgtaccaacggagtaccgacgacctaacgaagttacggaacgtcggacggaacgccttagacgattacgcgtacaccggtaccggtacctaaccgtttaacttacgtcgaccggtacggtaacgagttaacgtttaatcggtaccgtacgttacggtcccgttggtaccttaccgtaaacccgtcggtacggtttcggcggggtacctacgggtcggggacccgtaaccgggg

SEQ ID NO: 41594 - DNA, 650 bp, Homo sapiens
  misc_feature: GYAE6OF02IBUCC.15.20.B09.1.454.CMB.1.raw
  modified_base (245)..(245): a, c, t, g, unknown or other
  misc_feature (245)..(245): n is a, c, g, or t
tcagtctacgtagccacgaccggtgctcgattttagtgtagtgtgaaggggacccaaaaaccacacccctccttgggagaatcccctagatcacagctcctcaccatggacgggacctggagcattcctttttcttggtggcagcagcaacaggtgcccactcccaggttcacctggtgcagtctggagctgagctgcagaagccgtggggcctcagtgatggtctctgcagtgcttctggttanacttcttttccaccttacggtattgtaagtttggttgagtacgacggacccccggaggaggggcttggaggtggagtgggatgggatcgacgtccttaacggaaactaaaacgagacgtagtagacaggagtaacgtccgaagggacaggagtacgatacacgtacgaccggacggaaccgaacctagtacccaaacggtaacgtaaccacgtaacctaacgaagttacgggaaacttgggaacggtacgcccttaagaacgacgtacctagggaaccgaccgaacggtacctaactttacgtactggaccgtacgaagtagtatttacttgactccgttaggtccgtacggctaccgtaacgcgtcgttaggcggtaccgtacggtccgggaccgttaaccggg

SEQ ID NO: 41595 - DNA, 657 bp, Homo sapiens
  misc_feature: GYAE6OF02I0UNA.15.20.B09.1.454.CMB.1.raw
  modified_base (550)..(550): a, c, t, g, unknown or other
  misc_feature (550)..(550): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttccacctggtgcagtctggagctgagctgacagaagcctggggcctcagtgatggtctcctgcagtgcttctggttacattcttttccaccttacggtatgtaattcggttgacgacgacggcccccggagaggggtcttgaggttcggatggggactgggatcgagtacccgttacgaaactaaacgagagtacgtgacagacgtaacgtccgagggtacgacgtaagtcgatacacgtcaaccggtcggacacgtactaccgacgtagtacacgtacctaacgtacgtacggaaacgttcggaacggtacgtaccgtacgttaagaaccgtttccgtaaacgaaccgtaccgaacgggttacctaaccgttacgttaaaccnggtaccgaccgtaagtaagtaacgttataccggcgtaacgtcggtacgttacggcttaccgtaacgtccgtcgtacggtagccggtaacgtcggggacctaaccggg

SEQ ID NO: 41596 - DNA, 716 bp, Homo sapiens
  misc_feature: GYAE6OF02G15O0.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattccttttccaccttacggtacttgaagtttggttgagacgacggcccccggaggacggggcttggagtggagtgggagtggatcgacgtcccgttaacggaactaaaacgagtaagtatagacaggaagtaacgttaccgagggacaacggtagtacataccgtacgtaccgacccggaccgggaacaaccaacgtacccgaacggtaacgtaaccacggaccctaaccgtaacgtaacgggtaaaccgtagggaacgggaccggtacccgttacgtaacgtacgttaccgtacgggaaaccgaacccggaaccgggtacccttacgtttaacgttaccgtggaccgtacgtaacgtagttaacttagttcgaccgttagtaccggtccggttcggtaccgtaccggttaaccgtccggtacgttcggggtaccggtaccggtacgggttcggggacccgttaacccgggg

SEQ ID NO: 41597 - DNA, 586 bp, Homo sapiens
  misc_feature: GYAE6OF02FYOPZ.15.20.B09.1.454.CMB.1.raw
tcagtctacgtagccacgaccggtgctcgatttagtgtagtgtgaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggagtgggatggatcgagccgttaacggaactaaaacgagagtagtgacagaagaagttccgagggcagagtcatcatcgacgacgacacataccacgagtacacgacctaacgagtacggaacgtgacggacgcctacgagtactacgtagaccgacgaccggacctaacgttacttacgtcgacggtcgaagagtatttacgttgtactacgttcggtcctgggtacctacgtaacctacggtcgttacggtcggtacgtacggtcggggacgtaacccggg

SEQ ID NO: 41598 - DNA, 724 bp, Homo sapiens
  misc_feature: GYAE6OF02GBLK4.15.20.B09.1.454.CMB.1.raw
  modified_base (246)..(246): a, c, t, g, unknown or other
  misc_feature (246)..(246): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttccacctggtgcagtctggagctgagctgcagaagcctggggcctcgagtgatggtctcctgcagtgcttcgtggttacncttctttccacgtacgtatagagttggttgagacgtacggcccccggaggcgggcgttgagtggagtgggtatggtactcgacgccgtaacggaactaaacgagagtatgacagtacgaacgttaccgaggacgaggtagtactactacacgtaccgaaccggccggtaacacctaactaccgaacgtaacctaccgaacgtaccctaacgtacggtacggtaaccgtacggaacggtcccggtaccttacgaacggtacgttaccggaacggtaacccgtaccggaacccggtaccgtaaaccgtttagtttacccgttacgggaccgttacgggtaaacgttaacggtaatttacggtacgttaccgtccggttacggttacccggttaggttaccgtaacccggtaccgttaaccggttcggttacggttccgggaccgttcggggttacccggggtcccgttaaaccccggggg

SEQ ID NO: 41599 - DNA, 715 bp, Homo sapiens
  misc_feature: GYAE6OF02JB6PB.15.20.B09.1.454.CMB.1.raw
  modified_base (232)..(232): a, c, t, g, unknown or other
  misc_feature (232)..(232): n is a, c, g, or t
  modified_base (420)..(420): a, c, t, g, unknown or other
  misc_feature (420)..(420): n is a, c, g, or t
tcagtctacgtagccacgaccggtgctcgatttagtgtagtgtgagggaccgaaaaccaacaccctccttggagaatcccctagatcacagctcctcaccatggacgggaccgtggagcattccttttcgttggtggcagcagcaacgaggtgcccactcccaggttccacctggtgcgagtcgtggagctgagcgtgcaggacgccgtggggcctcagtgagtggtctccngacagtgcttcgtggttacattcttttccacgttacgtatgtaagttggttgagaccgacggcccccggtaggaggggtcgttcggtaggttcggaggtcggggagttggagtcgacggtaccgttaacggaaactaaaacgaggtaagtagtggacaggaacgtagttacgacgggacagacggtanacgtacagtaccgtacccggacggactaccgactacccggaacgtaaccgtaaccgaccggtaacctaaccgtaggtaacgggtaacctaaggaacgggtaaccgtacctacggacgtacgtaccgttcggaacgaaccgtaaccggtacccgtaattaccgtttaccgacggtacccgtagaacgtaagtaacgttaagttcgtacgtacgtcgggttaacccggtcgtaaccgttacggtaacccgtcggtaaccgttggtccggtcggacggttccgggaccgtaacccggg

SEQ ID NO: 41600 - DNA, 874 bp, Homo sapiens
  misc_feature: GYAE6OF02GV572.15.20.B09.1.454.CMB.1.raw
tcagtctacgtagccacgaccggtgctcgatttagtgtagtgtgaaggggacccaaaaaccacaccccctccttgggagaatcccctagatcacagctcctcaccatggacgggacctggagcatcctttttcttggtggcagcagcaacaggtgcccactcccaggttcaccgtggtgcagtctggagctgagctgcagagccgtgggcctcgagtgatggctcctgcagtgcttcgtggttacattcctttccgaccttagtatgtaagttggttgagacgacggcccccggaggtacggggctttggacgtgggtagtgggtacgttggactcgacggtacccgtttaacggaacctaaaaacgaggaacgttagtcggacgtaagacggtaacgtttccgaacggggtacaaggacgttacgaacgttacgaacgttaccgacccggtacggaaaccaccgtaaccgtacccgtaaaccgggtaaccgtttaacccgaaacgggtaaccccgtttaaaccgtaacggttaaccggtaaaccgggtacgggttaaccggggaacccgttacccgttacgaaacgggtaaccgttaccgttaacgggaaacccggtaaccggtaacccgggtaccccgttaaaccgttttaaccggttaacgttccgggttaacccggacccgggtaaaggtaccggttttaaacgttacgtttaccggaccgtttaacccgggtaccggggtttcccgtttaccgggttaccgttaacccgggttaaacccctttacgggttaccccggtttacgggtttcccgggggaacccgtttaaccgggggtttacccgggggaaccccggtttaaaccccggggg

SEQ ID NO: 41601 - DNA, 791 bp, Homo sapiens
  misc_feature: GYAE6OF02FS4VQ.15.20.B09.1.454.CMB.1.raw
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
tcagtctacgtagccacgaccggtgctcgatttagtgtagtgtgaaggggacccaaaaccacacccctccttgggagaatcccctagatcacagctcctcaccatggacgggacctggagcatccttttcttggtggcagcagcaacaggtgcccactcccaggttcacctcggtgcagtctggagctagagctgacagacgcctggggtcctcagngagtcggtcgtcctgcgagtgcttcctaggttacnttcctttccacctcgtactgacgttggtgtagtacgaccggcccccggtaggtacggggtctttacggagggttcggaagttagggggtactagggtacgtacgaacggtaccccggttaaacgggtaaaaccctaaaaccgtaaggtacggttaacgttacgacgtaacggtaacggttaacggttacaccggggacgtacgtaaggtactaattccgaacttccgaccgtaccggacctactaccgaccaacggtacgtaacgacgtaccgtaacacggtacggtaacgtacggaacggtccgtaccgtaactacggtactaccggttacgaaccgaacgacccgggttacctaacgtttaccgtaaacggttggtaccccggtacgaacggtacggttaactttacgggtactacggttaaccgtttccggtaccggtaaccggttccgttaacgggtaaacccgtttcgggaccggttttaccggtacgggtaccggtttaaccggtaccggggtacccggtttaaaccccgggg

SEQ ID NO: 41602 - DNA, 650 bp, Homo sapiens
  misc_feature: GYAE6OF02IEMGW.15.20.B09.1.454.CMB.1.raw
tcagtctacgtagccacgaccggtgctcgatttagtgtagtgtgaaggggacccaaaaaaccacaccccctccttgggagaatcccctagatcacagctcctcaccatggacgggacctggagcatcctttttcttggtggcagcagcaacaggtgcccactcccaggttcacctggtgcagtctggagctgagctgcagaagcctggggcctcagtgatggtctcctgcagtgcttctggttacattcctttccaccgttacggtatgtaatttggttgagacgacggcccccggaggacggggtcttgaggtggagtgggatggactcgacgtaccgttaacggaaactaaaacgagagtatcgacgagaagtaacgtaccgaagggacaggtacgtacgtactacactccgaaccggacggaaccacactaccgacgagtaccacgacctaacgagtacggaacgtaggacggacgtcctacgacgtaacgtcgtacggaccgaaccgaccggtacccttaacgtttacttacgtacgcgacgtaacgagttaactttagtctaccgtacgttcggtccgtcggtacgtacgtaacccgtacggttcgttcggtcggaccgtacgggtacgggacccgtaacccggg

SEQ ID NO: 41603 - DNA, 673 bp, Homo sapiens
  misc_feature: GYAE6OF02JV0ZS.15.20.B09.1.454.CMB.1.raw
  modified_base (243)..(243): a, c, t, g, unknown or other
  misc_feature (243)..(243): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttcgtggttacnttctttccacctacggtatgtaattggttgagtaccgacgggcccccgggaggacggggtcttggaggtggagtgggattggatcgacgtaccgttaacggaaactaaacgagaagtagtagacgagagtaacgttccgagggtacaggagtctaacgtcacgtaccgacccggacggaacacacgtacccgaacgtaacgtaacgacggaacctacgagtacggaagtaggacggacgtcctacgtaacgtgtaaccgtagtaaccggacctaccgggaacccgtaattacgttaaccgacggtccgaacgtaagtaacgtagtttaactgggaccttcggtacggttccgttcggtacgttaaccggtaacccgtacgttacggttcgggtaccggtacgtacgggtaccggggtaccgtaacccggg

SEQ ID NO: 41604 - DNA, 692 bp, Homo sapiens
  misc_feature: GYAE6OF02H18YS.15.20.B09.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
tcagtctacgtagccacgaccggtgctcgattttagtgtagtgtgaaggggacccaaaaaaccacacccctccttgggagaatcccctagatcacagctcctcaccatggacgggacctggagcatcctttttcttggtggcagcagcaacgaggtcgcccactcccaggttcacctggtgcagtctggagctgganctgcaganccgtgggccttacgagtcgatcggtcnccgtgactagtcgctttcgtaggtttaactcgtttccttttacccaagttacggtacttaggttaagttaggttagacgtacggaccggtacccccggaggacgggtcgtttggacggttgggtaggtcgggtagtaggtactacgtcgtaccctaaacgggaacgtaaaaacgtcggttaagtagtacggacgtacggacgtacggttacgacggtacaggtacgtagacgtactacggtaccaacggacgaactactacgacgtacgaaccgtacgaccgctaacgtacgtacgtaacgtaccggtacggtacgacgtacgtacgacgttcgaaacgtcggtaacaccgtcgttaaccttacgtacgtacgggctagggtacgtaagttactgtcagtactcggtcttcggactacggtaccgtagtcgtcgtcggcgaacggtcggaccggtaaccg

SEQ ID NO: 41605 - DNA, 697 bp, Homo sapiens
  misc_feature: GYAE6OF02GBG6E.15.20.B09.1.454.CMB.1.raw
  modified_base (230)..(230): a, c, t, g, unknown or other
  misc_feature (230)..(230): n is a, c, g, or t
  modified_base (417)..(417): a, c, t, g, unknown or other
  misc_feature (417)..(417): n is a, c, g, or t
tcagtctacgtagccacgaccggtgctcgatttagtgtagtgtgaaggggacccaaaaaccgacacccctccttgggagaattcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgccngtcgcttcgtcggtttacacgttccttttaccgaccgttacggtatacgtaagtttggttcgagaccgtacgggcccccggagacgggtcttagacggtggtaacgtgggacgtggactcgacgccgttaacgggaaacctaaagacgagtagtggtacagagtaccgtcgaggcagagtcgatcancgaccggtacggaccacgactaccgtacgacgtaaccggtactaccgtaacgaggttagtaaccgtcggaaacggacctaccgggtacaacggttacgttcggttaaaccgcggtaacccgaccgggttacccgaacttttaaccgtaccgttaaccggcgaaccggttagtaaggttaacttacggttacgtccaacgttcggtacccgtgggttaccctaggtaaacccgtcgtcggtttcggacgtaccgacgggtttccgggaccgttaacccggg

SEQ ID NO: 41606 - DNA, 702 bp, Homo sapiens
  misc_feature: GYAE6OF02FH820.15.20.B09.1.454.CMB.1.raw
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (419)..(419): a, c, t, g, unknown or other
  misc_feature (419)..(419): n is a, c, g, or t
  modified_base (456)..(456): a, c, t, g, unknown or other
  misc_feature (456)..(456): n is a, c, g, or t
  modified_base (509)..(509): a, c, t, g, unknown or other
  misc_feature (509)..(509): n is a, c, g, or t
  modified_base (523)..(523): a, c, t, g, unknown or other
  misc_feature (523)..(523): n is a, c, g, or t
tcagtctacgtagccacgaccggtgctcgatttagtgtagtgtgaagggggacccaaaaaccgacacccctccttgggagaatcccctagatcacagctcctcaccatgggacgggacctggagcatcctttttcttggtgggcagcagcaacaggtgcccactcccaggttcacctggtgcagtctggagtctgagtctgcagaagccgtggggcctcgagtgagtggtcctccgtgcaggtgtacttcgttggttacatttcctttaccaccgtaggttatagtaagtttggttgagacgaccgggtccccggaggaggggtcttggaggtcggagtcgggagtaggataccgacggtaccgttaaacggaaacctaaaacgngaacgtnaggacaaggacgtacgtaccgaggacngtacgctaataccgctacccggaccgccgacacctanaccgaagaacgtaccaacgtctaacgagtacggaacgtggaacgtcgtaccgngtaacgtcgtacgngaaaccgacgaccggttacctaacgtttaccgtaacgtcgaaccgtacggaacttaacgggtactttagtccgttactacgggtccggtaccgttaggacccgtttaacccgtaaccggtacgttccgggtttagggtccccgggacgttaccggggacgggttacccggtaaccgggg

SEQ ID NO: 41607 - DNA, 865 bp, Homo sapiens
  misc_feature: GYAE6OF01DFNH4.8.59.F04.1.454.CMB.1.raw
tcagctcgcgtgtccacgaccggtgctcgatttagtacacacacttagggattgggggagcatcacccaggcaacccacactcgtgttcctcgtagtagaattccccgtgagagcgtccgttcctacaccatggactcggacctggaggagttccgtcttcgttggtggtcgtacgttcgtaggtccggcgggtaagtttaaccgtacgtccccgaggtgcgaacgtggtagtcgtaggtcgtggggtcggtggtaacggttggtccggcccggggtacgtccggtacggggccctcgtacgtcgtaggtacggtcctccgtcgtcgtaaggtccttcgtaggtacttaaccgtccgttacggccgacctacttagtacgtacgtaccgtcggaacgtcggccgtacccgacggggccccggtagggaaccggtaagggtccgttaggacggttcgggtagtcgggtacgtggtactaccgtaaccgaagttacggtcggtacggaccgtaacgtaaacgttacggcggaccgtaacgggttacgttaccgacgggtaccgtaacgggtaccgtaaccggtttaccggaaaccggaacgggtaacccgtaccgttaccgaacgttaccgtaaaccgtaacgtaacggttaaccttaacgttacgtacggtaacgttacgtttacggaaccggtacccggtaccccgttacgtaacgttaacgttccgtaacgggtaacggtaacccggtaccgggttcccgttacgtttaccggtttcggtacggtaccgggttaacccgggtacccgttaccggtttcgttaacggtacggttacggtacccgtacgttcccgaccgttacccg

SEQ ID NO: 41608 - DNA, 534 bp, Homo sapiens
  misc_feature: GYAE6OF01BETP2.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtctggggctgaagtgcgcgagcctggggcctcagtcagagtctcctgcaaggcttctggatacgccttcggcgaccactatatacactggatgcgccacggcccctggacaagggcttgagtggatggcctggatctacccgaatagtggtggcactaaattatgcgacgggtagtttcgagggcgagggtcaccgtgaccgagggacacgtccatcactacagtctatatgctagtttgacgcggcctcgagtatcgtgacgacaccggccgttcttacgtttgtcgtcggacgggtacccgtaccgttctttacgacgttcggacgctcgacgtaccg

SEQ ID NO: 41609 - DNA, 584 bp, Homo sapiens
  misc_feature: GYAE6OF01CPO42.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtctggggctgaagtgcgcgagccgtggggcctcagtcagagtctcctgcaaggcttctggatacgccttcggcgaccactatatacactggatgcgccacggcccctggacaagggcttgagtggatggcctggactctaacccgaagtaggtggtggcaacaaattatgacgagggtagtttcgagggcagggtcacggtgaccgagggacacgtccatccactacgagtctatatgactagtttgaacgtccgcctacgagtacttacgtacgaccgacgtaccgggtccgttacgttaccgtttttaggcggtaccgggtaacggggtaccccgtaccggtttcgttttacggaccggttacggaccgtaccttccgtacgtacccg

SEQ ID NO: 41610 - DNA, 786 bp, Homo sapiens
  misc_feature: GYAE6OF01AE1VG.8.59.F04.1.454.CMB.1.raw
  modified_base (156)..(156): a, c, t, g, unknown or other
  misc_feature (156)..(156): n is a, c, g, or t
tcagctcgcgtgtccacgaccggtgctcgatttagtacacacacttaggattggggaggcgatcacccacgcaaccacatctgtcctctagagaatcccctgacgagctccgttccctcaccatggactcgactggaggactcctcttctggtgcngcagccgcggacgtccactcccaggtcgacacttggtgccagtcgtggggctggaacgtgccgtaccggaggcccggtcggggtcctcgaggtacctaagggtccgttccgtccctagggaacaacgggtccgtttacgtcggtacgtacccgtcccggtttccgggaccgtaccctaaccttataacgttacctaaccgtagggcttacgggccacccgtaccgggtccccggtaggtaacgaacgggtccgtttagggacggtcgggtacgtacgggcccgttgggacgtaacccgtaaccggtaagttacggtgggtcgaacctaacgtaaatttcgacgcgggtaacgggttgttaccggagggacccgtagggtacgtaccggtacggaaccggtaacgggtaacccgcccggtacgaaccgttacgtacccgttaacgtacggtacgttaagtcgttacgtagtaacgtttacggacgtaccgggtcctaacgacggttaactaccgggtcaaccggccgtaccggtaccgtttaccgttacggtttcgtcgggaacccgtcgggtacccgtttacggttacccgtttcgaccgggttaacgaccggtaccttcgtaccgtacc

SEQ ID NO: 41611 - DNA, 884 bp, Homo sapiens
  misc_feature: GYAE6OF01CID0W.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccgaggtgacaactggtgcagtcgtgggctgaagtgcgcgcgccgtgggcctgagtcgagtacgtcctccgtgacaggtcttcgaggtactaccggtcccgttccggaccgaaccctaacgttacttaactaccgtaacggttgggtaacgtcggcccgacccggaccgggtaccccccgttaaggggaaccgtaaacgggggtccgttttagggacggggtttacgggaacggttccggggtacccgttacggggtaaacctttacccggttaaacccccgggaaaagtttaacggggttcggggttaaccggtaacgtaaaaccgttaaaacgtttacggtacggacccgggtttaaacggggggttacgttttaccgggaacgggggtccgtaaccggggggttacccgtaaacccggggttacgggaaaccccggtaacgggggtaaacccgtacccgggttaccctaaacgtacccgtaaccgtaaccggttaacgttacccgttaattaaccgttacggtacgttacgtttacgggtaccgtacggtccctacgtacgtacgttacgtacgggacctaccggtcccggttaccgttacctttacggtttacggtcggtacccgggtaaccgggtacccggttacccgttttacggtttacgtacggttacggaccgttaacccgtcgtacccgttaaccccgg

SEQ ID NO: 41612 - DNA, 733 bp, Homo sapiens
  misc_feature: GYAE6OF01CRMZX.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtcgtggggctgaagtgcgcgagccgtggggcctcgagtcagacgtctcctgccaaggcttcgtggatacgccttcggccgaccactatatacactggatgccgccacggcccctggacgaagggtcttaggagttggagtggccgtggactccgtaacccggaaagttaggtcgggtggactaaactaaatttagtggaccgtaacggggtacgtttcgaaggggcgtaacggggttaccgtacccggtacgggaacccggtaacggggaacccgtaccggtacccgtaacgtaccgaaccgttaacgtacgttacctaacgttaacgttcgtaccgttaagttttcggaacggtccggtacccgtacgtacggtacttaccgtacggtaaccgacccggtaccgggtcccgttaccgtttaacggttttcgggtaccggttacggggaaccggggttaccccggttacccggtttaccgtttttacggtaacccggttacgggtaacccgttaaccgttaccgtaaccgttaaccccg

SEQ ID NO: 41613 - DNA, 590 bp, Homo sapiens
  misc_feature: GYAE6OF01EG272.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtctggggctgaagtgcgcgagccgtggggcctcagtcagagtctcctgcaaggcttctggatacgccttcggcgaccactatatacactggatgcgccaggcccctggacaagggcttgagtggatggcctggatcgtacccgaataggtggtggcaacaattatggacgacgggtagtttcgagggtcgagggtcaccggtgaccgagggacacgtccatcactacagtctatactgatagtttggacgtccggtacctcgtagtacttcgtcgaccgaccgaccggtcccgttacgttaccgtttttggtcggtacgggtacggggtacccggttacccggttcgtttttacggaccggttacgggaaccggtaccttaccgaccgttaacccg

SEQ ID NO: 41614 - DNA, 796 bp, Homo sapiens
  misc_feature: GYAE6OF01B05IP.8.59.F04.1.454.CMB.1.raw
tcagctcgcgtgtccacgaccggtgctcgatttagtacacacacttagggattgggggagcatcacccagcaaccacatctgtcctctagagaactcccctgagagcctccgttcctcaccatggactggaccgtggaggatcctcttcttggtggcagcaggccggcgggacgtccacctcccgaggtcgacaacgtggtgcagtcgtggggctaggaagtcgcggcgaggccgtggggcctgagtcaggtacgtcctccgtgacgaggtcttcgtaggtactaccggtccgttccgggacctaaccctaacgttataaccgtaccgtacggtacgggtacgtcggacccggacccgtaccgggccccccgttaggggaacccggtaacggggttccgtttagggaagggttacgggtacgggttccggggtacccgttagggttaaccgttacccggtaaaccccggtaaaggtttacggggtacgggtacgggtaacctaaaacggttaaactttaacggtacgggaccggttaacggggttacgtttacgggaacggggtccgtacgggtaccgtaccggtacggaacccggtacggacgtaccgtacgaacctactaaccgtacgacgttacttagtactacgtacttaagttcggaacggtccgtacccgtagacgttacgttacgaacggaccgtaccggtaccggtcgtttaaccgtttggttacgcggaccgggtaccggtacctccggtttacgttacgccgttacgacctcgtccgtcgttaccg

SEQ ID NO: 41615 - DNA, 548 bp, Homo sapiens
  misc_feature: GYAE6OF01B0NZI.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtctggggctgaagtgcgcgagcctggggcctcagtcagagtctcctgcaaggcttctggatacgccttcggcgaccactatatacactggatgcgccacggcccctggacaagggcttgaggtggatggcctggactctaccgaataggtggtcgacactaaattatgacgtacgggtagtttcgagggcgtagggtccaccgtacgaccgaacgggacacgtaccatacactacgatactatatgctatttcgagcgctcgagatctgacgacgacggtccgtcttacgtttgtcggacggacgggtacccgtaccgttcgttttacgacgttggaccgtactcgactacccg

SEQ ID NO: 41616 - DNA, 818 bp, Homo sapiens
  misc_feature: GYAE6OF01CRDSI.8.59.F04.1.454.CMB.1.raw
  modified_base (252)..(252): a, c, t, g, unknown or other
  misc_feature (252)..(252): n is a, c, g, or t
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtcgtggggctgaagtgcgcgagccgtggggcctcagtcagagtctcctgcaggcttcnggatacgccttcggccgaccactatatacactggatgcgccacggcccctggacgaagggcttaggagtggatggcctaggactcgtaacccggtaagtaggtgggtggactaacgtaaagtttatcggaccgacggggtaggtttacgacgggtcgaacggggtccgaccggtcggaacccgtacggggaaccctaccgggtaccctaactacctaaccgtaaccgtacggttaccttaagttaactacggtaccttaagtttacgggtaccggtacccgggtacccttacggtaacggttaacgttaccgttacgggaacccggtaacccggtaaccccggggttaccccgggttttacccgttttttaaccggttttttaccgggggttaccggggtaccccggggttaaaacccggggggtttaaccccccgggtttaaccccccggggttttttaacccggttttttttacccgggaaacccccggggtttttacgggggtaaacccccggtttaacccccgggttaaaccccgttaaaccccgggtttaaacccccccgg

SEQ ID NO: 41617 - DNA, 670 bp, Homo sapiens
  misc_feature: GYAE6OF01ELLSO.8.59.F04.1.454.CMB.1.raw
  modified_base (181)..(181): a, c, t, g, unknown or other
  misc_feature (181)..(181): n is a, c, g, or t
  modified_base (346)..(346): a, c, t, g, unknown or other
  misc_feature (346)..(346): n is a, c, g, or t
  modified_base (660)..(660): a, c, t, g, unknown or other
  misc_feature (660)..(660): n is a, c, g, or t
tcagctcgcgtgtccacgaccggtgctcgatttagtacacacacttagggattgggggagcatcacccagcaaaccacatctgtcctctagagaatcccctgagagctccgttcctcaccatggactggacctggaggatcctcttcttggtggcagcagccgcggagtccactccaggtncaacgtggtgcagtcgtgggctaggagtgcgcgagccgtggggcctcgagtcagacgtcctcgtgacgacggtctttcgtaggtactaccgtccgttccggaccgaacctactaataactacacgtggatcggccgccgaccggcccgtacggacgtaacgggtnttggaggtggacgtcgggcctaggtacctaacgttaacccgtaagttagggtggtacggaacctaaactaaagttacgtcggtaccggtaacgggttagtttaccgggacgggtacgtacgggtaccgaccggttacggaccggtaagggaaccctacgtaccgaacgttaccaacgttaacgtacgttactaagttatcgtacttagtttacgacggtccgtacgtacgtacgtacttcgaacgacgaccgtacggtccgttgtttacgttggtacgcggtaacggccgttacttcgttacgcgtacggatcnctcgtacccg

SEQ ID NO: 41618 - DNA, 898 bp, Homo sapiens
  misc_feature: GYAE6OF01BKOWW.8.59.F04.1.454.CMB.1.raw
tcagctcgcgtgtccacgaccggtgctcgatttagtacacacacttagggattgggggagcatcacccagcaaccacatctgtcctctagagaatccccctgagagctccgttcctcaccatggactggacctggaggatcctcttcttggtggcagcagccggcgggagtccacctcccgaggtgcaacgtggtgcagtcgtggggctaggagtgccgcggagccgtggggcctcgagtcaggtagtcctccgtgaccgaaggtccttcgtaggactaccggtcccgttcggacccgaacctaacttactaataccgaacgtcgggtatcggacccgacccgacccggggtcccccgttagggaaccggaacggggtcgttaggaacgggttgggaggttccgggccgttagggtaaccgtaacccgttaacccgggtaaagttaggggtcgggtacggaacctaaaacgtaaagtttcggtacgggaacccggttaaggggttaacggttttacgggacggggtaccgggtaacggggttaccccgaacccggggtacggtaaccccgggaacgggggtaacccctaaccccgggttaccctaaacgttaccccgtaaactacccgttaaggttacccttaaggttactccgggttacttaaacggtttggaccgggtaccccggtaccgtacgtaaacgttaccgttaccggtaccggaacccggtaaccggaccccgggtttcccggttaaccgtttttacgggtttacgggaccgggggtaaccccgggtaccgggggttaaccccccggtttacccggttttacggttttaaccgggtaccccgggttacggttaaccccgtaccgttaacccgtacccggtttaacccccg

SEQ ID NO: 41619 - DNA, 754 bp, Homo sapiens
  misc_feature: GYAE6OF01CR0HV.8.59.F04.1.454.CMB.1.raw
  modified_base (60)..(60): a, c, t, g, unknown or other
  misc_feature (60)..(60): n is a, c, g, or t
  modified_base (214)..(214): a, c, t, g, unknown or other
  misc_feature (214)..(214): n is a, c, g, or t
  modified_base (583)..(583): a, c, t, g, unknown or other
  misc_feature (583)..(583): n is a, c, g, or t
  modified_base (589)..(589): a, c, t, g, unknown or other
  misc_feature (589)..(589): n is a, c, g, or t
tcagctcgcgtgtccacgaccggtgctcgatttagtacacacacttagggattgggggancatcacccagcaaccacatctgtcctctagagaatcccctgagagcctccgttcctcaccagtggacctggaccgtggaggtactccttcttcgttgggtcgcacgcgacgccggcgggactccaccgtcccgagggtcactaacgtgggtacncgtacggtcgggtgggtactaggaaggtcggccggacggtacggtcccggggtcggggtaccttacggaacggttacgaacggttcgtccgttaccgtacggaccgtaacggttccgttacggaggtaccgtaccgtccggttcggaccctaactacgtactaactccgtaggtcggacgtcgacccgcccggaccgtaccgacggaacggtaggtcgtaaggcggtacggacgtaccgggtccgtacgttaccgaaccggtaacgaagggtggttcggacgaactaagtaagttacgaggaccggttagggtactacgggacggtaccgtaggtaccgacggtacggacgtaacgaccgtacgctacncgtaanactacgtatacgtatcgagttacggtggaccgtcgtacgtacgtactacgtacgaccgtaccgtaccggtcctccggttactttggaccggtacgggtacggtaccggttcccggttcggttaccgtttacggaccgttaccacgtccgtaccgtacgttacccg

SEQ ID NO: 41620 - DNA, 683 bp, Homo sapiens
  misc_feature: GYAE6OF01CDW5O.8.59.F04.1.454.CMB.1.raw
tcagctcgcgtgtccacgaccggtgctcgatttagtacacacacttagggagttgggggagcatcacccagcaaccacatctgtcctctagagaatcccctgagagctccgttcctcaccatggactggacctgggaggatcctcttcttggtggcagcagccgcgggacgtccactcccgaggtgcaacgtggtgcagtcgtgggctggaagtgcggcgacgccgtggggccttcgacgtcgagtacgtcctccgtgacgaaggtccttacgtaggaacgtaccggtcccgttccgggaccgtaaccactaatactacgacgtggagtcgccggacccgacgggccccgtagggacgaacgggtctttggaggtggagtcgggcctaggacttccgtaaccgtaagtacgggtgggtacgactaaactaagttagcgaccggtacgggtaagtttcggaaggggtaccgacggggttaccgtaccggtacggaaccggaacggggtaaccacggtaccaacgtccaacgtacgtagtactagtagtcgacgttagttggacgccgtcctacgtacgctaccggacgaccgccggttccgtacgttacgtttggcggtccgggacgggtaccgttccggttacgtttagacggttacgaccgtactccgtaccgtcgtacccg

SEQ ID NO: 41621 - DNA, 696 bp, Homo sapiens
  misc_feature: GYAE6OF01CHB8D.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaacgtggtacagtcgtggggctagaagtgcgcgagccgtggggcctcgagtcagtagtctcctgctaaggcttcgtggactacgccgttcggcgaacctaactataatacactggaatcggccgaccgacggcccccgtaggaaccgaacggggtccttaggacggtagggagtgggtccctagggtaactaccgtaaccgtaaagtacggtcgggtacggactaaactaaaagttatacggtacggaacgggtaggtttacggagggacggtaacgggtaccgtaaccggtacggaaccggtaacgggaaccgaaccgttacccgaactaacacctaacagtactaatagtacgtactaagtttcggaacgtccggacctacaagtatacgtacggtaacgaccgaccgggtacccgttacgttacgttttaggtacgtacgggtacggtacccggtaaccgttaccgttttggaaccgttcggtaacgtacctaacgccgtacgtaccccg

SEQ ID NO: 41622 - DNA, 660 bp, Homo sapiens
  misc_feature: GYAE6OF01BEZX6.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctgggaggactcctcttcttggtggcagcagccgcgggactccactcccaggtgcaacgtggtgcagtcgtggggtctggaagtcgcgcgacgtcctggggcctcagtcagagtctcctgcaaggcttcgtggactaccgtccttccggccgacctacgtatactacactcggatcgccgccgacggccccgtagggaccgtaagggcttggacgtggagtcggcgtgactaccgtaaccgaagtggtcgtcggactaactaagttacgtcggaccgtacggtaagttcgagggacgtagggtccgtaccggtacgaccgagggaccaccgtaccgactaccactacgtacgtacttagactcgtactacgtttacggcgtacggtcctacgaacgttactcgtacggtaccgaccgtccggtccgtttaccgtttacggtttcgggtcgggaccggtaccggggttacccgttaccggtttccgtttacgacgggttaccggacttacccgtccgtacccggttacccg

SEQ ID NO: 41623 - DNA, 745 bp, Homo sapiens
  misc_feature: GYAE6OF01A6N6R.8.59.F04.1.454.CMB.1.raw
tcagctcgcgtgtccacgaccggtgctcgatttagtacacacacttagggagttgggggagcatcacccagcaaccacatctgtcctctagagaactcccctgagagctccgttcctcaccagtggacgtcggaccgtggaggactccctctttcgttggtggcgagcgagccggcggagtcccacctcccgaggtgaccgaacgtggtcgcagtcgtgggctgagtgcgcgacgccgtgggcctcgagtcgaagtcgtaccgtcgtgccgtaacggtccttcgtacggtacgtaccggtacccgttcggaccgtacctacgtaacgtaactaccgacgttggtaacgtcgcccggacccgtaccggtccccggtaggaacggtaacgggtccttagggacggttcggaagttcgtaccgtaggtactaccgtaacccggtaagttcggtggtacggacaaacgttaagttacgacgaccgtacgggtagtttcggacggtcggtaccgggtaccaccgtcggaaccggacggtaaccgtacgtaccgtctacgtactacgtagtaccgtatccgtgtacctagtttacgaacggtccgtacgtacgtacgttcctacgttacggaaccgtccggtaccgggtccctttaacggttcgttaccggtacgggtacggtaccccgggttccgttaccgtttcgtaccgggttaagcccggttacgaaccttaccgtcgttaccccgg

SEQ ID NO: 41624 - DNA, 865 bp, Homo sapiens
  misc_feature: GYAE6OF01C1634.8.59.F04.1.454.CMB.1.raw
tcagctcgcgtgtccacgaccggtgctcgatttagtacacacacttagggattgggggagcatcacccagcaaccacatctgtcctctagagaactcccctgagagcctccgttcctcaccagtggactcggacctggaggactccttctttcgttgggtcggcagcacggcccggcgggacgtcccaccgtcccgaggtcgacaacgtgggtcgcgtacggttcggtggggctaggtaaggtggccgcggacggccggtcggggcctacgacgtcgaacggtcgtcctccgtcgacgtacggtccttcgtacggtacgtaccgtcccggttacggacccgtaacctaacgttactaccgtaccgtacgtacgggtacctccggcccggtacccgtaaccgggtcccccggtaagggaacccggtagggtccggtttagggacggttagggtacgttcggggaccgtacgggtaacctttaacccggtaaaccggttaagttacggggtagggtaccgaaactaaagtttaaacttacggtacgggtaccgggttaaggggttaccgtttaacgggaccgggggttacgtaccggggttaccgtaaccgggttacgggaaccggtaacgggtaccctaccggtactaacgtaccgtaacgtacgtaacgttactagttacgtaggtacgtttcgtacggacggtcccgacgtacgacgttacgtaccgtacggacccgtacggttcccggtaccgtttaccgtttacggtttacgggaccgtaccggggtacccggtttacccgttcgggttttacgtttaccgggaccgttaacgtaacccttccggtaacctcccgttacccg

SEQ ID NO: 41625 - DNA, 684 bp, Homo sapiens
  misc_feature: GYAE6OF01A33UW.8.59.F04.1.454.CMB.1.raw
  modified_base (264)..(264): a, c, t, g, unknown or other
  misc_feature (264)..(264): n is a, c, g, or t
  modified_base (672)..(672): a, c, t, g, unknown or other
  misc_feature (672)..(672): n is a, c, g, or t
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcgttggtggcagcagccgcgggagtccactcccaggtgcaactggtgcagtcgtggggctagaagtgcgcgagccgtggggcctcacgtcgagtagtcctccgtgacaaggtccttcgnggactaccggccgttcggccgaccacttatactacacgtggactgccgccgaccggtccccgtaggaaccgtaaggggtcttaggacggttgggacgtcgggtacctcgggtactcccgttaaccgtaagtaggtggtacgacaacgtaattacgcgacgtacgggtacgtttcgagggctacgggtccaccggttacggaccgtacgggacctaccggtccaacttccgactactaacgtctagtacgtgtacttgttacggacgccggtactacggataccgtagtaccggacgtacggacccgttccgttaccgtttaaggtttcggtacgggtaccggttacggggaaccccggtttccgtttaccggtttacggtaacggtccggttaacctaaccgttaccncgtttaaccccg

SEQ ID NO: 41626 - DNA, 768 bp, Homo sapiens
  misc_feature: GYAE6OF01BRCXG.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccggcgggagtccacctcccgaggtgacaacgtggtgcgagtcgtggggctagagtgcgcgacgccgtcggggcctgagtcgaggtacgtcctccgtgacgtaaggtccttcgtaggtacgtaccgtcccgttcggaccgtacctacttaactactacgacgtggaatccggccgaccgaccggcccgtaggaaccgagggtcttggacgtggacgtcggacgtagtactaccgtaaccgtaagtacgggtaggtacggaacctaaacgttaaagtacgtacggaaccgggttacgggttagttacggaccggggtcgtaaccggggtcctaaccgggtacggaaccgggtaacggtaccccgtaccgttccaaacgtccgtaaccgtacgtacggttactacgtagtccgttacgttacggtacggaccgtacccggtaccgttaacgacgtttaccgtaccggacggaacccgtacccgggtaccggtttaaccctttcggtttaacggtttgggacccggggtacggtaacccggggttcccgtttaaccgttttcgggtttacgacccggttaccggaccttacgttacccgactttaccccggg

SEQ ID NO: 41627 - DNA, 748 bp, Homo sapiens
  misc_feature: GYAE6OF01CPPR7.8.59.F04.1.454.CMB.1.raw
  modified_base (616)..(616): a, c, t, g, unknown or other
  misc_feature (616)..(616): n is a, c, g, or t
  modified_base (738)..(738): a, c, t, g, unknown or other
  misc_feature (738)..(738): n is a, c, g, or t
tcagctcgcgtgtccacgaccggtgctcgatttagtacacacacttagggattgggggagcatcacccagcaaccacatctgtcctctagagaatcccctgagagctccgttcctcaccagtggactggacctggaggactcctcttcgttggtggcagcacggtccggcgggtactccctacctcccgaggttcgactaacgtggtcgcgaggtcgtggggtctaggtaacgtcgcgacgacggtccggtcgggtacctacgagtacgaggtacgtccgtacgtacggacgtaacggtccgttgtacggtaccgtacccgtcccgttaccggaccgtaacccttaagttaacttaactaccgtaaccggtggtaccgtccggcccgtaccggacccgggtcccgaaagggtaaccggaacgggttcttaaggggtacgtagggacgtcggtaccgtagtacccttaccggtaaccgtaaggttaccggggtcgtacgtaacgtaaactaaggtttcgacgggtacggtacggttagttacgggaggacgggtacgtacgcggtaacggacgtaacggcctaccgtacctacgtcgtaactacgtagtactagttntacgtgtagtcggctaccgtactgtacgtacgtaccgtacggaccgtcgtccgttccgttacgttacgttacggcgtacgggtaccgttcccgttacgttcgtacgcggttacaccgtaccngtccgtcccg

SEQ ID NO: 41628 - DNA, 728 bp, Homo sapiens
  misc_feature: GYAE6OF01DW50B.8.59.F04.1.454.CMB.1.raw
  modified_base (121)..(121): a, c, t, g, unknown or other
  misc_feature (121)..(121): n is a, c, g, or t
  modified_base (130)..(130): a, c, t, g, unknown or other
  misc_feature (130)..(130): n is a, c, g, or t
  modified_base (348)..(348): a, c, t, g, unknown or other
  misc_feature (348)..(348): n is a, c, g, or t
tcagctcgcgtgtccacgaccggtgctcgatttagtacacacacttagggattgggggagcatcacccagcaaccacatctgtcctctagagaatcccctgagagctccgttcctcaccanggctggacnggaggatcctcttctggtggcagcagcggcggagtccactcccaggtgacaacgtggtgcagtcgtggggctgaagtggcgcgacggccgtggggcccttacgagtcgagacgtcctcctgcaaggtcttcgtgatacgtccgttcggccgaccactagtaatacgacgtggatcgccgccgacggtccccgaggaccgtaaggtctaggaggtaggngtacggtccgtaggaaccttcggtaacccggtaagttcgggtagggtacggaactaaaccgtaattaacggtcgtacgggtaacggggtttcgttaaccgggacggggtcggtaacgggtccggaaccggtaacggacccgggtaacgggacccctaacggtacccaacgtaccacgtaactacgttataacgttagtacgtcttagttcgaccgggtcgtaccgtagtacgtacgttacgacggaaccggtccgggtaaccgtccggtttacctttacggttttcgggcggtacgggggtaacccgggtacccggttacccggttttcgtttaaccgggaccgttaacggtaccgttaacctccgaacctttacccggg

SEQ ID NO: 41629 - DNA, 538 bp, Homo sapiens
  misc_feature: GYAE6OF02H8THZ.8.59.F04.1.454.CMB.1.raw
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
  modified_base (531)..(531): a, c, t, g, unknown or other
  misc_feature (531)..(531): n is a, c, g, or t
tcagctcgcgtgtccacgaccggtgctcgatttagtacacacacttagggattgggggagcatcacccagcaaccacatctgtcctctagagaatccccggagagctccgttcctcaccactggactggaccgtggagggagtcctccttcctttggttgggcgagcagccgccgggaggtccacctcccacggtgcaactaggtggcagtctggggcgtgaagtgcgcgagcctggggccgtcagtcagagtctcctgcaaggcttctggagtacgccttcggcgaccactatatacactggatgcgccacggcccctggacaagggcttgagtggatggcctggatctacccgaatagtggtggcacaaaattatgcacgggaggtttcagggcagggtcaccgtgaccagggacacgtcatcactacagtctanatgcatttgngcggcctcanagtctcgacgacacggccgttctacttttgtggcgagggaccgtaccgttcttttgacgtggaccgtactcacnttccccg

SEQ ID NO: 41630 - DNA, 511 bp, Homo sapiens
  misc_feature: GYAE6OF02GIGBN.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtctggggctgaagtgcgcgagcctggggcctcagtcagagtctcctgcaaggcttctggatacgccttcggcgaccactatatacactggatgcgccaggcccctggacaagggcttgagtggatggcctggatcgtacccgaatagtggtggcacaaattatgcacgggagtttcagggcagggtcacgtgacagggacacgtcatcactacagtctatatgactatttgagtcggctcgagatctgacgacacggccgtctactttgtgacgagggtaccgtaccgttctttcgacttggaccgtactcactacg

SEQ ID NO: 41631 - DNA, 638 bp, Homo sapiens
  misc_feature: GYAE6OF02IES9H.8.59.F04.1.454.CMB.1.raw
  modified_base (321)..(321): a, c, t, g, unknown or other
  misc_feature (321)..(321): n is a, c, g, or t
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtcgtggggctgaagtgcgcgagccgtggggcctcaggtcagagtctcctgcaaggcttcgtggactacgcttcggcgaccactatatacactcggatgcgccaggcccctggacaagggcttagagnggatggctgatctaaccgaataggtggtcgggcaaacgtaaattacgtagaccgtaacggggtacgtttacgaggggtacgaggggtaccctaccgggtaggaacccggaggggtaaccaccggtttacccgaacgtacctaacgtacgaacgttcgttaacttaacgtgtaccgtagttttcgacggtaccgggtaccctagaacgtattaccgtcggaacgtaaccgaccggttccgtacgtttacgttttaggtcggtacggacgggtacccgtacgtttcgtttacgacgtcggacgtacgttccacttaccg

SEQ ID NO: 41632 - DNA, 572 bp, Homo sapiens
  misc_feature: GYAE6OF02F2RFR.8.59.F04.1.454.CMB.1.raw
  modified_base (438)..(438): a, c, t, g, unknown or other
  misc_feature (438)..(438): n is a, c, g, or t
tcagctcgcgtgtccacgaccggtgctcgatttagtacacacacttagggattgggggagcatcacccagcaaccacatctgtcctctacgagaatcccctgagagctccgttcctcaccatggactggacctggaggatcctcttcttggtggcagcagccgcgggagtccactcccaggtgcaactggtgcagtctggggctgaagtgcgcgagcctggggcctcagtcagagtcctcctgcaaggcttctggataccgccttcggcgaccactatatacactggatgccgccaggcccctggacaagggcttgagtggatggctggactccgtaccgaataggtggtgggcaacgtaaattagtgaccgacgggtagtttcgagggtcgacgggtccaccggtgaccgaggacacgtccatcactacatctatanctctagtttgacgtcggtcctacgagacttacgtgaaccgacgaccgggtccttacgttacgtttggcggtacggaccgggtacccgttaccgttcgtttacggacgttccggaccgtaccttccacttacccg

SEQ ID NO: 41633 - DNA, 533 bp, Homo sapiens
  misc_feature: GYAE6OF02GP9R8.8.59.F04.1.454.CMB.1.raw
  modified_base (430)..(431): a, c, t, g, unknown or other
  misc_feature (430)..(431): n is a, c, g, or t
  modified_base (501)..(501): a, c, t, g, unknown or other
  misc_feature (501)..(501): n is a, c, g, or t
  modified_base (526)..(526): a, c, t, g, unknown or other
  misc_feature (526)..(526): n is a, c, g, or t
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtctggggctgaagtgcgcgagccgtgggggcctcagtcagagtctcctgcaaggcttctggactacgccttcggcgaccactatatacactggatgcgccacggccctggacgaggctggagtggatggccgtggactctaccgagtagtggtcgacacaaattagcgcgtacgggtagtttcgagggtcgagggtcacggtgaccgagggacacgtccatcactactagtctatnnctattgagccgtctgagtctcagacgacgacgccttattcgtttgcggacggtacgggccgtaccgtttnttacggcgttacggaccgtactacncgtaccg

SEQ ID NO: 41634 - DNA, 652 bp, Homo sapiens
  misc_feature: GYAE6OF02HWKTV.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtcgtggggctgaagtgcgcgagccgtggggcctcagtcagagtctcctgcaaggcttctggatacgccttcggcgaccactatatacactggatgcgccagggcccctggacaagggcttgagtggatggctggatcgtacccgaatagtggtaggcaactaaattatgccgacggggtacgttttcggagggtaccgtaggggttaccaaccgggttacggaacccgaacgggggtaccaaccggtaccgaacttaccgaacttaacccgtaacgttactaattactcgtaccgtaagtttggacggtccgggtacctacgaggtacttcgtacggaacgtaccgaaccgggtcccgttacttacgtttttcggtcggtaccgggtaagggaccccggttaaccggtttcgttttaacggaccgttcgggaacgtacccgtacgtaccgttaacccg

SEQ ID NO: 41635 - DNA, 712 bp, Homo sapiens
  misc_feature: GYAE6OF02HPTIE.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccacctcccaggtgcaactggtgcagtcctggggctgaagtgcgcgagccgtgggcctcagtcagatctctgcagcttgtgatacgccttcggcgaccatatatacactgatcgcgccgacggccccgtaggacgacgggtacttcggaggtggagtcggaccgtggactaccgtaaccccggtaagtacgggttaggtaccggacgaaaccgtaaaagttacgtacggaccggtaacgggtacgttttacgggaacgggtccgtaaggggttacccgaaccggttaccgaaaccggacgggtaaaccgaaccggttaaccgtacttaacccgaaacgttaaccgtaaacggtttccttaaagttacgtacgtacgttaaggtttagaccggtaccggtaccctagacgttacgtacgttaacgacgaaccgtaccggtccgttacgtttacgttttggacggtaccggtaaccgggtacccgttaccggtttaccgtttacggtaccgtacggtaacccgtaccgttactaaccgttacccg

SEQ ID NO: 41636 - DNA, 741 bp, Homo sapiens
  misc_feature: GYAE6OF02IFJLO.8.59.F04.1.454.CMB.1.raw
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtcgtggggctgaagtgcgcgtagccgtggggcctcgagtcagagtcctctgcaaggtcttcgtggataccggtcccgttcgggccgaacctacttaatactaacctacgttggacgtcggccgacccgaccgggccccgttaggaaccgaacggggtcctttgggaacggttcgggaacgttcggggtccgttacgggtaacttacccggtaaccccggtaaagttcgggttacggggtcgaactaaacgtaaaagtttagtacggtacggtaacgggtacgttttacgggacggggtaccgtacggggtcctaaccggttacggaacccgaaggggtacctacccggtacctaacgtaccgtaacgtaacgtaacgttacttaagttagtcgtattacgttttacggacggtccgtaccgtaccgagtaccgttcgaccgacggtaccgaccgggttccttacgttttacgtttacggcggtaccggtaccgggtacccgttacgtttcgtttacgacggttaccgaccgttactcgtacctaccg

SEQ ID NO: 41637 - DNA, 754 bp, Homo sapiens
  misc_feature: GYAE6OF02I9HQ3.8.59.F04.1.454.CMB.1.raw
  modified_base (164)..(164): a, c, t, g, unknown or other
  misc_feature (164)..(164): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (471)..(471): a, c, t, g, unknown or other
  misc_feature (471)..(471): n is a, c, g, or t
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccggngggagtccactccaggtgcactggtgcagtcgtggggctgaagtgcgcgagtccgtgggcctgngtcagntcnctgcaggcttgnggtactacgtccgttcggaccgaccctatacgtactacgacgttcggatcgccggaccgaccgggtccccgttaagggaaccgtaaggggtcgtttacggaagggttcgggacggttccgggtcccggtagggtaaccgttacccgtaacccgtaaaggttaacggggtgggtaccgggtaacaaaccttaaagttacggttcggaaccggtaacgggggtntttaccgggaacgggtgaccggggttacaccgggtacgtaaccgggacgggtaacgtccggtaactaaccgtccgtaaccgttaacggtacttacggttactaagttcgtaaccttacggttacgggcggtacccggttacgtacgtacgttacgtacggtacgtaacccggtcgaacccggttaccgttcctttacggttacggtcgggtaccggtaccggggttaccgtccgttttacgttacggtccggtacgtacccgtactacccgggtcttacccgg

SEQ ID NO: 41638 - DNA, 800 bp, Homo sapiens
  misc_feature: GYAE6OF02JW86Z.8.59.F04.1.454.CMB.1.raw
  modified_base (256)..(256): a, c, t, g, unknown or other
  misc_feature (256)..(256): n is a, c, g, or t
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtgcagtgtggggctgaagtgcgcgagcctggggcctcagtcagacgtctccgtgacaaggccttcgnggtagtcgccgttcggccgaccagtatactacacgtggatcggccgccgacggccccgtaggaaccgaagggtcttaggaggtggacttcgggccgtagggtactaccgtaacccgaaaggttcggtcgggtacggactaaaccgtaaagtttacgtacgacggtaaccgggggtacgttttaacgggacggggtacgtaacggggttccggtaacccgggttaccgggaacccgggtaacggggtaacccgtacccgggttaccgaagttaccccgaaaccgtttaaccggtacgtttaaccgtttaacgtacggttaacgtacgttaaccgttttacgggaccggtaccgggttaccccgtaccggtaagtaaccggttccgtaacggaacccggtaaccggtacccgggttacccgttaccgtttaaccgtttttacgggcgtaaccgggggttaaccggtaacccccgggtttaccgtttaccggtttaccggttaacggttacgggtaacccgtacccgtttacccgaccgttaacccg

SEQ ID NO: 41639 - DNA, 673 bp, Homo sapiens
  misc_feature: GYAE6OF02HR5SH.8.59.F04.1.454.CMB.1.raw
  modified_base (166)..(166): a, c, t, g, unknown or other
  misc_feature (166)..(166): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
  modified_base (556)..(556): a, c, t, g, unknown or other
  misc_feature (556)..(556): n is a, c, g, or t
tcagctcgcgtgtccacgaccggtgctcgatttagtacacacacttagggattgggggaggcatcacccagcaaccacatctgtcctctagagaatcccctgagagctccgttcctcaccatggactcggacctggaggatcctcttcttggtggcagcagcccgngggtacgtcctaccgtcccgaggtcgacaaccgtggtgcagtcgtggggctgaagtgcgacgaggtccttcggggcctacagccgtaagnggtccttcgngaccgaggtccttcgtggtactacggtcccgttcggccgaaccgactactactacgtaacgtgacgtgaccgcgaccggcccgtagaaccgtacggtcttggagtaggcgtcggtaccgtggtagtccctaaccggaataacggttggggtacgactaaacggtaaattagtcgacgtacggggttagttaccgagggacgtaggtccgacggtacgtacggacggacgtacgacgactacgtacacgtatagtataaccgntacgtnttccgagaccggtccaccgtgnttaaccggtaacgaccgtaacggtccgtagtttccgtagtttaacccgggccggtaaggaccccggttactcggttttaccgtaccggtaggacccgtaacgtttccgaacttccgg

SEQ ID NO: 41640 - DNA, 648 bp, Homo sapiens
  misc_feature: GYAE6OF02JA6SR.8.59.F04.1.454.CMB.1.raw
  modified_base (498)..(498): a, c, t, g, unknown or other
  misc_feature (498)..(498): n is a, c, g, or t
tcagctcgcgtgtccacgaccggtgctcgatttagtacacacacttagggattgggggagcatcacccagcaaccacatctgtcctctagagaatcccctgagagctccgtcctcaccatggactggacctggagatcctcttcttggtggcagcagccgcggcgtccactcccaggtgcaactggtgcagtctgggggctggaagtggacgcggagccgtcggggcctcagtcagagtctcctgcgaaggcttctggataccggccttccggcgaaccgactattactacacgtgattggccgcccgcggccccgtaggaccgaagggtcttacgaggttggagtcgggacccttgggaacttccgtaaccccgaagtacggtggtgtacaactaaatagtcgacgtacgggtacgtttcggacggtcgtacgggtccgtaaccggtgaacccgtagggacgaccgtaccgaatccgtactacgtaacgtctaactntcgtcctagtttcgacggtaccgtccgtacgtagtccgtaagtcggaccgtacgaccgggtcccttagttacgttttaccgcggtaccgggacgggtacccggttaccgtttcgtttaggtaccgttcggaacgtcctactacgtacccg

SEQ ID NO: 41641 - DNA, 664 bp, Homo sapiens
  misc_feature: GYAE6OF02G021Z.8.59.F04.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (272)..(272): a, c, t, g, unknown or other
  misc_feature (272)..(272): n is a, c, g, or t
  modified_base (431)..(431): a, c, t, g, unknown or other
  misc_feature (431)..(431): n is a, c, g, or t
  modified_base (657)..(657): a, c, t, g, unknown or other
  misc_feature (657)..(657): n is a, c, g, or t
tcagctcgcgtgtccacgaccggtgctcgattttagtacacacacttagggattgggggagcatcacccagcaaccacatctgtcctctagagaatcccctgagagctccgttcctcaccatggactcggaccgtggaggatcctctttcgttggtggcagcagccgcgggagtccactcccgaggtgcaactggtnacagtcgngggctgagtcgcggcgagtccgtcgggcctagagtcgagtacgtctaccgtcgacgacggtcttcgnggtataccgtccgtccgcgaccctaatactactacacgtcggaatcggccgaccgaccgggtcccgaggaccggaagggttccgtagtggtaggtggtcggtaccgtacggaccttacgtaccggtaaagtcggtggtacggactaaacgtaaagtttnaccggacgtacgggtacgttcgagggtcgtaagggtccgtacggaccgaacggcggaccgttacgcctacgtacaaccgttacacggtttactacgtgtacgtacttgttgtacccgcggttaccaccgtagtacctagtaccggccgtaacgtccgtcgtttacgtcgttgaccggtacggtaccggtccgtttacgttcgttacgaccggttgaccagttaccngtaaccg

SEQ ID NO: 41642 - DNA, 637 bp, Homo sapiens
  misc_feature: GYAE6OF02GNN65.8.59.F04.1.454.CMB.1.raw
  modified_base (626)..(626): a, c, t, g, unknown or other
  misc_feature (626)..(626): n is a, c, g, or t
tcagctcgcgtgtccacgaccggtgctcgatttagtacacacacttagggattgggggagcatcacccagcaaccacatctgtcctctagagaatcccctgagagctccgttcctcaccatggactggacctggaggatcctcttcttggtggcagcagccgcgggagtccactcccaggtgcaactggtcgcagtcgtggggctgaagtgcgcggagccgtgggcctcagtcagagtcctccgtgcgaggcttcgtggactaccgtccgttccggccgacctaactatactactacgtggagtcggccgaccgacggccccgtaggaacgtaacgggtctggtacggtgggagtcggtacctggtacgtaccgtaaccggtagttaggtagggtcgacgtaaactaattacgcgcggtacggggtagtttcggacgggtcgtagggtacccgtacggtaggaccggtagggaccgtaccgtacagtaccacgtacatactatctgtatcgttgacgtccgtactacgacgtcttaccgaggtaccgacgtacccgtcgttacgttcgtttaggcgggttacggccgggtaacccgttcgtttacgttcgacgtaccgtacgtacnccacttacccg

SEQ ID NO: 41643 - DNA, 510 bp, Homo sapiens
  misc_feature: GYAE6OF01BV759.3.69.G03.1.454.CMB.1.raw
  modified_base (427)..(427): a, c, t, g, unknown or other
  misc_feature (427)..(427): n is a, c, g, or t
tcagagacgcactccacgaccggtgctcgatttagtcgctgcgtaaaggagaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctcaggctgaggacgaggctgattatactgcagctnatatacaagcaagcagcacgtgggtcttcggaactgggaccaaggtcaccgtcgtcccacgtcagcccaagcccaacccgtac

SEQ ID NO: 41644 - DNA, 548 bp, Homo sapiens
  misc_feature: GYAE6OF01CWBZG.3.69.G03.1.454.CMB.1.raw
  modified_base (432)..(432): a, c, t, g, unknown or other
  misc_feature (432)..(432): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttaataactatgtctcctggtatcaacagcaccaggcaaacgccccaaactcataatttatgatgtcagtaatcgccctgtagggtttcaatcgtcttctctgttacaagtctaggtcaacaccggtcctcctacgacctactctcgtacgggctccgaggctgaggacgaggctgattatacngcagctcaatataacaagcagcagctacgtgggtctacggaacgtcgggaaccgtaggtaccaccggttccgtacccgacgtcgacggaccccgaacggaccccaaccccgtaccg

SEQ ID NO: 41645 - DNA, 535 bp, Homo sapiens
  misc_feature: GYAE6OF01BVXXP.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataatttatgatgtcagtaatcggcctcaggggtttctaatcgcttctctgttacagtctggcaacacgcctccctgaccatctctggctccgaggctgacggacgaggctgtattattactgcagctcatatacaagcagcagcacgtgggtctccggaacgtcgggaacctaaggtccgacccggtccgtacccgacgtaccacgaccccgaacggcccctaaccccgtaccg

SEQ ID NO: 41646 - DNA, 536 bp, Homo sapiens
  misc_feature: GYAE6OF01C0MKR.3.69.G03.1.454.CMB.1.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
  modified_base (424)..(424): a, c, t, g, unknown or other
  misc_feature (424)..(424): n is a, c, g, or t
tcagagacgcactccacgaccggtgctcgatttagtcgctgcgtaaaggagaaagggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccngcagtgacgttggtgttaatactatgtctctggtatcaacagcacccaggcaaacgccccaaatcataattangatgtcagtaatcggccctgagggtttctaatcgtcttctctggttacaagtctggctaacacggcctccngaccatctcgtggctcgagctgaggacgaggctgattatactgcagctanatatacgaagcagctagcgtacgtggggtacttacggaacgtcgggacctaagggtccacccggttccgtacccgacgttccaacgacccgaacggccccaaccccgtaccg

SEQ ID NO: 41647 - DNA, 559 bp, Homo sapiens
  misc_feature: GYAE6OF01BUVPL.3.69.G03.1.454.CMB.1.raw
  modified_base (435)..(435): a, c, t, g, unknown or other
  misc_feature (435)..(435): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggacaaacgcccccaaactcataatttatgatgtcagtaatcggcctcgagggttctaatcgcttctctggttacaagtctggcaacacggcctccgtcgaccatctctcgggcctccgaggtctaggaggacgaggctagtatttacttacngcagtctacatactacgaagcaagcacgctacggtcgggtacgtacggaacgtcgggaacctacgggtacctaccggtcccgtacccgacgtccaccgacccgaacggaccccaacccgtaccg

SEQ ID NO: 41648 - DNA, 522 bp, Homo sapiens
  misc_feature: GYAE6OF01D9U72.3.69.G03.1.454.CMB.1.raw
  modified_base (431)..(431): a, c, t, g, unknown or other
  misc_feature (431)..(431): n is a, c, g, or t
tcagagacgcactccacgaccggtgctcgatttagtcgctgcgtaaaggagaaaggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcaccaggcaaacgcccccaaatcaataatttatgatgtcagtaactcggcccttcgtagggtttctaatcgcttctctggttacaagtctggcaacacggcctccctgacctatctctgggcctccgaggctgaggacgaggctagtattattacngcagctcatatacaagcagcagcagtgggtcttcggaactgggaccagtccaccgtccgtccacgtcacgcccaacggcccaacccgtacg

SEQ ID NO: 41649 - DNA, 519 bp, Homo sapiens
  misc_feature: GYAE6OF01E4A10.3.69.G03.1.454.CMB.1.raw
  modified_base (395)..(395): a, c, t, g, unknown or other
  misc_feature (395)..(395): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataattatgatgtacagtaatcggccctcgtagggtttctaatcgtcttctctggttacaagtctgcacacggcctcctgaccatctctggctcnggctgaggacgaggctgattatactgcagctacatatacagcagcagcacgtgggtctacggaacgtgggaccgaggtctaccgtcgtacccgacgtccacgacccgaacgcccaacccgtacg

SEQ ID NO: 41650 - DNA, 518 bp, Homo sapiens
  misc_feature: GYAE6OF01CDWP9.3.69.G03.1.454.CMB.1.raw
  modified_base (251)..(251): a, c, t, g, unknown or other
  misc_feature (251)..(251): n is a, c, g, or t
  modified_base (367)..(367): a, c, t, g, unknown or other
  misc_feature (367)..(367): n is a, c, g, or t
  modified_base (514)..(514): a, c, t, g, unknown or other
  misc_feature (514)..(514): n is a, c, g, or t
tcagagacgcactccacgaccggtgctcgatttagtcgctgcgtaaaggagaaaggggggggtcccaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttanaactatgtctcctgtatcaacagcacccaggcaaacgcccccaaactcataatttatgatgtcagtaatcggccctcagggtttctaatcgcttctctggttacagtctggcaacncgcctcctgaccatctctgggctccgaggctgaggacgaggctagattatactgcagctcatatacaagcagcagcacgtgggtcttcgggaactgggaacctaaggtcaccggtcgtcccacgtcacgcccaaggcccaaacccgntacg

SEQ ID NO: 41651 - DNA, 941 bp, Homo sapiens
  misc_feature: GYAE6OF01D40H5.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcccacctcctcactcacggcggacaggtcgtcggccgaccgtcgtcgtcccgtcgtactacctagccgtcgtcctcccgttcgtcgttcgggttcgttccttcggacgaacgtcggtactactactccgtccactcttcccttcgcactacggaaccgaacgacgacgtaggtacggtttgggttaggtttaattaaaccttaattcggttccttcccttagggtaattacaaaccgaagccaacccccgaaggaccgaaaaccgaaccccccaaaaccttaataactttaaaatttttaactaggtaacgttcgttaccgtaagttaaaacgtcccgggtcccccttacccggtttaaagggggttttaccctttaaacgtaccggttacccttttcctttacgtttacggggtttaaaccgttaaacgtccggttacgggaacctaaaacccggtaacccgggtcccccgtttcccctaggaaacccctaacttttcccgttccggttcggggacccgttacccctaaggggtcgttacgggaacgggaaaccggttacgggctttaacggttaatttttaaaccgttcgttaccggaccgtaagtacccgtttaacaacgtttaaacgtaaacccgaaacggtccgaacgtaccgaacggtacccttacggggtttacggggtaacccgttttacccggaaacggaaccggggtttaaccggaaacccggtttaggtaccccccggttacggtccccctaaaccggtcgaaaccccgggtaccccgaaacccgggttacccccaaaacccctaggtttccgg

SEQ ID NO: 41652 - DNA, 516 bp, Homo sapiens
  misc_feature: GYAE6OF01EJYI2.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataattatgatgtcagtaatcggccctcagggtttctaatcgcttctctggttacaagtctggcaacacgcctcctgaccatctctgggctccagctgaggacgaggctgattatactgcagctcatatacaagtcagcagcacgtgggtcttcggaacgtcgggaccaaggtcaccgtcgtcccacgtccacgacccaacggcccaacccgtacg

SEQ ID NO: 41653 - DNA, 695 bp, Homo sapiens
  misc_feature: GYAE6OF01AM41S.3.69.G03.1.454.CMB.1.raw
  modified_base (322)..(322): a, c, t, g, unknown or other
  misc_feature (322)..(322): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcatcgccatcctcctgcacgtcggaaccagcaggtgacggttggtgttatactatgtctctggtatcaacagccaccgaggaccaaaccgacccccaaactacaattaatttanagtatagtacagtaactccggcccttgtacgggtttctaagtcgtcttcgtcgtagttactaacgttcgtacggaccaaccgtcggtccccttacccgtacgacctacttccgttacgtcgggtcctaccggacggtcgtagggaacggtacggaggtacgttaggttaactttaacgttacgtcgtaccgacgtacctaactaacttaacgaacgaacgcgaacgtacgaacggtacgtaccgggttcggggttaccgttaccgggaaccgggtaccgggaacccgtaagggtaccccgtacccggttacccgtacccgtaccggtacccgacccggaaccccggaaccggtacccccaaaccccgttaccg

SEQ ID NO: 41654 - DNA, 766 bp, Homo sapiens
  misc_feature: GYAE6OF01DUSZQ.3.69.G03.1.454.CMB.1.raw
  modified_base (144)..(144): a, c, t, g, unknown or other
  misc_feature (144)..(144): n is a, c, g, or t
tcagagacgcactccacgaccggtgctcgatttagtcgctgcgtaaaggagaaagggggggtctcagggaggcgagcgctcctcgggacgtctccaccatggcctgggctctgcgtacttcctcaccctctcacgtcaggcacngggtcctgggcccagtcctgcctgactcagcctgcctcgtcgtctggtcctctggacagtcgatcatcgcagtctcctgcactaggaaccagctagtggacgttggtgttaagtaactatgtactcctggtatcaatagcaccaggccaaacgacccccgaaacgtccaagtaaactttactaggtaattcggtactaagttaaacgtccgggtacccttaccgtaggggtttttacctaaagttaccggtcgttttccctacgtttaggtttaacgtaaacggttcgttacgggctaaaacggtaccgggtcccttaccccggtacgtaaccctaacgttaccttccgttcgggtaccttacccgaacgggttcgtacgggaacgggaacggtaacgggtcctagggttaaccttaagtttaactcggtactacggtccttaacgtaacttacttaaccgaaacgttctaaacggctaacgtcgtaaccggttacgggggtttacctttacccgggaaaccgttcgggggaaaccccgtaaaggggttcccaaaccgggttacccgtaaccccaacggttaccaaacggttccccgaaacgggcccctaaccccgtaaccg

SEQ ID NO: 41655 - DNA, 565 bp, Homo sapiens
  misc_feature: GYAE6OF01D18RB.3.69.G03.1.454.CMB.1.raw
  modified_base (232)..(232): a, c, t, g, unknown or other
  misc_feature (232)..(232): n is a, c, g, or t
  modified_base (440)..(440): a, c, t, g, unknown or other
  misc_feature (440)..(440): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcattcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcacccaggcaaacgcccccaaactcataatttatgatgtacagtaatcggccctgaggggtttctaatcgtcttctctggttacaagtctaggcaacaccggcctccctgaccatctctgggcctcgaggctggaggacgaggctgtattattactgcagcctanattaatacaagtcaagcacgctacggtcgggttcttaccgggaacgtcggggaacccaagggtaccacccggtaccgtccccgaccgtccaaccgtaccccgaaacggccccaaaccccgtaccg

SEQ ID NO: 41656 - DNA, 517 bp, Homo sapiens
  misc_feature: GYAE6OF01BNPKS.3.69.G03.1.454.CMB.1.raw
  modified_base (252)..(252): a, c, t, g, unknown or other
  misc_feature (252)..(252): n is a, c, g, or t
  modified_base (433)..(433): a, c, t, g, unknown or other
  misc_feature (433)..(433): n is a, c, g, or t
  modified_base (491)..(491): a, c, t, g, unknown or other
  misc_feature (491)..(491): n is a, c, g, or t
tcagagacgcactccacgaccggtgctcgatttagtcgctgcgtaaaggagaaaggggggggtctcaggaggcagtgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttanaactatgtctcctggtatcaacagcacccaggcaaagcccccaaatcataatttatgatgtcagtaatcggaccctcaggggtttctaatcgcttctctggttacaagtctggcaacacggcctccctgaccatctctgggctccaggctagaggacgaggctagattatactgcagcctnaattatacaagcagcagcacgtgggtcttcggaactgggaccaggtcacgtctacccngtccagcccaacggtccaaccctacg

SEQ ID NO: 41657 - DNA, 510 bp, Homo sapiens
  misc_feature: GYAE6OF01DD6V7.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcaccaggcaaagcccccaaaatcataatttatgatgtcagtaatcggccctgagggtttctaatcgcttctctggttacaagtctggcacacggcctccctgaccatctctgggctccaggctgagacgagctgattatctgcagctcatatacaagcagcagcacgtgggtctcggaactgggaaccaggtcaccgtcgtacccacgtcaacgcccaacggcccaacccgtacg

SEQ ID NO: 41658 - DNA, 581 bp, Homo sapiens
  misc_feature: GYAE6OF01AVNJR.3.69.G03.1.454.CMB.1.raw
  modified_base (247)..(247): a, c, t, g, unknown or other
  misc_feature (247)..(247): n is a, c, g, or t
  modified_base (374)..(374): a, c, t, g, unknown or other
  misc_feature (374)..(374): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgtttggngttataactatgtctcctggtatcaacagcaccaggcaaacgccccaaactcaataatttatgatgtcagtaactccggccctcgtagggtttctaatcgtcttctctagttacaagtctgacaacncggcctcctgaccatctcgtcgggcctccgaggctggacggacgaggctgtaattactacgtgacagctacaataactacaagtcagacacgacgtacgtcggggtaccttacggaaccgtcggggaacctaagggtccctaccggttcccgtaacgggtaccgaaccggtaccccaaacggccccctaaaccccgtcgttacccgg

SEQ ID NO: 41659 - DNA, 558 bp, Homo sapiens
  misc_feature: GYAE6OF01A5LBN.3.69.G03.1.454.CMB.1.raw
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcaataatttatgatgtcagtaactcggccctgagggtttctaatcgtcttctctgtacagtctggcaacncgcctcctgaccntcctctcgggctcgaggtctggacgacgaggctgtattatacgtgacagctacataactacgaagcagacagactcggtgggttccttacgggaacgtcgggaacctaaggtcccgacccggttaccgtcccgtaccgtaccaccggacccgaaccggtcccccaaacccgtaccg

SEQ ID NO: 41660 - DNA, 581 bp, Homo sapiens
  misc_feature: GYAE6OF01BRDF9.3.69.G03.1.454.CMB.1.raw
  modified_base (232)..(232): a, c, t, g, unknown or other
  misc_feature (232)..(232): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcaccaggaccaaacgcccccaaactcaataatttatgatgtacagtaactccggtccctcgtagggtttctaagtcgtcttctcgttaggttactaagtctaggacaacgaccggtcctcccgtagacctatctcgtcgggcctccgaggctaggacggacgacggctagtattagttactgcagctacatacacgagcagcagactacggtcgggtaccttacgggaacgtacgggaaccgtaaggtccgacccggtccgtacccgacggtaccgacgaccccgaaccggccccaacccgtaccg

SEQ ID NO: 41661 - DNA, 723 bp, Homo sapiens
  misc_feature: GYAE6OF01C93YO.3.69.G03.1.454.CMB.1.raw
  modified_base (233)..(233): a, c, t, g, unknown or other
  misc_feature (233)..(233): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgccatctcctgcactggaaccngcagtgacgttggtagttataactatgtctcctgtatcaacagcaccaggcaaacgccccaaactcaataattatagatgtacagtaactccggccctagtacgggtttactaacttcgtacttcgttacgttggttaactaacgttcgtaggtactaaaccgtacggtacccctcccgtacggacctactcgtcgtcgggtcctaccgtagggtcctaggaacgggtaacggacgggtctagtaacgtttaacttacgttcgacctaggtcctaccgtaattaacgttaacaaacggtccgaagtaccgtaacggacctaaccggggtttcgggggttaccgtttaaaccgggaaccgggtttaacccgggggaaacccggttaaacggggtaccccgtacccgggttaccccggttacccccgtaacgggttccccgaaacccggtacccccggaaacccggtaccccccgaaaacccccttacccgg

SEQ ID NO: 41662 - DNA, 682 bp, Homo sapiens
  misc_feature: GYAE6OF01CYTDO.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctctggtatcaacagcaccaggcaaacgcccccaaactcactaatttatagatgtcaagtaatcggcctcgtagggttctaatcgtacttctcgttacggttacaagtctggaccaacgacggccttcctcgacctatcctcgtcgggtcctccgaagggtctagggaacgggaaccggagggtctacggtaattttaacttaacgttggtactaacggtccttaccgaaattaaaccgttaacgaaaccgtcgaacgaccgaagtcccgttaacgggttcgggggtttaccttaccggggtaaacgttcggggaaaccccgtaaaggggttcccctaaacccgggttcccggtacccccgaacggttaccccgaaccggtaccccccgaaaacggggtccccccaaaaccccccgttaccgg

SEQ ID NO: 41663 - DNA, 736 bp, Homo sapiens
  misc_feature: GYAE6OF01A5UHO.3.69.G03.1.454.CMB.1.raw
  modified_base (572)..(572): a, c, t, g, unknown or other
  misc_feature (572)..(572): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgccatctcctgctacgtggaaccagcagtgtacgttggtagttataactatgtctcctggtatcaacacgccacccgaggaccaaaccgaccccccaaactcctaattaaacttttatgtatggtactaagtaactccggtacccttacggtaggggttttacctaagttccgtcctttacctcgttacggttaacgtaaacggttccgtacgggaacctaaaccgtacccgggttacccctaccccgtcgaacccctattcccgtccggttccgggtaccttcccgacggggtctacgggaacgggtaccggtacgggtacttaggtaacgtttacgttaccgtgtaccgtagtacctanaaacttactaacgaacgtaccgagtacgtacgaccgtaacgggttcgggttaccgttacgggaaaccggtacggggtaacccgtaagggttcccgtaccccggttccgtacccggtaccgttaccggaccgtaaccccgaaccggacccccaaacccccgtacg

SEQ ID NO: 41664 - DNA, 545 bp, Homo sapiens
  misc_feature: GYAE6OF01ENJVZ.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatccgccatctcctgcactggaaccagcagtgacgttgtgttatactatgtctctgtatcaacagcaccagcaaacgccccaaactcataattatgatgtcagtaatcgcctcgtagggtttactatcgtcttctctggttacagtctgacaacgacgcctccctgacctatcgtctcgggctccgaggctgacggacgaggctagtattatactcgcacgctactatactaacaacgtcagcacgacgacgttgggtaccgttacggaacgtcgggaccgtaacggtccgaccgtccgtcccacgtccacgacccgaccggaccctaaccccgtacg

SEQ ID NO: 41665 - DNA, 559 bp, Homo sapiens
  misc_feature: GYAE6OF01CQQST.3.69.G03.1.454.CMB.1.raw
  modified_base (308)..(308): a, c, t, g, unknown or other
  misc_feature (308)..(308): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatccgccatctcctgcactggaaccagcagtgacgttggtgtatactatgtctctggtatcaacagcaccaggcaaacgcccccaaactcacttaatttangatgtacagtaactcggccctacgtacggggtttactaagtcgtcttctcttaggttacaagtctggacacacggccctcctacgaccatctcgtcgggcctcgaggctggaggacgaggctagtattactactgcagctacaatacacgaagtcagtcagcgacgttggggtctacggtacgtacgggacctaacggtccgacccggtccgtacccgaccgtcgacgcccgaacgccccaacccgtaccg

SEQ ID NO: 41666 - DNA, 661 bp, Homo sapiens
  misc_feature: GYAE6OF01DB4CY.3.69.G03.1.454.CMB.1.raw
  modified_base (229)..(229): a, c, t, g, unknown or other
  misc_feature (229)..(229): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcacctctcactcagggcacagggtcctgggcccagtctcgccctgactcagcctgcctcgtgtctgggtctctggacagtcgatcatccgcatctcctgcactggaaccngcagtgtacggttggtagttaataactgtcgtctcgtgtactacacgacgacaccgacggaaccaaccgaccctaaactactaattaattatagtacgtacgtactacgtacgtccgtaccgtacggttacgggttactaacgtcgttcttcgtacgttacggttaacgtacgtcgtacgacaaccgtaccggtccctcccgtacgtaccgtacttccgtacggtcggtccgtacggtacggtacgtacggacggtacggtaggtacgtagttattacgttacgacgacgtacgtcgtactaataacgacgacgtacgacgacgacgtacgtacgggttcggtaccgtacgggtacggtacggtaccgtaggtacccgtaccgtacccgtacccgtacgtaccgaccgacccgacccgaccctacccgtacg

SEQ ID NO: 41667 - DNA, 625 bp, Homo sapiens
  misc_feature: GYAE6OF01AXE5H.3.69.G03.1.454.CMB.1.raw
  modified_base (231)..(231): a, c, t, g, unknown or other
  misc_feature (231)..(231): n is a, c, g, or t
  modified_base (272)..(272): a, c, t, g, unknown or other
  misc_feature (272)..(272): n is a, c, g, or t
tcagagacgcactccacgaccggtgctcgatttagtcgctgcgtaaaggagaaaggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctctgtatcaacancaccaggacaaacgcccccaaactcattaattatgatgtacagtactcggcctagtagggttctatcgtcttctctgtacagtctggacaacgacggtccctcccgtcgacctatcctcgtcggcctccgagtctaggaacggacggaggtctagtaacttacgttacgtcgctacgtcctactaattaactaaccgtaacgccgtaacgcgtaacgaccgtacgggttcgggttaccgttaaccgggtacggtaccgggaacccgtaacgggtacccgtaccccggttacccggtaccctaccggtaccgacccggaaccccgaaaccggaccccctaacccccgttaccgg

SEQ ID NO: 41668 - DNA, 679 bp, Homo sapiens
  misc_feature: GYAE6OF01C9890.3.69.G03.1.454.CMB.1.raw
  modified_base (235)..(235): a, c, t, g, unknown or other
  misc_feature (235)..(235): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacgacgggtcctgggcccagtctcgcctgactcacgcctgcctcgtgtctgggtctccgtggacagtcgatcatcgcatctcctgcactcggaaccngcagtgacgttggtagttaataactatcgtctctgtatacaacacgaccaccaggaccaaaccgaccccaaaactactaatttaaatttatagtattagtacgtaacgttaacgtccggtcccttacggttaacgggtttacttaacgttcgtacctttcttacgttacggttaactaacgtcgtacggtaaccaacgaccgtccctacctacgacctactcgttcgtcggtcctcgaggtcgaggacggacggacggtacgtagttaatttaacgttacgtacgtctacgtactactaactaagtaacgaagcaacgacacggtacgtacggttacgggttacgtacgggtacggtaacgggaaccggtaacggttaccgtacccggttcccgtacccgacgtaccggtaaccgacccgaaaccggaacccctaacccgtacg

SEQ ID NO: 41669 - DNA, 756 bp, Homo sapiens
  misc_feature: GYAE6OF01AO28G.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggacaaacgacccccaaactcaattaatttatagatgtacagtaacgtccggtccctacgtagggtttactaacgtcgtctttctcgttaggttaactaacgtcgtaggaccaaccgaaccggtccccttacccgtacgtaaccctacttaccgtcgtacgggcctacccggaggtccgtaggaacgggaaccgggtacggtacgttagttaacgtttaagttacgtacgacgtacggtaccttacgtaattaacgtaaccgtaaacggaccgtaacgtaccgaacggtaccgtaaccgggtttccggggggtttaccgtttaaacccgggggaaaccggttaaccgggggaaacccgttaaacgggggttaccccgtaccccgggtttaccccgtaacccccggtaaccggttacccgaacccgggtaaccccccggaaacccgggtaccccctaaaaccccccggttaaccgg

SEQ ID NO: 41670 - DNA, 646 bp, Homo sapiens
  misc_feature: GYAE6OF01ETZMA.3.69.G03.1.454.CMB.1.raw
  modified_base (232)..(232): a, c, t, g, unknown or other
  misc_feature (232)..(232): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttatactatgtctcctggtatcaacagccacccgaggaccaaaaccgcccccaaaactcaattaatttatgaatgtctagtaactccggcctcgtaggggtttactaagtcgtcttcttcttaggttaacagttcgtggactaaccgaccggtccctaccctagaccctatccttcgtacgggcctccgaggctacggacgggacgtacggtcgttagtatttaacgttacgtcggacctagtcctacaagttaactaacgaacgtacaacgcgaacggtccgtacgggttggggtaccttacgggtaaccgtacgggtaacccgaagggttcccgacccggttcccgtaccccgtaccgtaccgaccggaccccgaacgaccccgtaacccgtaccgg

SEQ ID NO: 41671 - DNA, 639 bp, Homo sapiens
  misc_feature: GYAE6OF01D8P5Q.3.69.G03.1.454.CMB.1.raw
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
  modified_base (463)..(463): a, c, t, g, unknown or other
  misc_feature (463)..(463): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcatctcctgcactggaaccngcagtgacgttggtagtataactatgtctctggtatcaacancaccaggaccaacgaccccaaactcattaatttangatgctagtactcgcctgtagggttactatcnctttctctgttacagtctggacacgacgtccctcctcgacctatcctcgtcggcctccgacggcgtaggacgggacggacggtcttaggtaactttacgtttacgtcgtacgtacgtcctanaacttaactaacgtacgacgaacgacgaaggtaccgtacgggttacggggttaccggtttaaccgggaaccggttacggggaaacccgttaagggtaccccggtaccccggtacccggtaccccgtaccggtacaacccgggaccccgtaaccgggaccccctaaccccggtaccg

SEQ ID NO: 41672 - DNA, 657 bp, Homo sapiens
  misc_feature: GYAE6OF01EMRUM.3.69.G03.1.454.CMB.1.raw
  modified_base (231)..(231): a, c, t, g, unknown or other
  misc_feature (231)..(231): n is a, c, g, or t
tcagagacgcactccacgaccggtgctcgatttagtcgctgcgtaaaggagaaaggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcacccaggacaaacgccccaaactcaattaatttatgtatgtacagtaatccgacctgagggtttctaagtcgtcttcgtcttagttacaagttctaggactaacgccggtcctccctgacctatccttcgtcgggtcctccgtaggctaggacggacggacggtctagtatttaacttacgtgacgacgtcctagtaactaataaccgagtaccgaagacgaagtcccgtaacggttcggggttacctttaccgggaacgtttacgggggaacccgttaaacgggtccctaaccccgggttacccggttaccccccgaaacgggttacccgaacccgggaacccccgtaaaccggaacccccgtaaacccccgttaacccgg

SEQ ID NO: 41673 - DNA, 601 bp, Homo sapiens
  misc_feature: GYAE6OF01BDNNF.3.69.G03.1.454.CMB.1.raw
  modified_base (274)..(274): a, c, t, g, unknown or other
  misc_feature (274)..(274): n is a, c, g, or t
  modified_base (457)..(457): a, c, t, g, unknown or other
  misc_feature (457)..(457): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccagcagtgacgttggtgttataactatgtctcctggtatcaacngcaccaggacaaacgcccccaaatctaataatttatgatgtacagtaactccggtccctcgtagggtttctaatcgtcttctcttggttacaagtcgtgacacaccggcctccctagaccctattcctcgtcggtcctaccgaggccgtaggacggtaccggaggctagtactttacttacgngctaggtctacaattaactacgaagtcaggacacggctaacgggtggggttacctagggaaccgtcggggtaacctagggtacccgtacccgtccgtacccacggtaccctacggacccgtaacccggacccctaaacccgtcg

SEQ ID NO: 41674 - DNA, 675 bp, Homo sapiens
  misc_feature: GYAE6OF01DNBZB.3.69.G03.1.454.CMB.1.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (578)..(578): a, c, t, g, unknown or other
  misc_feature (578)..(578): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctcgtgtcgtggtctccgtggacngtcgatcatccgccattcctcctgccactaggaaccagcagttgacggttggtgtaataactntgtctctgtatcaacagccaccgagaccaaacgacccccaaactactaatttaatttataggtactcggtacaacgttacgtccggccccttaggttaacgggttttactaacgttccgtaccgtttacgttccgttaacggttactaaggttccgtggtaaccacccgtaaccgggtccccttcccgacgtaccctacttccgttacgtccgggtccttaccggcggtacgtagggaaccggtacggcggtcttaacgttaactttacgttacgtacgtaccgtagtcctaataataactaacgagtcacgacncggtactacggttcggttacgttacggaacggtcggaaacgtaccggtctaccggtccgtacccagtccgaccgacccgaaccgccctacccgtacg

SEQ ID NO: 41675 - DNA, 633 bp, Homo sapiens
  misc_feature: GYAE6OF01CA1J0.3.69.G03.1.454.CMB.1.raw
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcactggaaccagcagtgacgttggtgttataactatgtctctggtatcaacagaccaccaggaccaaaccgacccccaaactcaattaatttatgatgtacagtactccggccctacgtacgggtttactactcgtcttctcgtggttaacaagtctggacacaccggtcctcccgtcacctacttctcgtcggtcctaccgacgggtctagggacggacgacggtcctagttaactttacgttaacgtggactacgtacctactaagtaactaacgaacgtaccgaacgacacggtacgtacggttacgggtcgtaccggtaacggtcgggaaacccgtacggtacccgtaccggttacccgtcccgtacgtaccgacccgacccgaacccggcccaaacccccgtacg

SEQ ID NO: 41676 - DNA, 720 bp, Homo sapiens
  misc_feature: GYAE6OF01AL3MH.3.69.G03.1.454.CMB.1.raw
  modified_base (317)..(317): a, c, t, g, unknown or other
  misc_feature (317)..(317): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatcctcctgcactggaaccagcagtgacgttggtagttataactatgtctccgtggtactcaacacgcacccgaggacaaaccgaccccaaactcaataatttangatcgtactaagtacgtccggcctcggtacgggtttactaacgtcgtcttcttcgtacggttaactacgtctacggacctaacgccggtcctacctacgtaacctactcctaccggtcgggtcctaccggacggtcgtacgggacgggaccggtacgggcttaggtaacgttttaactaccgttacgacgtaacgtcctaacttaactaaccttaacgaacgtaccgaacggtaccgaacggtaccggtaacgggtttcggggttacccgttaaaccggggtaccggtaaccggggtaacccgttaaacggggtccccgtaaccccgggttaccccgtaccccgaacccgggttaccgacccggaaaccccggtaacccggaacccccgtaacccctacccgg

SEQ ID NO: 41677 - DNA, 594 bp, Homo sapiens
  misc_feature: GYAE6OF01A0XP5.3.69.G03.1.454.CMB.1.raw
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
  modified_base (452)..(452): a, c, t, g, unknown or other
  misc_feature (452)..(452): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttaatactatgtctcctggtatcaacagcaccaggacaaacgccccaaatcataattangatgtacagtatccggcctcgtaggtttactatcgtcttctgtacgttacagttcnggtacaacgtccggtacctcccgtacgacctattccgtcgtcggacctccgaggtcgtaggaacgggacgaggtctagtacttattacgngcagtcctactaagttaactaacgaagtccaagtccgaagtccgtacgggtcgggttaccgttacggaacgttcggaaccgtaacggtccgacccggttccacccgtacgtcacccgtacccgaaccgcccctacccgtacg

SEQ ID NO: 41678 - DNA, 610 bp, Homo sapiens
  misc_feature: GYAE6OF01APVRD.3.69.G03.1.454.CMB.1.raw
  modified_base (315)..(315): a, c, t, g, unknown or other
  misc_feature (315)..(315): n is a, c, g, or t
  modified_base (566)..(566): a, c, t, g, unknown or other
  misc_feature (566)..(566): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatccgccatcctcctgcactggaaccagcagtgacgttggtagttataactatgtctctggtatcaacagcacccaggacaaacgacccccaaactcataatttatnatcgtcagtaatccggccctgaggggttttctaagtccgcttcttcgtaggttacaagttctggaccaaccgtaccggccctacccgtcgtacccacttccgtcgtaccgggtcctaccgaggtccgtaggacggacggaggtactgtaacttacgtttactcggactagcctactaataactaaccgaaggtacacgactacgacgtaccggtcgggttcgttacggacgtacgggacctacgggtaccnccggtccgaccgacgtcgacgacccacggaccccacccgtaccg

SEQ ID NO: 41679 - DNA, 659 bp, Homo sapiens
  misc_feature: GYAE6OF01C5ITY.3.69.G03.1.454.CMB.1.raw
  modified_base (315)..(315): a, c, t, g, unknown or other
  misc_feature (315)..(315): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacagtcgatcatccgccatctcctgcactggaaccagcagtgacgttggtagttataactatgtctctgtatacaacagaccaccaggacaaacgccccaaactctaattaatttanagtattacgtacaagttaactccggcccttacggtagggtttactaagtccgtcttcgttcttaggttaactaacgttctacggaccaacgaccggtccctacccgtcgacctacgtcgtcgtcggtcctccgacggtcgtggaacggacggagtcgttagtactttacgttacgtgctagcgtactagtaactaacgaacgctaacgcgaacgtcggtaccggttgggttaccgtacgggtaacggtaccgggtaaccgtaaccgggttccgaaccccggttcccggtaccccgtacgtaccggaaccgacccccggaaacggtacccccaaaccccggtacg

SEQ ID NO: 41680 - DNA, 779 bp, Homo sapiens
  misc_feature: GYAE6OF01ATSTB.3.69.G03.1.454.CMB.1.raw
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtcttggtctcctggacagtcgatcatcgcatctctgcacgtggaaccngcagtgacgttggtagttataactatcgtctcctggtatcaacncgacaccgaggaccaaccgaccccctaaatctaattaaatttacgtagtatacgtactaagttaacgtccggtacccttacggttaacgggtttactaacgtcgtacttcttacggttacgttactagttcgtacgaacctaaccgaccggtccctaccgtacgtacctacgttccgtcggtccggtactccgtaggtcccgtagggaacggacgtacggtacgttaggttaactttacgttacgacgtaccgtacgtaccgttaagtaaccttaagtaaacccgaacgtccgtaacggtaccgtaacgggtaccttaacggggttaccggggttaacccgtttaaccggggaaacccggttaccggggtaaacccggttaacgggtttacccccggtaaaccccgggtttccccggtaaacccccggttacggtaaccccgggtaacccccgggtaacccccggtaaaccccggtaaccccccgtaaacccccggttaacccg

SEQ ID NO: 41681 - DNA, 745 bp, Homo sapiens
  misc_feature: GYAE6OF01DWYXT.3.69.G03.1.454.CMB.1.raw
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggactagtcgatcatcgcatcctcctgccacgtcggaaccagctagtgtacggttggtaggttaataacttatgtctcctggtactcaacagccaccgaggaccaaaccgaccccctaaactctaagttaatttagagtattgtactacgttaagtcccggtcccgttacggttacgggttttactaacgttcgtcctttccgttacgttaggtttaaccaaggttcgtacggtaaccaccgtacccggtccccttacccgtacgtaaccctcgttccgttccggtcgggtccctaccggtacgggtacgtacggaacgggacggtacggtctaggttaatttacgttactcgtcctaagtaccttataacttaacgtaacgaacgtcaaacgtccaacggtacgtaccgggtttcgggtaccggttacgggaaaccggtcggggaaaccccgtaagggtccccgtacccggttaccccggtacccctaacccgggttccgaaaccccggaaccccgaaccccgggtacccccaaaccccggttacccg

SEQ ID NO: 41682 - DNA, 581 bp, Homo sapiens
  misc_feature: GYAE6OF01AJ3GJ.3.69.G03.1.454.CMB.1.raw
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
  modified_base (378)..(378): a, c, t, g, unknown or other
  misc_feature (378)..(378): n is a, c, g, or t
  modified_base (460)..(460): a, c, t, g, unknown or other
  misc_feature (460)..(460): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcatcgccatctcctgcactggaaccngcagtgacgttggtgttataactatgtctcctggtatcaacngcaccaggcaaacgcccccaaactcaataatttangatgtacagtaactccggccctcgtacgggtttctaatcgtcttctctagttacaagtctggacaaccnccggtcctcccgtacgacctacttctcgtcgggcctccgaggcgtaggaggacggagctgtattactagtcgacgtgcctanattaactacgaagcacggcacggactacggttcggggttccttacgggaacgtcgggaaccgtaaggtccgacccggttccgacccacgtccgaccgacccgacgaccccaacccgtaccg

SEQ ID NO: 41683 - DNA, 671 bp, Homo sapiens
  misc_feature: GYAE6OF01A8CDX.3.69.G03.1.454.CMB.1.raw
  modified_base (273)..(273): a, c, t, g, unknown or other
  misc_feature (273)..(273): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttatactatgtctcctggtatcaacngcacccaggccaaagccccccaaactcataaactttatgatgtctaagttaactccggtaccccttcgtacgggggttttactaaacttcgtaccttctccgttaggttaactaagttcgtcggtacaaccgtaccgggtccctccccgtcgtaccctactccgtacgtcgggccttaccggacggctaggacgggaacggtagggctagtaactttaacgttactagacgtagtcctacgtaataacgtaaccgaactacgacgccaaggtccacgggttcgggtaccgttccgggtaaacggtaccggggaaaccgtacgggccgtacccgttcccggtaccccgaccggttaccaacccggaccccgaacccgggtcccccaaacccccgtaccg

SEQ ID NO: 41684 - DNA, 598 bp, Homo sapiens
  misc_feature: GYAE6OF01A65RH.3.69.G03.1.454.CMB.1.raw
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (311)..(311): a, c, t, g, unknown or other
  misc_feature (311)..(311): n is a, c, g, or t
  modified_base (486)..(486): a, c, t, g, unknown or other
  misc_feature (486)..(486): n is a, c, g, or t
tcagagacgcactccacgaccggtgctcgatttagtcgctgcgtaaaggagaaaggggggggtctcaggaggcagcgctctcgggacgtcctccgaccatggcctgggctctgctattcctcaccctcctcactcagggcacgagggtcctgggcccagtctgccctgactcagcctgcctccgtgtctgggtctccgtggacagtcgatcatcgcatctctgcactgaaccngcagtgtacgtttggngttatactatgtctctggtatcaacngccaccgaggacaaacgccccaaactcaatatttangtatgtacagtatcgcctcgtacgggtttcaagtcgtacttctcgttcgttacagtcgtcgcaaccgcgccctccgtcgacctacttcctacgtcggtctaccgaggtctggaacggaccgagtcttacgtaattacttacgcgtacagtctactaattaacacgagtcgagacncgtacctaggtcggttacgttacggaacggttacggaaccgtacggtccgtacccggttccgtacccctacggttccaacgtaccccgaaccgtcccgaacccgtaacccgg

SEQ ID NO: 41685 - DNA, 820 bp, Homo sapiens
  misc_feature: GYAE6OF01EKROS.3.69.G03.1.454.CMB.1.raw
  modified_base (225)..(225): a, c, t, g, unknown or other
  misc_feature (225)..(225): n is a, c, g, or t
tcagagacgcactccacgaccggtgctcgattttagtcgctgcgtaaaaggagaaaggggggggtctcaggaggcagcgctctcgggacgtctccaccatggcctgggctctgctattccctcaccctcctcactcagggcacgagggtcctgggcccagtctcgccctgactcagcctgcctcgtgtcgtggtctcgtggacagtcgatcatcgctatcctccngcacgtaggaaccagcaggtcgtacggtttggtaggtttaacttaactagtcgttccttccgtagtactacgaacacgaccaacccgaaggaaccaaacccgaccccctaaactactaaacttaagtttatagtaagtcgtaacgtacgttaaccgtcccggtacccgttacggtttaacggggttttacctaacgttcccgttacgtttccgttacggttaacgttaacgttacgttaccgtacggacccgtaaacccgtccggtaccccgttcccgtacgacccttacgttcctccgggttacggacccgttccggaacggtacggtaggggaaccgtagggtaccggtacgttaacggttagtttaacgttacgtacgtccgtacgtaccttaacgtaacgttaaacaacggtaacgacgtacgaaccggtcggtaaccgttacggggttaccggtttaccggtaaaccgggtaccggttaaaccggggtaaccgttaacccgggtaccccgttacccggtaccccgtacccgtaacccggaacccgaccccggaaaccccggaaccccgtaccccggaaacccttcccggg

SEQ ID NO: 41686 - DNA, 635 bp, Homo sapiens
  misc_feature: GYAE6OF01CITT5.3.69.G03.1.454.CMB.1.raw
  modified_base (339)..(339): a, c, t, g, unknown or other
  misc_feature (339)..(339): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
  modified_base (500)..(500): a, c, t, g, unknown or other
  misc_feature (500)..(500): n is a, c, g, or t
  modified_base (597)..(597): a, c, t, g, unknown or other
  misc_feature (597)..(597): n is a, c, g, or t
  modified_base (621)..(621): a, c, t, g, unknown or other
  misc_feature (621)..(621): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacgagggtcctgggccctagtctcgccctgactcagcctgccttccgtgttctcggtctccgtggactgtcatcatccgcctatcctcctgacacgtcgaacagcgtagtgacgttggtacgttataactgtcgtcttcgtaggtatacaacgtacgccaaccgaggacccaaaccgacccctaatactaattaactttangtagtagtacgtaacgttacgtccggtccctaggtacgggtttacacgttcgtcttacgttacgttacgtacgtagtctacgaccacgtcccgtcctccgtcgtaactgttccgtacgcgtccacgngtcgtaggacgacggngtctaggttactttacgntcgactagactacgtataacgaagacgcagtcacggactcgggtggttaccgtaggaacgtacggtaaccgtacgtacccgtcgtaccgtaacccgngttacccgaaccgacccgaaaccncccccgtacgtacg

SEQ ID NO: 41687 - DNA, 721 bp, Homo sapiens
  misc_feature: GYAE6OF01BLUE8.3.69.G03.1.454.CMB.1.raw
  modified_base (141)..(141): a, c, t, g, unknown or other
  misc_feature (141)..(141): n is a, c, g, or t
  modified_base (234)..(234): a, c, t, g, unknown or other
  misc_feature (234)..(234): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacngggtcctgggcccagtctgccctgactcagcctgcctccgtgtctgggtctccgtggacagtcgatcatcgccatctcctgcactcggaaccngtcagtgtacgttggtagttaataactatgttcttcctggtatacaacacgaccaccgacggacaaacgacccccgaaactctaattaaagtttactggtatgtacaagtaacgtccggtcccttacggtaggggtttacctaacgttcgtactttctcgttacggttaactaacggtcgttacggaactaaccggaccgtaccctcccgtacaccgtacttccgtacggttcgggacccttacccggaggtccgtagggacggaccgggtacgccgttaagtacgttttaacgtactcggacgtacgtccttacgacttaacgtaccgaagtaccgtaacgtaccaggtcccggtaaggttcgggggttaaacgttaccggggaacgtaaccggggaacccgttagggtaccccgtacccggttccggtaccccctacgggtaccgaacccgtaacccggaacccgtacccccgaaccgtaccccg

SEQ ID NO: 41688 - DNA, 767 bp, Homo sapiens
  misc_feature: GYAE6OF01AYNG9.3.69.G03.1.454.CMB.1.raw
  modified_base (232)..(232): a, c, t, g, unknown or other
  misc_feature (232)..(232): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctccaccctcctcactcagggcacagggtcctgggcccagtctgccctgactcagcctgcctccgtgtctgggtctcctggacagtcgatcatcgccatctctgcactggaaccngcagtgacgttggtgtatactatgtctcgtgtatacaacagccacccgagaccaaaccgacccccaaactcaacttaaactttatagtactgtacaagtaaccgtccggcccttacgttacggggtttacttaacgttacgtccttcgtcgttacggttaacgtaagttcgtcggactaaccgaccggtccctcccgtacgtaccctactcttaccgtcgggtcctaccgaggtccttagggaacggacggtacggaccttaggtaactttaagttaccgtagtacccgtaggtaccttaactactttaaataaaccgtaaacgtacctaacggtaccgaacggtacccggtacggggttaccgggggttacccgtttaaacggggggaaaccgttaacccggggggtaaaaccggttacgggttaaccccggtaccccgggttacccgtacccccggtaaacgggttcccgaaccccggggttaaacccccgaaaccccggggaaacccccctaaaccccggttaacccccggg

SEQ ID NO: 41689 - DNA, 783 bp, Homo sapiens
  misc_feature: GYAE6OF01AIR6I.3.69.G03.1.454.CMB.1.raw
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactcggaaccngctaggtgtacggtttggtaggttactaactatcgtctccgttggtatacaacncgaccacccgaggaccaaaaccgacccccctaaactacctaattaatttatgtattcgtactaagtaacgtccggcccttacggttacggggtttacctaagtccgtctttacgtcgttacggttaactaacggttcgtacggaccgtaaaccgtcccggtaccccgttccctaccgtaccttacgttcccgttccggttcgggtccctacccggtagggtaccgtacgggaacgggtacccgggtaaggtaccttaggttaacgtttaccgttaccgtacggtaccgtactccgtaacgttaactaacttaacgaaccgtacgaacgtactaacggtaccggttaaccgggttacggggttacccgttaacgggtacccgggtaacggggtaaccccggtaacgggtacccggttaccccggttcccgtaaccccgacggttaccccgaccgggaacccccggaacccggtaacccccgaccccgttaacccgg

SEQ ID NO: 41690 - DNA, 828 bp, Homo sapiens
  misc_feature: GYAE6OF01CYO7T.3.69.G03.1.454.CMB.1.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (272)..(272): a, c, t, g, unknown or other
  misc_feature (272)..(272): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
tcagagacgcactccacgaccggtgctcgatttagtcgctgcgtaaaggagaaaggggggggtctcaggaggcagcgctctcgggacgtctccaccatggcctggctctgctattcctcaccctcctcactcaggcacgagggtcctggcccagtctgccctagacctcacgcctcgccctccggtgtccgtgggtcctccgtggacngttcgatcgactcgccatctcctgccacgtgaaccngcgagtgtacgttggtagtaataacttntcgttctcgtagtactacaactacgccaaccgaggaccaacccgacccctaatatacttaaagttntnacgttcacgtaagtaaccgtccggtacccgttagggtacggttttactaacgttccgtaccgtttcgttacgttacggttaacgtaacggtttccgaccggtaaaccaacccggtacccgttaccccgttacccctacggtaaccttacttccggtccggtacgggtccttaccggacggttacgtacgggaacggtaccggtaaggtcgttacgttaacgtttaacgtttacgaccgtttacgaccttaccgtaacgtttaaaccaaccggtttaacgaaacggtaccccgtaggacccgttaaccggaccggttacgggttaccgggggttaacccctaggggttaaaacccgggacccgggggttaaacccggtaccggtttaaccccgggtacccgtttaccccgggaaccccgttaaccgggtcccccgaaacccggtaccccgtaaaaccccggtaaaccccgtttacccccggaacccggg

SEQ ID NO: 41691 - DNA, 775 bp, Homo sapiens
  misc_feature: GYAE6OF01DY2RW.3.69.G03.1.454.CMB.1.raw
  modified_base (261)..(261): a, c, t, g, unknown or other
  misc_feature (261)..(261): n is a, c, g, or t
tcagagacgcactccacgaccggtgctcgatttagtcgctgcgtaaaggagaaaggggggggtctcaggaggcagcgctctcgggacgtctccaccatggcctggctctgctattcctcaccctcctcactcagggcacagggtcctgggcccagtctgccctgactcagcctgcctcgtgtctggtctccgtggacagtcgatcatcgctatcgtcctgcacgtacggaaccagcagtgacgttggtagtaataactatntctctgtactacaacagccaccgaggaccaaaccgacccccaaactactaacttaaattttacgtagtaagttacgtactaacgttaacgtacccggtccttacgggtaacgggttttacctaaacgttccggttacctttaccgttacggttaacggttaaccgtaaaggttccgttacggaaccctaaacccggtacccggttacccccttaccccgttaacggtaaccctaacgtttacccgttaccgggttccgggtacccttacccggaacggggttacccgtaagggtaacgggaccgggtacggtcgttaagttatttaacgtttacgcgactaacggtcctaataacttaacgaactaacgcacggtacaacggtacgtaccgggttcggttaaccgtaccggtaacgggttaccggtaaacccggttaccgtacccggttacccggttacccgtacctaccgtaccgaccgtaccccgaaacccgttaccccaacccgttacccg

SEQ ID NO: 41692 - DNA, 709 bp, Homo sapiens
  misc_feature: GYAE6OF01BLWXD.3.69.G03.1.454.CMB.1.raw
tcagagacgcactccacgaccggtgctcgatttagtcgctgcgtaaaggagaaaggggggggtctcgaggaggcagcgctctcgggacgtctccaccatggcctgggctctgctattcctcaccctcctcactcagggcacgagggtcctgggcccagtctcgccctgactcagcctgccctcgtgtctcgggtctccgtggacacggtcgatccgagttcgcctattcctccgtgcctaccgtaggaacctagccgtagtggtaacggttggtacgttaactacgtatcgtctcgtacgtacacacgacgaccgaccgacgaccaaccgacccctaactactaacttaattagtagtacgtacgtacgtacgtacgtccggtaccgtacgtacgggttactacgtcgtcttcgtacgttacgtacgtacgtcgtacgactaccgtaccgtcctccgtacgtactacgtccgtcggtcggtccgtaccgacggtacgtacggtacggtacgtacgtacgtaagtacgttacgtactacgacgtacgtactacgtaactaacgacgtaacgtacgacgtacgtaacgtacggtaccggtacgggttacgttacggaaccggtacgggtaacccgtacggtacccggtcccgtacccgtaccgtaccggtacccgtacccgaacccggacccgtaccccgtaaccgtacgg

SEQ ID NO: 41693 - DNA, 518 bp, Homo sapiens
  misc_feature: GYAE6OF02JEQ2Z.3.69.G03.1.454.CMB.1.raw
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagagacgcactccacgaccggtgctcgatttagtcgctgcgtaaaggagaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaaactcataatttatgatgtcagtaatcggccctcaggggtttctaatcgcttctctggttacaagtctggcaacacggcctcctgaccatctctgggctccaggctgagacgaggctgattattactgcagctnattanacaagcagcagcacgtggggtcttcggaacgtgggaaccaaggtcaccgttcgtcccacgtcacgcccaacggcccaaccctacg

SEQ ID NO: 41694 - DNA, 509 bp, Homo sapiens
  misc_feature: GYAE6OF02FR0G2.3.69.G03.1.454.CMB.1.raw
  modified_base (308)..(308): a, c, t, g, unknown or other
  misc_feature (308)..(308): n is a, c, g, or t
tcagagacgcactccacgaccggtgctcgatttagtcgctgcgtaaaggagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttangatgtcagtaatcggccctcagggtttctaatcgcttctctggttacaagtctggcaacacggcctcctgaccatctctgggctccaggctgaggacgaggctgattattactgcagctcatatacaagcagcagcacgtgggtcttcggaactgggaaccaggtcaccgtcgtcccacgtcacgcccaggcccacccacg

SEQ ID NO: 41695 - DNA, 517 bp, Homo sapiens
  misc_feature: GYAE6OF02IG38Q.3.69.G03.1.454.CMB.1.raw
  modified_base (371)..(371): a, c, t, g, unknown or other
  misc_feature (371)..(371): n is a, c, g, or t
tcagagacgcactccacgaccggtgctcgatttagtcgctgcgtaaaggagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaaacgcccccaaactcaataatttatgatgtcagtaatcggccctgaggggtttcaatcgcttctctggttacaagtctggacaacncggcctcctgaccatctctgggcctccaggctgaggacgaggctgatttatactgcagctcatatacaagcagcagcacgtgggtcttcggaactgggaacctaggtcaccgtcgcccacgtcacgcccaaggccccaaccctacg

SEQ ID NO: 41696 - DNA, 539 bp, Homo sapiens
  misc_feature: GYAE6OF02I8EI4.3.69.G03.1.454.CMB.1.raw
  modified_base (272)..(272): a, c, t, g, unknown or other
  misc_feature (272)..(272): n is a, c, g, or t
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (439)..(439): a, c, t, g, unknown or other
  misc_feature (439)..(439): n is a, c, g, or t
tcagagacgcactccacgaccggtgctcgatttagtcgctgcgtaaaggagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctctggtatcaacngcaccaggcaaacgccccaaactcataattatgatgtcagtaatcggcctcgagggttctaatcgtcttctctagttacagtctggacaacacgcctccngaccatctcgtggctccgagctgaggacgagctgtattattacngacngctnatatacgagcagacncacgtgggtcttacggacgttagggaaccgtaggtaccaccggttaccgtccctaaggtcccacggaccccgtaaacgggcccctaaaccccgtgtaccg

SEQ ID NO: 41697 - DNA, 547 bp, Homo sapiens
  misc_feature: GYAE6OF02IL36K.3.69.G03.1.454.CMB.1.raw
  modified_base (154)..(154): a, c, t, g, unknown or other
  misc_feature (154)..(154): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggccngcctggcctagactctcgctgcctccgtgtcgtcgggtctcgngacgngtcgatcgatcgcatctctgcactggaaccagcagtgacgttggtggttataactatgtctcctggtatcaacagcacccaggcaaacgcccccaaactcaataatttatgatgtcagtaatcggccctcgtaggggtttctaatcgtcttctctggttacagtctggcaacacggcctccctgacctatctctcgggcctcgaggctggaggacgaggctagtatttattactgtcacgctcaatatacgaacgcagcagcacgtgggttactcggaacgtcgggaaccaggtcctaccggtccgtacccgacgtccgaccgcccgaacggccccaaccctacg

SEQ ID NO: 41698 - DNA, 514 bp, Homo sapiens
  misc_feature: GYAE6OF02HO37M.3.69.G03.1.454.CMB.1.raw
  modified_base (426)..(426): a, c, t, g, unknown or other
  misc_feature (426)..(426): n is a, c, g, or t
tcagagacgcactccacgaccggtgctcgatttagtcgctgcgtaaaggagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataattatgatgtcagtaatcggccctcaggggtttctaatcgcttctctggttacaagtctggcaacacggcctccctgaccatctctgggctcaggctgagcgaggctgattattactgcagctnatatacaagcagcagcacgtggggtcttcggaacgtgggaaccaggtcaccgtcgtcccgacgtcacgcccaacggcccaaccctacg

SEQ ID NO: 41699 - DNA, 521 bp, Homo sapiens
  misc_feature: GYAE6OF02HHH1K.3.69.G03.1.454.CMB.1.raw
tcagagacgcactccacgaccggtgctcgatttagtcgctgcgtaaaggagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcgaggggtttctaatcgcttctctggttacaagtctggcaacacggcctccctgaccatctctgggctccaggctgaggacgaggctagtattattactgcagctcatatacaagcagcagcacgtgggtcttcggaactgggaaccaggtcaccgtcgtcccacgtccacgcccaacggcccaaccccgtacg

SEQ ID NO: 41700 - DNA, 533 bp, Homo sapiens
  misc_feature: GYAE6OF02I61EZ.3.69.G03.1.454.CMB.1.raw
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
  modified_base (419)..(419): a, c, t, g, unknown or other
  misc_feature (419)..(419): n is a, c, g, or t
tcagagacgcactccacgaccggtgctcgatttagtcgctgcgtaaaggagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggnggttataactatgtctcctggtatcaacagcacccaggcaaacgcccccaaactcaataatttangatgtcagtaatcggccctcgtaggggttctaatcgcttctcttggttacaagtctggcaacacggcctccctgaccatctctgggcctccgaggctgaggacgacggntgtattattactgcagctcatatacagcagcagctacgtgggtctacggactacgggaccaaggtccaccggttccgtacccgacgtccgacgcccgaacgaccccaccctacg

SEQ ID NO: 41701 - DNA, 525 bp, Homo sapiens
  misc_feature: GYAE6OF02H5FTB.3.69.G03.1.454.CMB.1.raw
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttaatactatgtctcctggtatcaacagcacccaggcaaagccccccaaatcaattaattatgatgtactagtaatcggccctcgaggggtttctaatcgcttctctgtacagtctgcacacgcctccngaccntctctggctcgaggctgaggacgngctagtatttatacngcagctnatatacaagcagcagcacgtgggtactacggacgtacgggaccaaggtccaccgttccgacccgacgtaccacgacccgaacgaccccaaccctaccg

SEQ ID NO: 41702 - DNA, 551 bp, Homo sapiens
  misc_feature: GYAE6OF02F2OBV.3.69.G03.1.454.CMB.1.raw
  modified_base (232)..(232): a, c, t, g, unknown or other
  misc_feature (232)..(232): n is a, c, g, or t
  modified_base (410)..(410): a, c, t, g, unknown or other
  misc_feature (410)..(410): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactatgtctctggtatcaacagcaccaggcaaacgcccccaaactcataatttatgatgtcagtaatccggtcctcgtaggggtttctaagtcgtcttctcttaggttacaagtctaggacaacaccggcctccctgaccatctcgtggctcgagcngaggacgaggctagtattattactgcagctcaatactacaacgcagcaagcgaacgtggggttaccttacgggactcggggaacctaacggtccaaccgtccgtacccacggtccacggcccaacggccccaacccgtacg

SEQ ID NO: 41703 - DNA, 534 bp, Homo sapiens
  misc_feature: GYAE6OF02IWVUH.3.69.G03.1.454.CMB.1.raw
  modified_base (327)..(327): a, c, t, g, unknown or other
  misc_feature (327)..(327): n is a, c, g, or t
tcagagacgcactccacgaccggtgctcgatttagtcgctgcgtaaaggagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcaccaggcaaagcccccaaactcataatttatgatgtcagtaatcggccctnaggggttttctaactcgcttctctggttacaagtctggcaacacgcctcctgaccatctctgggctccaggctgacggacgaggctgtattattactgcagctcatatacaagcagcagcacgtgggtacttcggaacgtcgggaacctaaggttccacccggtccgttacccgacggtcacgccccaacggtccccaacccctacg

SEQ ID NO: 41704 - DNA, 517 bp, Homo sapiens
  misc_feature: GYAE6OF02HAWSZ.3.69.G03.1.454.CMB.1.raw
  modified_base (410)..(410): a, c, t, g, unknown or other
  misc_feature (410)..(410): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcgccctcaggggtttctaatcgcttctctggttacaagtctggacaacacgcctcctgaccatctctgggctccgaggctgacggacgnggctgattattactgcagctacatatacagcagcagcacgtgggtcttcggactcgggaccaaggtccacgttccgtcccacgtcacgcccaaggcccaccctaccg

SEQ ID NO: 41705 - DNA, 520 bp, Homo sapiens
  misc_feature: GYAE6OF02F786D.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaatcataatttatgatgtcagtaatcggcctcgagggtttctaatcgcttctctggttacaagtctggcaacacggcctcctgaccatctcgtgggctccgaggctgaggacgaggctgattattactgcagctcatatacaagcagcagcacgtgggtcttcggaactgggaaccaggtcaccgtcgtcccgacgtccacggcccaacggcccaaccccgtacg

SEQ ID NO: 41706 - DNA, 638 bp, Homo sapiens
  misc_feature: GYAE6OF02IYD3C.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgccactggaaccagcagtgacgttggtgttaataactatgtctctggtatacaacagcaccaggaccaaacgacccccaaactcaattaatttatagatgtactagtaactcggccctagtacggggttactaagtccgtcttactcgttggttactaagttcgtagacaacgacgtccctcgtcgactatctcgtcggccttccgaggcctggaacggacggtagcgttagtaacgtttaacttacgtggtaccacggtacctactaacgttaactaaccgaacgacacgactacgacgtacgttggggttacccgttagggaaccggttcgggaaaccgtacggtaccgtacccgttacccggtaccctacggtaccgtaccgaccccggaaacgtacccccgtaacccctaccgg

SEQ ID NO: 41707 - DNA, 530 bp, Homo sapiens
  misc_feature: GYAE6OF02G4O4P.3.69.G03.1.454.CMB.1.raw
  modified_base (232)..(232): a, c, t, g, unknown or other
  misc_feature (232)..(232): n is a, c, g, or t
  modified_base (410)..(410): a, c, t, g, unknown or other
  misc_feature (410)..(410): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactatgtctcctggtatcaacagcacccaggcaaacgcccccaaatcataatttatgatgtcagtaatcggcctcgagggtttctaatcgtcttctcttggttacaagtctggcaacacgcctcctgaccatctctgggctccgaggctgaggacgnggctgattattactgcagctcatatacgaagcagcagcgtacgtgggttcctacggaactggggaaccaagggtccaccgtcgtcccgacgtcgacgccccgaacggcccaacccgtacg

SEQ ID NO: 41708 - DNA, 512 bp, Homo sapiens
  misc_feature: GYAE6OF02IBLYI.3.69.G03.1.454.CMB.1.raw
  modified_base (432)..(432): a, c, t, g, unknown or other
  misc_feature (432)..(432): n is a, c, g, or t
  modified_base (485)..(485): a, c, t, g, unknown or other
  misc_feature (485)..(485): n is a, c, g, or t
tcagagacgcactccacgaccggtgctcgatttagtcgctgcgtaaaggagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagccccccaaaactcataatttatgatgtcagtaatcggcctcagggtttctaatcgcttctctggttacaagttctggcaacacggcctccctgaccatctctgggctccaggctgaggacgaggctgatttattactgcagctnatatacaagcagcagcacgtgggtcttcggaactgggaaccaggtcaccgtcncccacgtcacgcccaaggcccaccacg

SEQ ID NO: 41709 - DNA, 609 bp, Homo sapiens
  misc_feature: GYAE6OF02HXJUR.3.69.G03.1.454.CMB.1.raw
  modified_base (231)..(231): a, c, t, g, unknown or other
  misc_feature (231)..(231): n is a, c, g, or t
  modified_base (455)..(455): a, c, t, g, unknown or other
  misc_feature (455)..(455): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctctgcactggaaccngcagtgacgttggtgttataactatgtctcctggtatcaacagcaccaggacaaacgcccccaaactcaattaatttatgatgtacagtaatcggtcctcgtagggtttctaatcgtcttctcttgttacagtctggacaacgacgcctcccgtgacctatctcgtcgggcctccgaggctaggacggacggaggtctgtaatttacttacgtgacagtcctanaactaataacgaacgcacgacacggacgtacgttggggtaccgttacgggaacgtacggggaacccgtaacgggttccgtaacccggttcccgtaccccgtaccggttaccgaacccggaccccgtaaccggacccccgtaacccgtaaccccg

SEQ ID NO: 41710 - DNA, 526 bp, Homo sapiens
  misc_feature: GYAE6OF02G3SY2.3.69.G03.1.454.CMB.1.raw
  modified_base (307)..(307): a, c, t, g, unknown or other
  misc_feature (307)..(307): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaagcccccaaatcataatttangatgtcagtaactcggccctgaggggtttctaagtcgtcttctcttggttaacagtctggacaacacgcctcctgaccatctctgggctcgaggctgaggacgaggctgattattactgcagctcatatacaagcaagcagcacgttggggtacttcggacgtgggaccgtaaggtcaccgttcgacccacggtcacgacccaaggcccaacccgtacg

SEQ ID NO: 41711 - DNA, 540 bp, Homo sapiens
  misc_feature: GYAE6OF02GZXYJ.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaacgcccccaaactcataatttatgatgtcagtaatcggccctcgaggggtttctaatcgcttctctggttacaagtctggcaacacggcctcctgaccatctctgggctccaggctgaggacgaggctgtattattactgcagactcatatacaagcagcagcacgtcggggtcttcggaacgtcgggaccaacggtccaacccggttccgtacccgacgttcgacggaccccgaacggccccaaccctaccgg

SEQ ID NO: 41712 - DNA, 538 bp, Homo sapiens
  misc_feature: GYAE6OF02FUMUA.3.69.G03.1.454.CMB.1.raw
  modified_base (273)..(273): a, c, t, g, unknown or other
  misc_feature (273)..(273): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctgtatcaacngcacccaggcaaacgcccccaaactcaattaatttatgatgtcagtaatcggcctgagggtttcaatcgcttctctgttacagtctggacaacacggcctcccgtgaccatctcgtggcctccgaggctggacggacgaggctggtaattacttcgtgcacgtctacatactacaggcagcagcacgtggggtcttacggacgtgggaaccaaggtccaccgttccgcccgtacgtccgacgaccccgacggacccaaccctccg

SEQ ID NO: 41713 - DNA, 553 bp, Homo sapiens
  misc_feature: GYAE6OF02HGH4R.3.69.G03.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctctcactcagggcacagggtcctgggcccagtctgccctgactcagcctgcctccgtgtctgggtcctcctggacngtcgatcatccgccatctcctgcactggaaccngcagtgacgttggtagttataactatgtctcctggtatcaacngcaccagcaaacgaccccaaactcataacttatagatgtcaagtaatcggtccctcgtagggttctaatcgtcttctntgttacaagtctcggcaacnccgcctccctgaccagtcctcgtcggcctcgacggtctaggaggacgaggctagtacttattactgactagcctanatanacagacgtagcagctaagtcgggttctacggtacgacggtacctaaggtccaccgtccgtaccctacgtctaccgacccgaacgaccccgtaccctacg

SEQ ID NO: 41714 - DNA, 555 bp, Homo sapiens
  misc_feature: GYAE6OF02HJPBL.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtagttataactatgtctcctggtatcaacagcaccaggacaaacgcccccaaactcaattaatttactgatgtacagtaactccggccctgtagggtttctaatcgtcttctctgttacagtctgcaacacgcctcctgacctatctcgtggcctccgaggtctggacggacgaggtctgtaatttattacgtgcgagctacatatacagtcagcagcacgtcgggttactacggaacgtcgggaaccaaggtccctaccggtccgtacccgacgtaccgaccgacccgaacggcccctaacccgtaccg

SEQ ID NO: 41715 - DNA, 568 bp, Homo sapiens
  misc_feature: GYAE6OF02IOXXW.3.69.G03.1.454.CMB.1.raw
  modified_base (419)..(419): a, c, t, g, unknown or other
  misc_feature (419)..(419): n is a, c, g, or t
  modified_base (455)..(455): a, c, t, g, unknown or other
  misc_feature (455)..(455): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttaataactatgtctcctggtatcaacagcaacccaggacaaaacgcccccaaaactcaataatttatgatgtcagtaatcggccctacgaggggtttcaatcgtcttctctggttacaagtctaggacaacaccggcctccctagacccatctcgtgggctaccgaggntaggaggacgaggctagtaattattactgcagctanataatacaagtcacgcaagctaagttcggggtacttacggaaacgttcgggaacctaaggtccaccgtccgtacccacggtaccacgacccgaacggaccccaaccccgtacg

SEQ ID NO: 41716 - DNA, 738 bp, Homo sapiens
  misc_feature: GYAE6OF02JIDHW.3.69.G03.1.454.CMB.1.raw
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttaataactatgtctcctggtatcaacancaccaggacaacgaccccaaactcaattaattangatgtacagtaactcggaccctaggtacgggtttactaactacgtcttctcgtacggtttaactaacgtcgtacggactaaccgaccggtcccgtcctacgacctatccgttacgtcgggtacctaccggtacggtacgtaggaacggggtaaccggtacgggtacgttacggttaacgtttaacgtttaacgtcggtaaccgtacggttacccttaaccgtaacgtttaaactaaccgtaaaacggtcgaacggtacctacggtaacccggttccgggttaacgggggtttacccgttaccgggtaaacggttaccgggggtaaacccgttaaacgggtcccgttaacccggttcccggttaaccccgacgggttaccgtaaccccggacccggtaaacccggtaccccgaaacccccgttaccgg

SEQ ID NO: 41717 - DNA, 539 bp, Homo sapiens
  misc_feature: GYAE6OF02FGXVH.3.69.G03.1.454.CMB.1.raw
  modified_base (328)..(328): a, c, t, g, unknown or other
  misc_feature (328)..(328): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaatcataattatgatgtcagtaatcggccctntaggggttctaatcgtcttctctaggttacaagtctggcaacgcggcctccctgaccatctcgngggctccgaggcngaggacgaggctgtattacgttacngcagtctacatatacaagcagcagcacgtcgggtcttacggaacgtcgggtaaccaaggtccacccgtcgtacccgacgtcgaccgcccgaacggaccccacccgtacg

SEQ ID NO: 41718 - DNA, 533 bp, Homo sapiens
  misc_feature: GYAE6OF02FJ2HB.3.69.G03.1.454.CMB.1.raw
  modified_base (232)..(232): a, c, t, g, unknown or other
  misc_feature (232)..(232): n is a, c, g, or t
  modified_base (375)..(375): a, c, t, g, unknown or other
  misc_feature (375)..(375): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtggttataactatgtctcctggtatcaacagcacccaggcaaacgcccccaaactcaataatttatgatgtcagtaatccggccctcgtaggggtttctaatcgcttctctggttacaagtctggcaacncggcctccctgaccatctctgggctccgaggctgacggacgaggctgtatttattactgcagctacatatacaagcagcagcacgtgggtcttacggacgtcgggaacacggtccacccgtcgtcccacgtcaccgacccgaacggcccaaccctacg

SEQ ID NO: 41719 - DNA, 635 bp, Homo sapiens
  misc_feature: GYAE6OF02GV4D9.3.69.G03.1.454.CMB.1.raw
  modified_base (239)..(239): a, c, t, g, unknown or other
  misc_feature (239)..(239): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcatccgaccatcctcctgccacgtcggaaaccngcagtgacggttggtagttataactatgtctcgtgtatcaacagaccaccgagaccaaaccgacccccaaactactaattaatttactagattgtactagtaactccggacctacggtagggtttactaacgtctcttctagttacgttactagtcacggtacaaccgacgtccctcctgtactctctcgtcggctccgtggcaggtacgagcggtatattaattacgttactgacgtacgtctactaataactaacgaacgtacacgtaacgacgtacgtacggtacggggttacctaccgggtaacggtacgggtaacccgaacggtcccgtaccggttacccggttaccaccggtaccaccggaacccgaacccggtacccgacccttaccgg

SEQ ID NO: 41720 - DNA, 765 bp, Homo sapiens
  misc_feature: GYAE6OF02J1ID3.3.69.G03.1.454.CMB.1.raw
tcagagacgcactccacgaccggtgctcgatttagtcgctgcgtaaaggagaaaggggggggtctcaggaggcagcgctctcgggacgtctccaccgtggcctgggctctgctattcctcaccctcctcactcagggcacagggtcctgggcccagtctgccctgactcagcctgcctccgtgtctgggtctcctggacagtcgatcatccgccatcctccgtgcactgggaaccagcagtgacgttggtgttataactatgtctcgtggtactcaacagcacccagggccaaaacgacccccaaatctataactttatacgatagttcaagtaacgtccggtcccctaggtacggggtttactaacgttcgtccttccgttacgttaggttaaccaacggttccgtaggaccgaaccgtacccgggtcccgttacccgtacgtaaccgtcgttccgtaccggtttcgggccctaccggtaccgggtacgttacgggacgggttaaacccgggtgggtaccgtttacgtacgttttaaccgttaccggtacgtaccgtacgtacgtacccttaagttaccgttaaaccgacggtaccgaaacgtcgtaaaccgtccggtaaccgggttacggggtttaaccgttaccggggaacggtttaaccgggtaaccggtaacggtaccccgtaaccggtacccggtacccgtaacgtcggtaaacccggtaccccggtaacggaaccccccgtaccgtaccggttacccg

SEQ ID NO: 41721 - DNA, 866 bp, Homo sapiens
  misc_feature: GYAE6OF02JNZD5.3.69.G03.1.454.CMB.1.raw
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
tcagagacgcactccacgaccggtgctcgatttagtcgctgcgtaaaggagaaagggggggtacgtcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttaactactntgtctctggtatcaacagtcacccgaggtacaaaccggaccccccaaaactccaaacttaaacttttaactacggtaattcggttacgtaagttaaacgttccggtacccccttacggtaacggggggtttttaccttaaacgttccgttaccgtttaccgtttacgttcgggtttaaccgtaaaggttccgtttacgggaccgtaaaaccgtaccgggtaccccttccccgttacggtaaccctaacgtttccgttaccggttcggggtacccttaccccggaacgggttccgttacgggaacggggtaacggggtaccgggtaccgtttaggttaacgttttaaacttttaccggtacggtaccgtacgtacccgttcgtaaacgtttaaccttaacgtaaaccgggtcctaaacggcgtaaccggacgttaaccgggtttacgggggttaccgtttacccggggtaaacggttaccgggggtaaaccccgttaaggggtttaacccgaccccgggttacccgggtttaaccccgtaccgggttaacccggacccggtaaccccggtaaaccccgggtacccccgtaaaccccccggtttaccgg

SEQ ID NO: 41722 - DNA, 661 bp, Homo sapiens
  misc_feature: GYAE6OF02HVZ4H.3.69.G03.1.454.CMB.1.raw
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctctgcactggaaccagcagtgacgttggtgttatactatgtctctgtactcacagcaccaggaccaaacgaccccaaactctaattaatttatgtatagtacaagtaactcggaccctcgtacgggtttactaagtcgtcttctcgttcggttacacgtcgtaggactaacgaccgcctacctgacctatcctcgtcggactcgacggtgtacgggacgacgacggtcgtagtaacgtttatacgtcgacgtagtacctactaattaagtaaccaagtcctaagacgtaacgtacgaaccgggtttcgggggtaccttaccggggtaaccggtacgggggtaaccgtaaaccgggttcccgtaacccgggtttacccggtcccgtaaccgggtacccgaaccgggttaaccccggaaccggtaccccgtaaccccgttaccgg

SEQ ID NO: 41723 - DNA, 649 bp, Homo sapiens
  misc_feature: GYAE6OF02GL09B.3.69.G03.1.454.CMB.1.raw
  modified_base (233)..(233): a, c, t, g, unknown or other
  misc_feature (233)..(233): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgccatctctgcactggaaccngcagtgacgttggtgttaataactatgtctctggtactcaacacgcaccaggacaaacgaccccaaactacaattaatttacgagtatgtacagtaactccggaccttaggtacgggtttactaacgtcgtcttctcgttaggttaactagtctaggactaacgccgtcctcctacgacctatctcgtcggtcctcgacggtcgtacggacgggacggacggtcgtagtaacttattacgtcgcgtacgtctactataactaacgtaacgacgacgacgacgacgtaacgggttcgggttaaaaaccgttcgggtaaccggtacggggtaaccggtaacggtacccgtacccggttacccggtacccgtaccgtaccgtaccggtacccggaaccggtaccccgaacccgtacccg

SEQ ID NO: 41724 - DNA, 664 bp, Homo sapiens
  misc_feature: GYAE6OF02GTYWS.3.69.G03.1.454.CMB.1.raw
  modified_base (232)..(232): a, c, t, g, unknown or other
  misc_feature (232)..(232): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtagttataactatgtctcctggtatcaacagacacccaggacaaacgcccccaaactcaataatttatgtaatgtcaagtaatccgccctgagggtttcaagtcgtcttctnttggttacagtcgtgcaacncggccctccgtnacctatccgtcgtcgggtcctaccgaggtctggacggacgacggtactgttaattacgtttacgtgacgtaggtccttacgtaattaacgttaaccgaaagtccgtacgaccgtaacggaccgtaacgggttcggggggttacctttaccggggaaccgttaccggggaaaccgtaacgggttcccgtaacccggtttcccggtaacccccggtaccggttccgtaaacccgggaccccgtaaacccggggtacccccaacccccgttaacccgg

SEQ ID NO: 41725 - DNA, 750 bp, Homo sapiens
  misc_feature: GYAE6OF02JH7HS.3.69.G03.1.454.CMB.1.raw
  modified_base (277)..(277): a, c, t, g, unknown or other
  misc_feature (277)..(277): n is a, c, g, or t
tcagagacgcactccacgaccggtgctcgatttagtcgctgcgtaaaggagaaaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacggttggtggttaataactatgtctcctggtatcaanagcacccaggcaaacgccccaaactcataattatgatcgtacagtaatccggaccctgtacgggtttactaagtcgtacttccttcgttcggttaactaagttcgttggaccaaaccgaaccggtccctacccgtcggaaccctagttccgtaccgttcggggtaccttcccgaaggtcctgggtaacgggaccgtacgggtccttaggtaacttttacgttaaccgttagtctaaggtcccttacgtaattaaactaacgtaaacggaccgtaacgaccgaacggtacccttaaacggggtttaccggggggtttacccgttttaccgggggaaccggtttaccgggggaaacccggtaaacgggttcccgttaacccccggggttacccggttaccccgtaaacccggtttaccccggaaacccggacccccggtaaaacccgggtacccccaaaacccccccgttaccgg

SEQ ID NO: 41726 - DNA, 631 bp, Homo sapiens
  misc_feature: GYAE6OF02I4BUU.3.69.G03.1.454.CMB.1.raw
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccaggtctgccctgactcagcctgcctccgtgtctgggtctctggacagtcatcatcgccatctcctgcactggaaccagcagtgacgttggtgttataactatgtctcctggtatcaacagcaccgaggaccaaacgaccccccaaactactaattaatttactagtaagtgtacagtaacttccggtaccctacgtacggggttttactaaagttccgtcttcgttcgttaggttaactaagtccgttaggacctaacgtaccgtacccttccctacgtaccacttactcgtcggctccgaggctaggagggaccgaggcgtagtatttacttacgtcgcacgtctataatactaacaacgagtacgcctagactacggtgggtaccgttacggaaccggtacgggaacgtaacggtaccgtaccgtaccgtcccgtacgtcgtaccgacccgaaccggtacccaacccgtaccgg

SEQ ID NO: 41727 - DNA, 752 bp, Homo sapiens
  misc_feature: GYAE6OF02I85ZV.3.69.G03.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
tcagagacgcactccacgaccggtgctcgatttagtcgctgcgtaaaggagaaaggggggggtctcaggaggcagtcgctctcgggacgtctccaccatggcctgggctctgactattcctcaccctccgtcactcagggcacgagggtcctggcccagtctcgccctgactcagcctgcctccgtgtcgtggtctccgtggacngtcgatcatcgcntctcctgcacgcgaccacgcagtgacgttggtacgttactactactcgtctcctggtactacaacacgccaaccgaggaccaaaaccgtacccccaaaccgtcgtaagttaattacgtcgagttcgtacgtaacgttaacgtccggtaccctacggtacgggttttactaacgttccgtacgttcgtacgttacggttaacgaacgttcggtacggtacgtaaccgaccggtccctacccgtcggtaacctcgttaccttcgggtccggaccgtaccgtaggtccggttacggaacgggtccggtaacggtcgttacgtaacgttttacttacggtacgtccggtacgtctaacgttaactacgttaaccaaggaccgttacgacgtaaccggccgtaaggggttaccggtttacccgtaagggtacccgtaacggggtaacccggtaaaccggttcccgaacccggttacccgttaacccgaacgggttacccaccccggtaacccgtaaccgggtaccccctacccgtaccg

SEQ ID NO: 41728 - DNA, 663 bp, Homo sapiens
  misc_feature: GYAE6OF02H6VTI.3.69.G03.1.454.CMB.1.raw
  modified_base (207)..(207): a, c, t, g, unknown or other
  misc_feature (207)..(207): n is a, c, g, or t
  modified_base (469)..(469): a, c, t, g, unknown or other
  misc_feature (469)..(469): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (573)..(573): a, c, t, g, unknown or other
  misc_feature (573)..(573): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacgacgggtcctcgggcccagtctcgccctgactcagcctgcctccgtgtccgtggtctccgtggacngtcgatcactccgcctactcctcctgccacgtacggaaccagcgtagtcggtacgtttgggtagtttactaactattcgttcctccgtaggtactacaaccgacgaccgaccgaacggacccaaaaccgacccccccgaaaacttactaaacttttaaatttatagtacgtgtactaacgttaacgtcccggtccctacggttacgggtttactaacgtcgttcttacgttcgttaggtaacgtagttcgtcgtacgaaccnccgtaccgtcctacgtacctctcgtacgttcggcctacgacggtacgtggacgacggagtacgtagttacttattacgcgtnactnactataacatagcacgcncgtacgtacgtcgggtctacgacggttacggacgtacgtccgtaccgtccgtaccgactacgaccggacccgaccgacccctaccgtccg

SEQ ID NO: 41729 - DNA, 668 bp, Homo sapiens
  misc_feature: GYAE6OF02HKBZ9.3.69.G03.1.454.CMB.1.raw
  modified_base (317)..(317): a, c, t, g, unknown or other
  misc_feature (317)..(317): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcactggaaccagcagtgtacgttggtggttaataactatgtctctggtatcaacagccaccgaggacaaacgcccccaaactcaattaatttangatgtacagtaatccggtcctcgtacggggtttactaagtcgtcttctcgttacggttactaagtcgtggacctaacgaccggtccctaccctacgtaccctattccgttcgtcgggtacctaccgaggtcctagggaacgggacgacggtcttaggtatttaacgttacgtcgacgtacgtaccttataacttaactaacgaacgccaacgaccgaagtaccgtaccgggttcggggttacgttaccgggtaacgtaccgggtaaccgtaacggtacccgtacccggttaccccgtacccgtaccggtaccgaccggtaccccgaacggtaccccccaaccccgtaccgg

SEQ ID NO: 41730 - DNA, 810 bp, Homo sapiens
  misc_feature: GYAE6OF02JPOEE.3.69.G03.1.454.CMB.1.raw
tcagagacgcactccacgaccggtgctcgatttagtcgctgcgtaaaggagaaaggggggggtctcaggaggcagcgctctcgggacgtctccaccatggcctgggctctgctattcctcacccctcctcactcagggcacagggtcctgggcccagtctgccctgactcagcctgcctccgtgtctgggtctccgtggacagtcgatcatccgcctatcctcctgctactacggaaccagctaggtgtacggttgggtagttaactaacttatgtcctcctggtatacaacgtagccacccgaggaccaaaaccgacccccaaactcctaattaaatttatgatgtacgtaagtaacgcggcccgttcgtaacggggtttactaacgtcgtccttacttcgttacggttaactaacggttacgtacggtaccgaaaccgtccggtacccgttcccgtacgtacccgtacgttacccttccgggtacgggtccttacccggtagggtaccgtacgggtaaacggggacgggaaggttaccgttagttaacttttaaaccgttacgtaaccgtctacggtaccttaactaagttaaactaaacccggtaagtaccgaacgtacctaacggtacccgttaccgggttacggggtttacccggtaccggtaaaccgggttaaccggggtaaacccggtaaacggtttacccggtaacccccgggttacccgtaaccccccggtttaacggtccccggtaaaacccggtacccccgggtaaaccccggacccccgtaaacccccgggttaaccg

SEQ ID NO: 41731 - DNA, 776 bp, Homo sapiens
  misc_feature: GYAE6OF02HKRIZ.3.69.G03.1.454.CMB.1.raw
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatccgccatcctcctgccacgtcggaaccagcagttgtacggttggtggttaattaactatgtcctccgttggtactacaactgaccaacccgaggaccaaaacgacccccctaaactctaattaaactttactaggtatacgttacgtaaaggttaacgtccggtccccgttaacggttaggggtttacctaacgttcgttcctttcgttacgtttaggttaacctaagttcgtacggaacctaaccgtaccggtaccctcccgtacgaccctattaccgtcggtccggccttacccggaggtccgtagggtaacggaccggacggttactaggttaacttttacgttaacgtcgacgtacgtcctaagttaaactacgttaaacgaagtaccgtacgacgtaaccgacgtacgggttacggggtacgttaccgggaaacggtttaccggggaaacccgttaccggggttaacccctacccgggttacccggtaaccccgtaaccggttacccggaaacccgtaacccccggggaaacccggtaaccccccgaacccgttaacccgg

SEQ ID NO: 41732 - DNA, 563 bp, Homo sapiens
  misc_feature: GYAE6OF02FZ1H3.3.69.G03.1.454.CMB.1.raw
  modified_base (402)..(402): a, c, t, g, unknown or other
  misc_feature (402)..(402): n is a, c, g, or t
  modified_base (452)..(452): a, c, t, g, unknown or other
  misc_feature (452)..(452): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcaataatttatgatgtcagtaatcggccctcaggggtttctaatcgtcttctctggttacaagttctaggcaacacggcctcctgacccatctctggctacgngctgacggacgaggctgtaattattactgctagctacatactacgaacgnacgcacgacgtacgtggggttactacggtaacgtggggaaccctaagggtcctaaccggttccgtacccgtacgtaccacggtaccccgaacggaccccaaccccgtaccg

SEQ ID NO: 41733 - DNA, 643 bp, Homo sapiens
  misc_feature: GYAE6OF02HPCVG.3.69.G03.1.454.CMB.1.raw
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
  modified_base (529)..(529): a, c, t, g, unknown or other
  misc_feature (529)..(529): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacgagggtcctgggcccagtctgccctgactcagcctgccctccgtgtcctgggtcctccgtggacagtcgatcatccgccatctctgaccacgtggaaccagcagtgacgttggtgttaataactatgtctcgtgtatcaacngcaccgaggacaaacgaccccaatacattaattangtatgtactataactcgcctagtagggtttactacgtcgtcttacgtcgtacgttacagttcgacgtacaactaccgccttacccgtacgtacctactccgtcgtccgggtcttacccgacggtcgttacgggaacggaacggtacggtacgttacgttaacgtttacgtttacgcgttaacgacggtcctagtaacgttaactacgaacgngtaaccgagtacgattacggtcgggttacctacgggtacgttacgggaaccacggttccaccggttcccgtaaccctcgaccgaccgtaccgaacccggaccctaacccgtacg

SEQ ID NO: 41734 - DNA, 645 bp, Homo sapiens
  misc_feature: GYAE6OF02I66ZA.3.69.G03.1.454.CMB.1.raw
  modified_base (311)..(311): a, c, t, g, unknown or other
  misc_feature (311)..(311): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctgtatcaacagcaccaggacaaacgcccccaaactcaattaatttangatgtacaagtaactccggcctgtagggtttctaatcgtcttctctgttacagtctggacaacgcgtccctcctcgacctatctcgtcggcctccgaggctaggacgggacggacggtcttaggtaatttacttacgtgactacgtaccttacgtaacttaactaacgtaacgcaacggtacaacggtaccgtaacgggtttcgggggttaccgtttaccgggaacggttccggggaaacccgttacgggttacccgtaccccggttaccccggttacccgtaacggttcccgaaccggacccccgtaaccggacccccgaacccccttaccgg

SEQ ID NO: 41735 - DNA, 689 bp, Homo sapiens
  misc_feature: GYAE6OF02J1WQ0.3.69.G03.1.454.CMB.1.raw
  modified_base (233)..(233): a, c, t, g, unknown or other
  misc_feature (233)..(233): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactcggaaccngcagtgacgttggtgttataactatgtctccgtgtatcaacacgacaccgaggacaaacgacccccaaactctaattaattatgatgtactaagtaacgtccgccgtcgtacgggttactaacgtctcttctcgtgttactagtcgtgtacacgacgtcctccgtcgacctactcctcgtcggtcctaccggacggtcgtacggacggaacgggtacggtcgtagttaacgtttaagttaccgttacggccgacgtacccgttacgtaacttaacctaacgtaacgtaccgtacgacgtaacggaccgtacgggttacggggttccgttaccggggaacggttaccggggtaaacccgttaccggtacccggtaacccggtttccccgtaaccccgtacggtacccgaacccggttaccccggaacccgggtaccccctaaccccggttaacccgg

SEQ ID NO: 41736 - DNA, 718 bp, Homo sapiens
  misc_feature: GYAE6OF02HMTDM.3.69.G03.1.454.CMB.1.raw
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgccctccgtgtcgtggtctccgtggacagtcgatcatccgccatctctgcacgtcggaaccngcagtgacgttggtagttaatatatgtctcgtggtatcaacngacaccgagaccaaacgccccaaactctaattaattactagtatcgtactaacgttaacgttccggacccgttccggttaaggggtttacctaacgttccgttacctttccgttaccgtttaggttaaccgtaacggttccgtacgggtacctaaacccggtaccggttaccccgttacccgtacgtaacccgtaacttaccgttccggttacgggtccccttaccggacgggttaccgttagggaacgggtacggtaggtacgttaacgttaacgtttacgtttaccgagtactacggtctaagtaacttaacgtaacacgacgtacgacacggtactacgggttcggttaccgtaccgggtacggacgggtaacctacggttaccacccggtccgtacccgcggtaccaccgaacccgtaacgccccgaaccgtaccg

SEQ ID NO: 41737 - DNA, 676 bp, Homo sapiens
  misc_feature: GYAE6OF02G59U0.3.69.G03.1.454.CMB.1.raw
  modified_base (285)..(285): a, c, t, g, unknown or other
  misc_feature (285)..(285): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcctatctcctgcactcggaaccagctaggtgacggttggtagttaataactatgtcctccgtggtactcaacncgaccaccgaggaaccaaacgacccccaaactctaattaaatttatgatgtacaagtaacgtcggtacctacggtagggtttactaagtcctcttcgtcgttacggttaacacgttcgtcggaaccaaccgtaccggtcccttcccgtacgtacctactccgtccgtacggtccctaccgaggtcgtagggacgggacggtacggtctagttaatttacgtacttcgacacgttccataacgtaactaacgaacgcgtacgacgtcgacgttaccggtagggttccggtacgggtaacggtacggggtaaacgttaaccggtacccgtacccgttaccgttaccgaccgtaccggaaaccgacccgaaccggtacccctaacccgttaccg

SEQ ID NO: 41738 - DNA, 672 bp, Homo sapiens
  misc_feature: GYAE6OF02IHK0Q.3.69.G03.1.454.CMB.1.raw
tcagagacgcactccacgaccggtgctcgatttagtcgctgcgtaaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatccgccatctcctgcactggaaccagcagtgacgttggtaggttaataactatgtctctggtatcaacagcaccaggacaaacgcccccaaactctaattaatttatgatgtactaagtaactccggtccctacggtagggttttacaatcgtcttcttctaggttacaagtcgtggacaacgaccgtccctccctcgacctacttcctcgtcgggcctaccgacggtctagggacggacggaggtaccgtagttaactttaacgttacgtcgtactacggccttactaaattaacgtaacgaaggtaccgaacgtacgaacgtaccggtaaccgggttcggggttaccgttaccgggtaacggtaccgggtaaccgtaaccgggtacccgtaacccggttacccgttacccgtaccgtaccgaacccggaccccggaacccggtacccccaacccgtaccg

SEQ ID NO: 41739 - DNA, 588 bp, Homo sapiens
  misc_feature: GYAE6OF02FTOEN.3.69.G03.1.454.CMB.1.raw
  modified_base (233)..(233): a, c, t, g, unknown or other
  misc_feature (233)..(233): n is a, c, g, or t
  modified_base (473)..(473): a, c, t, g, unknown or other
  misc_feature (473)..(473): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacggttggtgttatactatgtctcctggtatcaacagcaccaggcaaacgcccccaaactcaataactttatgatgtcagtatcggcctcgtaggggtttactatcgtcttctcgttcggttaacaagttcgtaggactaaacgaccggcccttcccgtgaccctacttctacgtcgggcctcccggaggtctaggacgggacgaggctaggtaactttattactgcacgctanatataacagcagcagactcgtggggtaccttacggaacgtcgggtaaccgaaggtccgtaccgttccgtaccgtacggtcctaccggaccccgaacggtaccccaacccgtaccg

SEQ ID NO: 41740 - DNA, 728 bp, Homo sapiens
  misc_feature: GYAE6OF02GTDZG.3.69.G03.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacngtcgatcatcgccatctcctgcactggaaccngcagtgacgttggtaggttatactatcgtctcctgtatacaacagcacccaggacaaacgacccccaaactcaattaattagtgatgtacagtaatccggtacctagtacggggttactaagtccgtcttactcgttacggttaactaacgttcgtaggacctaacgacccggttacccgtaccccgtacaaccgtacttccttccgtcgggtccctccgaacgggtaccgtagggaacggggaccggtacggtacgttacgtaaacgttttacgttaacgtcgacgtaccctacgttacgtaaacttaacgtaaaccgtaacgacgtaacggacctacggacccggtaacggggtttaccgggggttacctttacggggaaccggttaccggggaaacccggttaaccgggtacccgttacccgggttacccgtaccccggtaacgttcccggaacccgtaccccggaaccgggtacccccaacccggtacccgg

SEQ ID NO: 41741 - DNA, 646 bp, Homo sapiens
  misc_feature: GYAE6OF02F6AYG.3.69.G03.1.454.CMB.1.raw
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (346)..(346): a, c, t, g, unknown or other
  misc_feature (346)..(346): n is a, c, g, or t
  modified_base (514)..(514): a, c, t, g, unknown or other
  misc_feature (514)..(514): n is a, c, g, or t
  modified_base (547)..(547): a, c, t, g, unknown or other
  misc_feature (547)..(547): n is a, c, g, or t
tcagagacgcactccacgaccggtgctcgatttagtcgctgcgtaaaggagaaaggggggggtcgtcaggaggcagcgctctcgggacgtctccaccatggcctgggctctgctattcctcaccctcctcactcagggcacagggtcctgggcccaggtctcgccctgactcagcctcgcctccgtgtcctgggtcctcctaggacagtccgatcatcgcctatcctcctgcactggaaaccngcagtgacgttgggtgttataactntgtctcctggtatcaactgccaccaggacaaacgcccccaaaactcgaacttaattacaggtactagtcaagttaacnccgtaccctacggtaaggtttctaaacgtcgtacttctacgttacgttacgtaacggtctacgggaacaaccgtacccggtcccttacccgtacgacctatcccgttcggtcggtacctccggtacgtcgtggaacggtactagggccttagtaactttcggttaacncgtcgacgtctaataacacgtaacagcgacgtnaacggtctacggttagggtcctacggaacgtccggaaactacggtaccgtacccggtcgttaccgacgtccaaccgtacccggaccgtacccacccgtg

SEQ ID NO: 41742 - DNA, 695 bp, Homo sapiens
  misc_feature: GYAE6OF02F7W0E.3.69.G03.1.454.CMB.1.raw
  modified_base (186)..(186): a, c, t, g, unknown or other
  misc_feature (186)..(186): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacgtagggtcctgggcccagtctcgccctgactcagcctgcctccgtntcgtggtctccgtggacagtcgatcatccgcatctcctgctacgtacggaaccagcgtagtcggtacggttggtcgttaataactatacgtctccgtagtactacaacagaccaccaggaccaaaaccgcccccaaacgtactaattaactttaatagacgttagtacaagtaacgttcccggtaccgttacggtacgggttttacctaacgttccgttactttaccgttactttacggttaacttaaacggtcgtttacggacctaacgtacccggtcccttacccgacggtaccacgttcgtacgtcggtacctccggacggtccgttgggaaccggtacggtaacggtcgttaggttaagtttacgttaacgtcgctacgtctactagtaacacgaagcacgacacgacgtcgttcgggtaccgtacggtacgtaccgggaacgtacggtaccgtaccggttcctaccgtacgacccgaccgaaccgaccgaccctacccctacgg

SEQ ID NO: 41743 - DNA, 722 bp, Homo sapiens
  misc_feature: GYAE6OF02GSHSJ.3.69.G03.1.454.CMB.1.raw
  modified_base (201)..(201): a, c, t, g, unknown or other
  misc_feature (201)..(201): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgccctccgtgtctgggtctcctggacngtcatcatcgccatctcctgcactggaaccagcaggtgacgttggtagttataactatgtctcctggtatcaacagcacccaggaccaaacgaccccaaactcaataatttatgatgtacaagtactcgacctcgtacgggtttctaatccgtacttccttacgttacggttaactaacgttcgtcggtaacgaacccgtaccgggtaccccttcccgtacggtaacccttaacgttcccgttccggtaccgggttccccgtaccccggtacgggtccgtacgggaacgggtaaccgggtacgggtaccgttagttaactttaacgtttaaccgttacggacctacggtacctactaaacttaacgtaaccgtaagacctacggacctacggtaccgtaacgggttcgggttaccgttacgggaacggttaccgggaaccgtaaccgggtaccgtaacccgtcccgttacccgaccgttaccgacccggaaccccgtaaccggaccccctaaccccgttcg

SEQ ID NO: 41744 - DNA, 645 bp, Homo sapiens
  misc_feature: GYAE6OF02IKEGV.3.69.G03.1.454.CMB.1.raw
  modified_base (341)..(341): a, c, t, g, unknown or other
  misc_feature (341)..(341): n is a, c, g, or t
  modified_base (446)..(446): a, c, t, g, unknown or other
  misc_feature (446)..(446): n is a, c, g, or t
  modified_base (511)..(511): a, c, t, g, unknown or other
  misc_feature (511)..(511): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacagtcgatcatcgccatcctcctgcactggaaccagcagtgacggttggtggttaataactatgtctcgtggtatacaacacgacacccaggacaaaaccgacccccaaactcaataatttatagtatagtacagttaacncggtcccgttacgtacgggtttactagtccgtcttctcgttacgttaacgattcgtcggtacaaccgtccgtacctccctacgacctactccgttcggtcggccnccgtagcgtacgacggacgaggtcgtagttaacgtttatactgacgtgctacaataactacgaancgtacgacgacgacgtacgttcggggtaccgttacgggaaccgtacgggtaaccgaacgggtaccgtaccccggtacccgtacccgtacggtacccgaccgacccccggtaaccgtaccccgacccctaaccgg

SEQ ID NO: 41745 - DNA, 795 bp, Homo sapiens
  misc_feature: GYAE6OF02G0V4H.3.69.G03.1.454.CMB.1.raw
  modified_base (237)..(237): a, c, t, g, unknown or other
  misc_feature (237)..(237): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgacctcagcctgcctccgtgtctgggtctcgtggacagtcgatcatcgcctatcctcctgcacgtcggaaccngctagtgtacggtttgggtagttaataacttagtgttcctccgtaggtactacaacgacgacctaccgaggaccaaaccgaccccctaaaccgtctaacttaagtttactagtacttcgtacgtaacgttaacgtcccggtacccgttaccggttaacgggggtttacttaacgttccgtccgtttacgttacgttacggtttaacgtaacgttcggtacggactaaccgtccggtacccttacccggtacgtacccgtacgttccgttaccgtccgggtaccctcggtacggtccgttagggacggtacggacggtaccttaggttaactttacgtttacgtcggtacgtacgtccgttaactaacgttaacgtaacgtaacggacgtacgacctacggtaccgtaccgggttacggggttaccgttaccgggtaaccggttaccgggaacccgggttacccgggttaccggtaccccggttacccggttaaccccgtacggtacccgtaacccgggaacccccggtaacggttacccccccgtaaccgttacccgg

SEQ ID NO: 41746 - DNA, 680 bp, Homo sapiens
  misc_feature: GYAE6OF02FHE77.3.69.G03.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (280)..(280): a, c, t, g, unknown or other
  misc_feature (280)..(280): n is a, c, g, or t
tcagagacgcactccacgaccggtgctcgatttagtcgctgcgtaaaggagaaagggggggggtctcaggaggcagcgctctcgggacgtctccaccatggcctgggctctgctattcctcaccctcctcactcagggcacgagggtcctgggcccagtctgccctgactcagcctgcctccgtgtctgggtctccnggacagtcgatcatcgccatcctcctgcactggaaccngcagtgtacgttggtgttataactagtcgtctccgtgtatcaacngccacccaggcaacgccccaatcataattatgatgtacagtaactccggcctacgtaggggtttactaactcgtcttctcgttaggttacagtctcggaccaaccgtacccggtccctacccgttacgaccctaacgttccgttccgtacggggtcctaccgacggtctacgggtacgggtaaccggacggtccgttacgttaagtttacttacgtcgactacgtctaacgtaactaacgtaacaaacgtcaacgtcgaacgccgtacgggttcggggttacgtttaccgggaacggtacggggtaaacccgtagggtaaccccgtacccggttaccccgtacccgtaacccgttaccggaccggtaccccgaaccggtaccccctaaacccgtacccgg

SEQ ID NO: 41747 - DNA, 694 bp, Homo sapiens
  misc_feature: GYAE6OF02FJCAZ.3.69.G03.1.454.CMB.1.raw
  modified_base (233)..(233): a, c, t, g, unknown or other
  misc_feature (233)..(233): n is a, c, g, or t
  modified_base (308)..(309): a, c, t, g, unknown or other
  misc_feature (308)..(309): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcactggaaccngcagtgacgtttggtggttaataactatgtctctggtatcacagccaccaggcaacgccccaaatcattaattannatgtcagtaactcgtccctgtacgggtttctaatcgtcttcttcgttacggtttaacaagtcgtacggacctaaacgtaccggtccctacccgtgtaccctattccgttcgtacggggtccttcccggagggtccgtacgggaacgggacggtaacgggcgttaaggtaactttaagtttaaccgtcgctacgtcttaccaacttaacgtaaccaagtaccgtaaggtacacggtaccgacgggtttcggggttaccgtttacgggaaacggttcggggaacccgtaacgggttccccgtaaccggtttcccggtaacccccgtaccggttaccgaacccggtaacccccggtaaacccggtaccccctaaacccccgttaccgg

SEQ ID NO: 41748 - DNA, 653 bp, Homo sapiens
  misc_feature: GYAE6OF02JWEJU.3.69.G03.1.454.CMB.1.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
tcagagacgcactccacgaccggtgctcgatttagtcgctgcgtaaaggagaaaggggggggtctcaggaggcagcgctcgtcgggacgtctccaccatggcctgggctctgctattcctcaccctcctcactcgagggcacgagggtcctgggcccagtctcgccctgactcacgcctgcctccgtgtccgtgggtctcgnggacagtcgatcactcgcctatcctccgtgccacgtcggaaaccaggcctaggttcgtacggttggttacgttaataactagtntctctaggtactacaactacnccaccgaggtacaaaccgaccccctaaacgtacctaatttaactttacgtagtattcgtaacagtaacgtcccggtcctacggttagggtttactaacgtctaccgttctcgttagttactaacgtcgtacggacaacgtccgtcccgtcctaacgcgtacttccgtacgtcggtcctacggcgtcgtagacgggtacgcggtactgtaactttagtacngcacgtntactagtaacacagacagcagcggtaacgttcgggtacgtacgtacggtcggacggtaacgtccgaccgttaccggcccgtagccggtaaccaacccggtaaccgaccctacccgtacg

SEQ ID NO: 41749 - DNA, 855 bp, Homo sapiens
  misc_feature: GYAE6OF02I20AU.3.69.G03.1.454.CMB.1.raw
  modified_base (239)..(239): a, c, t, g, unknown or other
  misc_feature (239)..(239): n is a, c, g, or t
  modified_base (263)..(263): a, c, t, g, unknown or other
  misc_feature (263)..(263): n is a, c, g, or t
  modified_base (339)..(339): a, c, t, g, unknown or other
  misc_feature (339)..(339): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacgagggtcctgggccagtctgccctgactcacgcctgcctccgtgtctgggtctcctggacagtcgatcactccgaccatctcctgccacgtaggaaccngacaggtgtacgttggtagttaanaactatgtctccttggtatacaacacgaccaccgaggaccaaaaccgtacccccaaactcgtaattaaagtttagngtaactgtactaagttaacgtccggacccttacggtaagggttttactaacgttccgtacttacgttacgttacggtttaacaacggttcgacgggtaacaaaccctaccggggtaccccttacccgtaacgtaacccgtacgttaccgttaccgggtaccgggtaccgttaacccggagggttccgttaaggggaaaaccggggtacggtaaccgggtacgttacggtttaaaacgtttaacgtttaaaccgttgtaaccgtaacgtacctacccttaaaagtaaacctaaaccgaaacggtaccgaacggtaaccgtaaaccggtacgttaaaccggggttaacggggttacccggtttaaccgggtaaaccgggtaccgggtaaacccggttaaaccgggttaaccccgtaaccccgggttaccccgttaacccgtaacccccgggttaccgaaaccccggtaacccccgggaaaaccccgggtaacccccctaaaccccggtttaaccccgg

SEQ ID NO: 41750 - DNA, 813 bp, Homo sapiens
  misc_feature: GYAE6OF02I79N1.3.69.G03.1.454.CMB.1.raw
  modified_base (370)..(370): a, c, t, g, unknown or other
  misc_feature (370)..(370): n is a, c, g, or t
tcagagacgcactccacgaccggtgctcgatttagtcgctgcgtaaaggagaaagggggggggtctcaggaggcagcgctctcgggacgtctccaccatggcctggctctgctattcctccaccctcctcactcgagggcacgagggtcctggcccagtctcgccctgactcagcctgcccttccgtgtcctgggtactccgtcggacagtcgatcacttcgcctatccgtcctgacacgtacggaaccagactaggtgacggttttggtaagttaacttaactaagttcgtcttacgtggtaacttaacaacacgacctaaccgaagaaccgtaaacccgaccccaaacctactaaattaaacgtttanagtacgttagtactaacgtaacttccggaccgttaacggtacgggttactaacgtccgtcttacgttaggtacttacgtaacgtcgtacgtacgaaccgtaccgtaccctaccgtagtaaccctgtttaccggtacgtcccgggtacttaccccggacgggtcgtaaagggtaccggggaaggtacggtacttaaggttaacgttttaaccgtacggttactaacgtaaccgcgtaacttaaacgtaaacgtaacgtaaacgaaccgaccgttaaacctcgtaccgggttaaccggtaccgggtttaccgtaaccggggtaacgttaaccggggaaaccgttaaccggttcccggtaaaccgtttaccccgggtacccttaaaccgggacccgttaacccgggaaccccggaacccgttaaaccccggacccttaacccgggg

SEQ ID NO: 41751 - DNA, 886 bp, Homo sapiens
  misc_feature: GYAE6OF02I88Z1.3.69.G03.1.454.CMB.1.raw
  modified_base (718)..(718): a, c, t, g, unknown or other
  misc_feature (718)..(718): n is a, c, g, or t
tcagagacgcactccacgaccggtgctcgatttagtcgctgcgtaaaggagaaaggggggggtctcaggaggcagcgctcgtcgggacgtctccaccatggcctgggctctgctattcctccaccctcctcactcgagggcacgacgggtcctcgggcccagtctcgccctagtacctcacggcctcgcccgttccgtgttcgtcgggtcctccgtaggtacacgttcgacttcgactccgcctattcctcctcgcgacgtacggaaccgagcgtacggtggtaccggtttgggttaggttaactaccgttaatcggttacccttccggttaggttaacctacgtaaacgaccgtaacccaacccggacggtaacccgaaacccgtaaacccccccgtaaaacttaccgttaaatttaaagtttaacgtattacgttacgtaccgtaagttaacccgtcccgggtccttacggggtttaccgggtttacttaaccgtccgttacctttggtaccgtttacggttaaacctacggttcgtacggaaccgtaaccgtacccgtcccttaacccgtacgtaaccctgttacctccgtcggtacccgttacgcggtacgtcgggaacgtggtaccgtaggtacgttaaacgttactacgtactacaccggtaacttacgtaactaacgtaaccggacgaaacggttaccgacgttaaacccncgggtttaaccggtccggggtttaacccgtaaccgggtaccggggtaaaacccgggttcccgggtaaccgggttaccccggtaaaccccggttcccggaaaccccggttacgaacccggttacccccggaaacccggaccccggttaaaccccccgtactaacccggg

SEQ ID NO: 41752 - DNA, 870 bp, Homo sapiens
  misc_feature: GYAE6OF02JARJX.3.69.G03.1.454.CMB.1.raw
  modified_base (123)..(123): a, c, t, g, unknown or other
  misc_feature (123)..(123): n is a, c, g, or t
tcagagacgcactccacgaccggtgctcgatttagtcgctgcgtaaaggagaaaggggggggggtctcaggaggcagcgctcgtcgggacgtctccaccatggcctgggctcgtgctattccncaccctcctcactcagggcacgagggtcctggcccagtctgcctgactcagcctgcctcgtgtcgtggtctcgtggactagtcgatcatccgactatcctctcgcacgtacgaaccgagcgtaggtcggtacggtttggtaggttaaactaacttagttcgttcctacgtaggttaactacgaaactcgacccaccgaggtaacccaaacccgaaccccctaaacgtactaattaaacgtttaagagtagttacgtaactaagttaaccgttcccggtacccgttacggttaacgggtttactaaacggtccgttcttaccggtcggtacgtttaacgtacggttacgacgtacgtaaccgtacccgtacccgttacccgacgtacccgttacgtccgtacggttcccggtaaccgtccggtaacggttccggttagggtaaaccggggtacggtacggtacggtttaacggttaacgttttaacgttaaaccggtcgtacggttaaccggtaccttaaccggttaacttaacggaaaccgtaccggtaaactaccgggtaccgtaaaccgggtccggtttaaccgggttaccggggttacccggtttaacgggaaacccgggttaaccggggtaacccggtaacccgggttaacccgtaacccggttacccccggttaacccgaaccggtttaccccgggaacccggtaaccccgtaaccccggacccccttaacccgtaacccgg

SEQ ID NO: 41753 - DNA, 659 bp, Homo sapiens
  misc_feature: GYAE6OF02JJDM7.3.69.G03.1.454.CMB.1.raw
  modified_base (234)..(234): a, c, t, g, unknown or other
  misc_feature (234)..(234): n is a, c, g, or t
  modified_base (281)..(281): a, c, t, g, unknown or other
  misc_feature (281)..(281): n is a, c, g, or t
  modified_base (349)..(349): a, c, t, g, unknown or other
  misc_feature (349)..(349): n is a, c, g, or t
  modified_base (468)..(468): a, c, t, g, unknown or other
  misc_feature (468)..(468): n is a, c, g, or t
tcagagacgcactccacgaccggtgctcgatttagtcgctgcgtaaaggagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcatcgcatctacctgcacgtggaaccngcagtgtacggttggtagttataactagtcgtctctggtatctaacngacctaccgaggacctaaaccgacccccaaactcctaattaaatttcgtagtatcgtactacgttacnccgtcctacgttacggggtttactaacgttcgtcttccgtgttacggttaacgtaagttcgtaggtaccaaaccgtccggtcctaccgtctactacttcgtcgtcggtcctacgcggtntacggaacggtcggtagtcctgtactttactgtcgtacgtctacgtatacgtaactacacgacacgtcgaacgccgtacgttcgggttaccgtacgtaccggtacggggtaaccctaggcccgtacccggttacccgtacccgtccgtaacggtacccgacccggtaacccgtaccccgaacccgttaccg

SEQ ID NO: 41754 - DNA, 181 bp, Homo sapiens
  misc_feature: GYAE6OF01CPHHU.12.6.A06.1.454.CMB.1.raw
  modified_base (178)..(181): a, c, t, g, unknown or other
  misc_feature (178)..(181): n is a, c, g, or t
tcagatacgacgtacacgaccggtgctcgatttagatctactgacaacaccaagggcccatcggtcttccccctggcaccctcctccaagagcacctctgggggcacagcggccctgggctgcctggtcaaggactacttcctacgtcgtatctgagcgggctggcaaggcgcatagnnnn

SEQ ID NO: 41755 - DNA, 576 bp, Homo sapiens
  misc_feature: GYAE6OF01DWP31.12.6.A06.1.454.CMB.1.raw
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (371)..(371): a, c, t, g, unknown or other
  misc_feature (371)..(371): n is a, c, g, or t
tcagatacgacgtacacgaccggtgctcgatttagatctactgacaacacgacgaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaangtcaccctctcctgcagggccagtcagagtnttagcggcaactacttagcctggtaccaanagaaacctggccaggctcccaggctcgtnatctatggtncatccagcacgggccactggcaatccccaagaccaggttcaggtggcaggtggtctgggacngacttcactctcaccatcagtacgacgtaggacgccgtagtaagtattttagacttagttttattacgttgtctagactaggttagtcggggtctcgtacgtcgtattacctacgtttccggacccgttgggtaacctaaagtagtacgtacgtacctaaacgtacgtggtacggtctacgtactaacacttactgttcttaccg

SEQ ID NO: 41756 - DNA, 600 bp, Homo sapiens
  misc_feature: GYAE6OF01DEM9F.12.6.A06.1.454.CMB.1.raw
  modified_base (209)..(209): a, c, t, g, unknown or other
  misc_feature (209)..(209): n is a, c, g, or t
  modified_base (364)..(364): a, c, t, g, unknown or other
  misc_feature (364)..(364): n is a, c, g, or t
  modified_base (396)..(396): a, c, t, g, unknown or other
  misc_feature (396)..(396): n is a, c, g, or t
tcagatacgacgtacacgaccggtgctcgatttagatctactgacaacacacaacggggggagaagagctgctcagttaggacccaggagggaaccatggaaaccccagcgcagcttctcttcctcctgctactctcggctcccagataccaccggagaaattgtgttgacgcagtctccaggcaccctgtctttgctccgggggaaanagtcaccctctcctgcagggccagtcagagtgttagcgcaacttcttagccgtggtaccaacagaaacctggaccaggcctcccgaggtctcgtcatctatggtgcatccagccaggccatgcatcccagcaggttcagtggcctaggtcgggtntagggaccaggtaccttcacttctacaccctntcaagttagactaggacgaccgtagaagtactttgacttagtttattactgtcgagcgtagtagtggggactcgacgtcgtagttccgtacgtttccggacccgtcgggtaaccaaacggtacgtagttaccgtaaccgtaaacgtaacgttcggtacggtacttacggacctaacccgtatttaccgtcgttaccttaacccg

SEQ ID NO: 41757 - DNA, 735 bp, Homo sapiens
  misc_feature: GYAE6OF01EPABC.12.6.A06.1.454.CMB.1.raw
  modified_base (216)..(216): a, c, t, g, unknown or other
  misc_feature (216)..(216): n is a, c, g, or t
tcagatacgacgtacacgaccggtgctcgatttagatctactgacaacacacgaaggggggagaagagctgctcagttaggacccagagggaaccatggaaaccccagcgcagcttctcttcctctgctactctggctcccagactaccaccggagaaattgtgttgacgctagtctaccgaggccaccctgttctttggtccggtacgggggaancgttccacccttctccgtgccgagggccagtcagtagtgttacgcggactaacttacgtacgccgtacggtaaccaacaacgtaaacctcgggacccgacggtccctacccgaggtccttacgtacctattccgttaagtcgggtagcctaacgttccgaggaccggtacgggacccaacgttcggactacgtacccgagtaaccgtaggttccgaggtcggacgttggggttacggtcggtcgggtaactacgtcctttaccgaccctacctaccgaactacgcgtaacgctacggtctacgaaacccgttacgaagtaacgttctcggtaacgtaccttaactttacgtactaacgacgaaacgtcgtaaacgttaacgttcccgtaacccctccggttacgttaccgggacgggtaacggtacgtaagtcggaactaacgaaaccgtaacggtccgttgaccgttacgcctaaacgtccgtacggttacttacgtttcgtacgtcccggttacccc

SEQ ID NO: 41758 - DNA, 780 bp, Homo sapiens
  misc_feature: GYAE6OF01CXYOV.12.6.A06.1.454.CMB.1.raw
  modified_base (207)..(207): a, c, t, g, unknown or other
  misc_feature (207)..(207): n is a, c, g, or t
tcagatacgacgtacacgaccggtgctcgatttagatctactgacaacacacgaaggggggagaagagctgctcagttaggacccagagggaaccatggaaaccccagcgcagcttctcttcctcctgctactctggcctccagataccaccggagaattgtgtgacgcagtctccaggccacctgtctttgtcgtaccgggggaanacgtccaccctctcctgcgacgggccagtcagtagtgttagcgacaactactagcctggaccaacacggaactcggaccacgggcctcccgaggtctcgtacatcgtagtgggtcacgtactaccgaggacgtacgggcctacgtcggaccactacccggaagtaccgtagggttacagggttcggaccgtagggggttcggggttcgacggggaacctaaccggttaccctttacctaaccttcctaacccgaaccctacgtaccgacgtacgtaccgttacccgtaacggtaccggtacccgttaaggtaaaccggtttacgttttaggtacccgtttaacgtttttaacgtttacccgtttacggtaccgtaacggtacccgtaacggtaccggttaacggtaaccggtaacggttcccgggttacccggtttacgggtttaaccgtttacccgggttttgggaacccgggtacgggaaccgtacgggtacggtaggtacgaaccgtttaaccgaaaacgggttacgttggaccggtacgtaccgtactacccgtagtccgttaacccgg

SEQ ID NO: 41759 - DNA, 689 bp, Homo sapiens
  misc_feature: GYAE6OF01C4Q27.12.6.A06.1.454.CMB.1.raw
  modified_base (176)..(176): a, c, t, g, unknown or other
  misc_feature (176)..(176): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (298)..(298): a, c, t, g, unknown or other
  misc_feature (298)..(298): n is a, c, g, or t
tcagatacgacgtacacgaccggtgctcgatttagatctactgacaacacacgaaggggggagaagagctgctcagttaggacccagagggaaccatcggaaaccccagcgcagtcttctcttcctcctgctactctggctccagactaccacggaataaattgtgtgacgcatcnccagtcacctgttcttgtcgtacggggaaanctccacctcncctgcgaggccagtcgagagtgtacgcgactaactacgtcgacgtaggaaccaacgaacgaaccgacggaccgacggaccnccgacgcgtcgtcagtactagtaggtcgacactaccgacgacgacggtaccgaacgtcggacgacctaccgaagaaccccccccccgtaggttacgtaggtacggtacgaggtacggtcgtacggacgacgtactactactactacactactacgtacgtaacgacgtacggacgtacgtacgtaagtagtttagtacgttagttaacgttagtacgtacgtagtacgtaggtaggtcgggtacgtacgtaccggtacgttacgttaccgttacgttacccggtaccggtaacggtaacgtaaacggtaacgtaacgtaacgtaaacgtaaacggtaacgttacggtacggtacgtacgaccgtacgtacgttacgttacgttcgttaccg

SEQ ID NO: 41760 - DNA, 610 bp, Homo sapiens
  misc_feature: GYAE6OF01B614K.12.6.A06.1.454.CMB.1.raw
  modified_base (220)..(220): a, c, t, g, unknown or other
  misc_feature (220)..(220): n is a, c, g, or t
  modified_base (391)..(391): a, c, t, g, unknown or other
  misc_feature (391)..(391): n is a, c, g, or t
tcagatacgacgtacacgaccggtgctcgatttagatctactgacaacacacgaaggggggagaagagctgctcagttaggacccagagggaaccatcggaaaccccagcgcagcttctcttcctcctgctactctggcctcccagactacccgaccggagtaaattgtgttgacgcagtctccaggcctaccctgtctttgtaccgtaccgggggaaancgtccaccctctcctgcgaggccagtcagagtgtagcgactaactcgtacgcctacggtaaccaacacgaaacctcggaccacggtccctacccgaggtcctcgtctattcgtagtcggtcgactactccgagcgacggaccacgtcgactacgtcccgagacgtggtacnggtggacgtagggtcggtcgaggactacgtactcactctacactagtacgagtcgacgtgacgtactagtaacttgttacacgtttatttactgtgtacaggtcgtaaggtcggtcggtactacgtacgtctagtccgtacgttccggacgtagaacttagcgtaacgtacgtacgaaacgtgtcgcgatcgtacctacgtagttcctagttcctaccg

SEQ ID NO: 41761 - DNA, 791 bp, Homo sapiens
  misc_feature: GYAE6OF01BWYFM.12.6.A06.1.454.CMB.1.raw
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (747)..(747): a, c, t, g, unknown or other
  misc_feature (747)..(747): n is a, c, g, or t
tcagatacgacgtacacgaccggtgctcgatttagatctactgacaacacacgaaggggggagaagagctgctcagttaggacccagagggaaccatggaaaccccagcgcagcttctcttcctcctgctactctggcctccagataccaccggagtaaattgtgttgacgcagtctcaggcacctgtcttgcgtacggggaancgccacttctccgtgcgngggccagtcaggtntcttagcctacttacgttacgcctacggtaaccaaactaggaaaccgtcggaccgaagggtcccttaccccggaaggtcccttaccctacgtacttaccgttaacgtcggtaactcggtacctaacgttaaaacccggaaaaacggggtccctaacggttcggacctaaccgttacccgacggttaccccggtaaggttccggacggttacgggtacctaagggggttccgggtacggttacggggacctaacggtacctttacccgaaccgtttccgaaccgtaacccgtagtaaccgtacggtaccgtaaccggtacccgtaaggtaccgtaaccgttaagtaaacgtttcggtttacggtaactttaacggtttttacttaccgtagtaccgtaggaccgtaggttaacctcggtaaacgtccgtttcgggtacccgtttcggttaccgttaccggttagggacccgagggtaaccgagttcgtacgaagtaacccgaaggttaaccngggttccgagtcctacggaactccgtattcccgtgttccctacg

SEQ ID NO: 41762 - DNA, 177 bp, Homo sapiens
  misc_feature: GYAE6OF02HWXFR.12.6.A06.1.454.CMB.1.raw
  modified_base (176)..(177): a, c, t, g, unknown or other
  misc_feature (176)..(177): n is a, c, g, or t
tcagatacgacgtacacgaccggtgctcgatttagatctactgacaacaccaagggcccatcggtcttcccctggcaccctcctccaagagcacctctggggcacagcggccctgggctgcctggtcaaggactacttcctacgtcgtatctgagcgggctggcaaggcgcatagnn

SEQ ID NO: 41763 - DNA, 178 bp, Homo sapiens
  misc_feature: GYAE6OF02IXI7E.12.6.A06.1.454.CMB.1.raw
  modified_base (176)..(178): a, c, t, g, unknown or other
  misc_feature (176)..(178): n is a, c, g, or t
tcagatacgacgtacacgaccggtgctcgatttagatctactgacaacaccaagggcccatcggtcttcccctggcaccctcctccaagagcacctctggggcacagcggccctgggctgcctggtcaaggactacttcctacgtcgtatctgagcgggctggcaaggcgcatagnnn

SEQ ID NO: 41764 - DNA, 868 bp, Homo sapiens
  misc_feature: GYAE6OF02FFXUR.12.6.A06.1.454.CMB.1.raw
  modified_base (169)..(169): a, c, t, g, unknown or other
  misc_feature (169)..(169): n is a, c, g, or t
tcagatacgacgtacacgaccggtgctcgatttagatctactgacaacacacgaaggggggagaagagctgctcagttaggacccagagggaaccatggaaaccccagcgcagcttctccttcctcctgctactctggcctcccagactaccgaccggagtaaatttgngttcgacggcacgtcctccgaggtccctacccttgttcctttacggtaccggtaccgggggaaactcgtccaccctctccgtggaccgacgggcccagtcaggtacgttcgtacgcctaccgttacgtacgtcccgttacggaacccaaacgaaccgaacccgtcggaccgtaccggtcctaccccgaagtccccttaccttacacttaccgtatacggtactacgaaccgtaaccgaaaccggtaaacggccctaacgttccgaccgtacccgtaccggtaccggtaccggttacggttacgacgggttaccggtaccggttacgggggtaccggtacgggtaacccggtaaccgtaacccgttacccgtttaccaaccccgttacccgaaaccctaccgtaacccgtaccgacccggtaccggtttaaaccggacggtaaccgttccggtttaaaccgtttaaacgggtttaaccgttttacgttaccggtttaacgtttaacgttacgtaccgttacgacccggtaacgtacgtaccggttacgtaacccgtcggtttacccgcggtttacccgtttacgggttaccgtttaacggggccggaaaccttacggactacggtacgtacgaacgacctaaacggtacgccgttacggcgaccctactcgttacgtccgttacgtccgttacctacccg

SEQ ID NO: 41765 - DNA, 511 bp, Homo sapiens
  misc_feature: GYAE6OF01B79S1.39.1.A01.1.454.CMB.1.raw
tcagtcgcactagtcacgaccggtgctcgatttagacgtctcatcaaagaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgaccgattcagcggcagcgggtctgagacagatttcactctcaccatcagcagcctgcaggctagaagatgtggctagtttattactgtcagctagtattatagtagtcctctagtacgtttcggccggggtacagcgtggagatacgaaacgacgtggtggctgacacctatctgttccttgtcttcccg

SEQ ID NO: 41766 - DNA, 509 bp, Homo sapiens
  misc_feature: GYAE6OF01DAESV.39.1.A01.1.454.CMB.1.raw
  modified_base (503)..(503): a, c, t, g, unknown or other
  misc_feature (503)..(503): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagattacttcgcttggtaccagcagaaaccaggacagcctcctaaagttgctcatttaactgggcatctacccgggagtcccggggtccctgaccgattcagcggcagcggtctgagacagatttcactctcaccatcagcagcctgcaggctgaagatgtggctagtttattactgtcagcagtattatagtatcctacgagtcttttgggcccggggtaccaagtcgtaggagatacaaacgtaactgtggctgcaccatctgtctcnttcccg

SEQ ID NO: 41767 - DNA, 558 bp, Homo sapiens
  misc_feature: GYAE6OF01D441U.39.1.A01.1.454.CMB.1.raw
  modified_base (452)..(452): a, c, t, g, unknown or other
  misc_feature (452)..(452): n is a, c, g, or t
tcagtcgcactagtcacgaccggtgctcgatttagacgtctcatcaagggaagggaaggggcagcaagatcggtgttgcagacccaggtcttcatttctctgttgctctggtatctctggtgcctacggggacatcgtgatgacccagtctccagactccctggcttgtgtctctgggtcgagagggccaccatcaactgcaagtccagccagagtggttttacacaggtccaacaataagaattacttcgcttggtaccagcagaaaccaggacagcctcctaagttgctcatttactgggcatcctacccggggagtccggggtccctgaccgattcagcggcaggcgggtctgagacagtatttcactctcaccatcagcagcctgcaggctagaagatgtggactagtttattactgtacagctagttaattatagttacgttcctanaagttacgttttacgggaccggggtaccaaggtctaggtagacgtaacgaaacgtaacgtggtaggtcgtagccaaccgtacttacgtagttccttctacttcccg

SEQ ID NO: 41768 - DNA, 636 bp, Homo sapiens
  misc_feature: GYAE6OF01BTWIT.39.1.A01.1.454.CMB.1.raw
  modified_base (315)..(315): a, c, t, g, unknown or other
  misc_feature (315)..(315): n is a, c, g, or t
tcagtcgcactagtcacgaccggtgctcgatttagacgtctcatcaaagggaaggaaggggcagcaagatggtgttgcagacccaggtcttcatttctctgttgctctggatctctggtgcctacggggacatcgtgatgacccagtctccagactccctggtctgtcgtctcgtgggtcgaggacgggccgaccagtccaactcgacaacgtccgagccagtagttgtttaacacaggtccaaacaataagaattacttcgcttggtaccagcaagaaccaggacacgcctacctaagttcgctctatttacgngggtacctagttccgtacccggggacggtcccgggggtaccctggacccgtacttccgacgccggcgaggcgggtctaggacgacgtagtactttcgactctcacatcacgctagcctgcctaggcgtagaagtacgttggtaggtctagtttactactcgtacacgtctagttacttagtacgtacgtctacgtagtacgtttccgggaccggggaactacggaccgtagggtacgtacgttaccgaaaacggtacgtgggttacggccttacggacccttaaccgtcttacccggttcttaccttccgtcgttaccccg

SEQ ID NO: 41769 - DNA, 601 bp, Homo sapiens
  misc_feature: GYAE6OF01DGTEQ.39.1.A01.1.454.CMB.1.raw
tcagtcgcactagtcacgaccggtgctcgatttagacgtctcatcaaggaagggaaggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaagtccagccagagttgtttacacaggtccaaacaataagaattactcgcgttggtaccagacaacgaaaccaggacagcctacctaagttgctctatttacgtggcacgtccgtacccggggacggtcccgggggtccctcggaccgtattcgagccggcaggtcgggtctaggacgacaggtatttccactctaccacctatcagcacgtcctgacgaggactagaagtagtggtaggtacttagtttaactacttgtcagtctaagttattaagtagtacgttcctactaggttcgtttacggggacccggggtaaccaggtcgtagggtaagacgtacgaaaacgtacgtaggtcggctacggaccaccgtacttacttgttaccttcactttccccg

SEQ ID NO: 41770 - DNA, 829 bp, Homo sapiens
  misc_feature: GYAE6OF01CS8YZ.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctggatctctggtgcctacgggacatcgtgatcggacccagtcctccagacctcccgtggcctgtgtctcgtgggcgaggacggccacatcaactgacaagtccaagccagtagtgtttaacactaggtaccaaataaataagtaattacttcgtacgttaggtaaccagaccaagaaacctaggaacacgacctacgtaagttcgactactaacgttttaccgaggacctacgttcccgtaacccgggtacggttccccgggggtacccttacggaaaccgttacgttaccgacgggtccgggaccgtacggtccgggtacgttacgggaacgtaacccgaaggttaccgttttaccgaaccttccgttaacccaaccgtaacttaccgaacgacccgtaacgtcccgtacggtaccgaacggtaccgttaacgggaaacgttaggttacgggtacgggttaaccgtttaaggtttaaacgtttccggttaacggtacgttaacggtaaccgtttaaacgtttaagttttaacgttaacggttaaccttaccgttacggttaaaccggttaccggttttacccgggggacccgggttaaacgtacggtaacggttacggaacggttaaaccggtaaaccggtaaaccggtacggtaggtaacgggtaccttaacggaccctaaagtaccgttacgtacgttcccgttagtcccgtttaccccg

SEQ ID NO: 41771 - DNA, 617 bp, Homo sapiens
  misc_feature: GYAE6OF01AD926.39.1.A01.1.454.CMB.1.raw
  modified_base (421)..(421): a, c, t, g, unknown or other
  misc_feature (421)..(421): n is a, c, g, or t
tcagtcgcactagtcacgaccggtgctcgatttagacgtctcatcaagggaagggaagggggcagcaagattggtgttgcgagacccaggtcttcatttctctgtgctctggatctctggtgccctacggggacatcgtgatggacccagtcctccagacctccctggctgtcgtcgtcgtgggcgaggagggccaccatccaactgcagtccagccaggagttgtttacacgaggtaccaacaataagaattacttcgcttggtaccagcaagaaaccaggacagcctcctaagttgctctatttactgggcatcctacccggggagtcccgggggtccctgacccgtattcgagccggcaggccggggtctggagacgacgtagtttccaccgtctccaccatcagcacgcctgcaggntagaagatggtggcttagtttattaacgtgtaccagtctaagttatttaagtagtactaccgtcgtaaggtacggttttcggggacccgggggtaaccagggtccgtagggaactagtaacccgaaacggacgttcgggtacggccttcggaacccaccgtacgttccgttagttcccttcgtacgttaccccccg

SEQ ID NO: 41772 - DNA, 551 bp, Homo sapiens
  misc_feature: GYAE6OF01AG4XY.39.1.A01.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaacaataagaattacttcgcttggtaccagcagaaaccaggacagcctcctaagttcgctcatttacgnggcagtccgtacccgggagtcccggggtcctgaccgattcgagcggcaggcggtctgacgacacgtactttcacctctcacctatcagcacgtcctgcgagctagagatgtgactagttatactgtcagctaagtattagtagtcgtactacgtagtacgtttcgggaccgggtacaggcgtaggacgtacgtaacgaaacgtacgtggcggtacgtcgaccgaactcttacgtacgttccttcgtccgttacccg

SEQ ID NO: 41773 - DNA, 651 bp, Homo sapiens
  misc_feature: GYAE6OF01DB6IB.39.1.A01.1.454.CMB.1.raw
  modified_base (318)..(318): a, c, t, g, unknown or other
  misc_feature (318)..(318): n is a, c, g, or t
tcagtcgcactagtcacgaccggtgctcgatttagacgtctcatcaagggtaagggaagggcaggcaagagtggtgttgcaggacccaggtcttccatttctcctgttgcctctggtatccctctggtgcctacgggacatcgtgatgacccagtctcccagactccctggctgtgtctctgggcgagagggccaccgactcgaactgacaacgtccagccagagtgttttacacgagtaccaacaataagtaattaccttacgcttggtaccagtacacgaaaccaggacagcctccctaagtcgctctatttacgnggcagtcgtacccgggagtcccggggtcctggaccgtattcgagcggcaggcggtctgagacagtactttcgacgtctaccgactatcacgactccgcgtgaccgtaggtaccgaggaacgtagtggtacgagttacggtttactacggttagtactagtacgttaagttatttaagtacggttaactacctacgtaacggtttacgtttaccgggggacccggttaacacgggttacctagggtaactaacgtaccgtaaaacggtcgttacggtacggtcgtaccgtaccgacctacggtacttaccgttacctaccgttcgttacccccg

SEQ ID NO: 41774 - DNA, 717 bp, Homo sapiens
  misc_feature: GYAE6OF01A4610.39.1.A01.1.454.CMB.1.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (444)..(444): a, c, t, g, unknown or other
  misc_feature (444)..(444): n is a, c, g, or t
tcagtcgcactagtcacgaccggtgctcgatttagacgtctcatcaagaaggaaggggcgagcaagatggtgttgcagacccaggtcttcattctctgttgctctggatctctggtgcctacgggacatcgtgatgacccagtctccagacctccctggctgtgtctctgggcgagagggccacatcaactgcagtccagccagagtgtttacacaggtccaaaccgaataagaattacttacgtcttaggtaccagactagaaaaccagtacagacctcctaagtnctcatttacgnggtcactcgtacccgggtacgtcccggggtcctacgaccgtattccgaacgcggacgtacgcggggtactggacgacacggtattttcgactctctaacccagtacgagctacgaccgtcgacgtacggcgtttacgaaaacggtntgggtacggtacttaacgggttttaacttctttacgggtaacctaggtacccttaaggttaaccgttttaaggttaacggtttaaccgtcccttagttaacccgggtttaacgtttttccgggggaccggggtaaccccgttaaaggccccggttagggtaacggtaaccgtaaccgttaaaaacgggtaccgttgggttaacggggtccttaccgggaccctaaacgttccccgtagggtttacttccgttacccttaacgggtttaccccc

SEQ ID NO: 41775 - DNA, 651 bp, Homo sapiens
  misc_feature: GYAE6OF01A1JAL.39.1.A01.1.454.CMB.1.raw
  modified_base (563)..(563): a, c, t, g, unknown or other
  misc_feature (563)..(563): n is a, c, g, or t
tcagtcgcactagtcacgaccggtgctcgatttagacgtctcatcgaagggaaggaaggggcagcaagatggtgttgcagacccaggtcttcatttctctgttgctctggatctctggtgccgtacggggacatcgtgatgacccagtctccagactccctggctgtgtctcgtgggcgaggagggccaccatcgaacgtgacaaggtccaggcctagagttcgtttacactaggtccaaacaataagtaattacttcgcttaggtaccagcaagaaaccaggacacgcctacgtaagttcgactacgtacgttttacgcggggactagtaccgtaacccggggtagttacccgggggtaccctagaccgtattccgaagccggacgaggccgggttcagacgaacaggtaactttcactctcgaccatacgagacacgctagcgtaggtcgtaagaagtagtcggtacggtactaagttttactaacgttgaccgaggtacctaggttattaatacggtaactccgtacgtaagtttaccggtttacgggacccggggtaanaacggtggttaaggacggtaacgtaacgaaacgtacgtggtacggtccgacgtaccaccgtagttcgtagtcttaccgtcttaccccg

SEQ ID NO: 41776 - DNA, 544 bp, Homo sapiens
  misc_feature: GYAE6OF01C8NE3.39.1.A01.1.454.CMB.1.raw
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
  modified_base (437)..(437): a, c, t, g, unknown or other
  misc_feature (437)..(437): n is a, c, g, or t
  modified_base (530)..(530): a, c, t, g, unknown or other
  misc_feature (530)..(530): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacnggcatcgtacccgggagtccggggtcctgaccgnttcagcggcaggcgggtctgagacagtatttcactctacaccatcaacacgcctgcaggctagaagatgtgactagtttactactgtacagcagttattatagtagtcctnagttacgtttcgggaccgggtacaaggtcgtaggacgtactaccgaaacgtaacgtgtaggtctacgacctactacttccttagttccttacngttcccgttacccg

SEQ ID NO: 41777 - DNA, 596 bp, Homo sapiens
  misc_feature: GYAE6OF01DX7Y4.39.1.A01.1.454.CMB.1.raw
  modified_base (305)..(305): a, c, t, g, unknown or other
  misc_feature (305)..(305): n is a, c, g, or t
  modified_base (425)..(425): a, c, t, g, unknown or other
  misc_feature (425)..(425): n is a, c, g, or t
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagccagccagtagttgttttacacaggtaccaacaataagtaattacttcgtcttggtaaccagacaagaaaccaggacagcctacctaagtcgctctatttacgnggctacgtccgtacccgggacggtcccgggtccctgaccgacttcgacgcggcacggcggtctagagacagtactttcactctacaccatacacgcacgcctagcgacggtctagaacgngtgtaggtacttagtttactacgtgtacagtactagttattaacgtgtacgttcctacgtacgttacgtttacggggacccgggtacacgtcgtaggacgtataaccgaaacgtacgtggtacggtcgtacgcccgtaacctcttacttacgttccttcgtacttcccccg

SEQ ID NO: 41778 - DNA, 526 bp, Homo sapiens
  misc_feature: GYAE6OF01DZLGH.39.1.A01.1.454.CMB.1.raw
  modified_base (473)..(473): a, c, t, g, unknown or other
  misc_feature (473)..(473): n is a, c, g, or t
  modified_base (518)..(518): a, c, t, g, unknown or other
  misc_feature (518)..(518): n is a, c, g, or t
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaaccaggacagcctacctaagttgctcatttactgggcatccgtacccggggagtcccggggtccctgaccgattcagcggcagcgggtctgagacagtatttcactctcacatcagcagcctgcgagctgaagatgtggactagttttatacttgtcagcagtattatagtactctacagtacgtttcgggaccgggacacgtcgtagganagtaccaaaacggactaggtcggctacgacaccatctagttctcnttaccccg

SEQ ID NO: 41779 - DNA, 607 bp, Homo sapiens
  misc_feature: GYAE6OF01CUCZG.39.1.A01.1.454.CMB.1.raw
  modified_base (300)..(300): a, c, t, g, unknown or other
  misc_feature (300)..(300): n is a, c, g, or t
tcagtcgcactagtcacgaccggtgctcgatttagacgtctcatcaagggaaggaaggggcagcaagatggtgttgcagtacccaggtcttcatttctctgttgctctggatctctggtgcctacggggacatcgtgatgaccctagtctccagactccctggctgtgtctctgggcgagagggccaccgatcaactgcgaagtccagccagagtgttttacacaggtaccaacaataagaatactcgcttggtaccagtcagaaaccaggacacgcctacctaagttgctcatttacgngggcactcgtacccgggagtcccggggtcctggaccgtattcgagtcggcaggcggtctgagacagtattcactctcaccatacagcacgctgcgtagcctagaagtatggtacgtactacggtttactacgttcgtacgtagactacgttaattaactaagttacgtacctacgtacggtacggttttacgggacccggggaactaaggtccgtagggacgtaacgtaacgtaaacggtaacgtggtacggtacgtacgtaccgtaaccgtacgttccgtacgttacccttcgtacgttaccccgg

SEQ ID NO: 41780 - DNA, 556 bp, Homo sapiens
  misc_feature: GYAE6OF01CY677.39.1.A01.1.454.CMB.1.raw
tcagtcgcactagtcacgaccggtgctcgatttagacgtctcatcaagggaaggaaggggcacgcaagatggtcgttgctagacccaggtcttcatttctctgttgctctggatctctggtgcctacggggacatcgtgatggaccccagtctccagactccctggctgtgtctctgggcgagagggccacatcaacgtgcaagtccagccgagtagtgttttacacaggtccaacaataagaattacttcgcttggtaccagcagaaaccaggacagcctccaagttgctcagtttacgtgggcagtcgtacccgggagtaccggggtacctgacccgtattcgagcggcagcggtctgacgacagatttcactctcaccatacagcacgcctagacagggtctagaacgtatggtacgactaggttttatacgtgacagactagtattatagtctacctcgtagtcgtttcgggaccgggactagcgtaggagtactgaaacgtatggtggtctacggaccaccgtacgtacgttcgttacttagtcgttcccg

SEQ ID NO: 41781 - DNA, 632 bp, Homo sapiens
  misc_feature: GYAE6OF01C90ZB.39.1.A01.1.454.CMB.1.raw
  modified_base (207)..(207): a, c, t, g, unknown or other
  misc_feature (207)..(207): n is a, c, g, or t
  modified_base (378)..(378): a, c, t, g, unknown or other
  misc_feature (378)..(378): n is a, c, g, or t
  modified_base (439)..(439): a, c, t, g, unknown or other
  misc_feature (439)..(439): n is a, c, g, or t
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
  modified_base (605)..(605): a, c, t, g, unknown or other
  misc_feature (605)..(605): n is a, c, g, or t
tcagtcgcactagtcacgaccggtgctcgatttagacgtctcatcaagggaagggaaggggcagcaagatggtgttgcagacccaggtcttcattctctgttcgctctggatctcgtggcgccgtacgggacatcgtgatcgacccagtcctccagacctcccgtggctgtcgtcctcgtgggacgaggacgggacccacatcaacngacaacgtccagcagtagttgtttacagacgtaccaacaaataagtaattactcgtcttaggaccagacaacgaaacgaggaacacgacctacttaagtcgctactattaccgtggactacgtccgaccgggacgtcccggggtacctagtaccgtatcgaggccggacgngtcggtactgaacgacagtactcactctacaccatcacgctacgctagcaggtcagaacgntaggtagactttagttacttagngtactaacgntaactagttaatcggttactactacggttaacggttcgttacgggaacccgggtaatacggacgtaggggtaaacctacgtaaacggaaaccgtaaggttggtaaccggcttaaaccggcttaaacccggttntaccgttgtaccttcgtacccgtcccg

SEQ ID NO: 41782 - DNA, 552 bp, Homo sapiens
  misc_feature: GYAE6OF01BNVM8.39.1.A01.1.454.CMB.1.raw
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (546)..(546): a, c, t, g, unknown or other
  misc_feature (546)..(546): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctactaagttgctcatttacgnggcagtccgtacccggggagtccggggtcccngacccgtattcagcggcaggtcgggtctagagacagtactttccactctcacatcagcagcctgcgagcgtagaagtagtgtggacttagtttacttacgtgtcgtagactaagttattagtagtacgtcctacgtacgttacgtttcgggacccgggtaacagtacgtgagtactacgaaagtacgtggacggtcacgcacgtatcgtacttctcgtnttcccg

SEQ ID NO: 41783 - DNA, 738 bp, Homo sapiens
  misc_feature: GYAE6OF01EQMK9.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttgtttaacacacggtaccaaacaataagaattacttcgcttaggtaccagcaacgaaaccaggacacgcctacctaagttgctactattacgtgggctacgtccgtaccggggtacggttcccggggtcctacgaaccgtattcgacggccggcgacggtcggggttactgggaacgtacgtaacggtacttttaccgacctttacctacccgtaaaccctactaccgtaacgggacctaaccgggtcccgttggaccggtaacgggtacctagggtaaaacggtagttacgggttacgggtaaccgtttaaggtttttaacttaccggtttacgttaaccgtaacgtaccgttaaaggttttaatttaaacgttaacggtttaccgttaccgttacgtaacggtttaccggtttaccggggacccgggggtaactaggtacgtaggtacgaacttaacgaaacggtacgtaggtcggcttaccggactaccgttagtactttagtaactttcgtactttcccg

SEQ ID NO: 41784 - DNA, 656 bp, Homo sapiens
  misc_feature: GYAE6OF01A3NP4.39.1.A01.1.454.CMB.1.raw
tcagtcgcactagtcacgaccggtgctcgatttagacgtctcatcaagggaagggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacaggtccaacaataagaatttacttcgtacttggtaccagtccaagaaacccaggaccacgccctaccgtaaagttcgacctactattttacgtgggcatccgtacccgggagtcccggggtccctgaccgattcgacgcggcacggtcgggtctagagacgagtactttcactcctaccaccgattccagcacgtccctggcgtaggctaggaagtagtggtggacttaaggttttactacgtgtcagctaagttattagtacgtacgttacgttcgtaggttaccggtttcggggacccggggtaactacggcgttagggagtaaccgtaacgtaaaaccggtcgttgggtaccggtcccgttaccggacccttaacccgttacggtttaccctttacccggtttaccctttacccgtaaccgttttacccccccg

SEQ ID NO: 41785 - DNA, 772 bp, Homo sapiens
  misc_feature: GYAE6OF01DFK7S.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgccgtacggggacatcgtgatcgacccagtctccagacctccctggctgtgtctcgtgggcgaggacgggccaccatcaactgacaacgtccagccagtagttgtttaacacgacggtaccaacaaataagtaattacttcgtcttaggtaccagacaacgaaaccgacggacacgacctaccgtaagttcgctactaacttttacgtcggactacgtaccggtacccggggtacgggtccccggggtaccctcggaacccgtacgttaccgacggccggcgagggtccgggtcgtacggaacgaacgtacgttactttaccaacctcctacctacctactaccgacgaccgacgtccgtaggaccgtacggtacgtaaggaacgttaggttcggtaacggtaccgtttaaggtttttacttacggtacgttacgtaacgtacggtttaagttaagttttaacgttaacggttaccgttccgttaacggttaacgggttttacccgggttttaccggggggaacccgggtaaccgtacggtacgggtaacggtaacggtaaaccgtaaccgtaaaacgggtaccgttggggtaccggtacgtaccgacctacccttagttaccgtttagttacccttccgtccgtttacccccg

SEQ ID NO: 41786 - DNA, 702 bp, Homo sapiens
  misc_feature: GYAE6OF01C8R25.39.1.A01.1.454.CMB.1.raw
  modified_base (177)..(177): a, c, t, g, unknown or other
  misc_feature (177)..(177): n is a, c, g, or t
  modified_base (329)..(329): a, c, t, g, unknown or other
  misc_feature (329)..(329): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgccgtacggggacatcgtgatcgacccagtcctccagacctcccgtggctgtgtctcgngggcgaggacgggcccacatacaactgacaacgtccagccaagtagttcgtttacacacgtaccaaacaaataagtaattacttcgtacgttacggaccagacaacgaaaccaggacacgaccttactaagttcgacttactacgtttacgnggactacgtacccggtacccgggaccgggttcccgggtaccctacggtaccgtagtccgaacgggccggacgacgggtccgggtacgtaggaacggacctagttactttacccgacttaccaccacactacgacgacgacgtcctagacggaggtacagggaatggtggtacgtacttaagtttatacgtgacgacgtaacttagttattagtacgttaccgtcctacggtacggttaccgggttaccggggaaccgggtaactacggtcggtaaggtaacgtaaacgtaaacccgaaacggttacgtgggtaccgtacgtaccgaccgttaacctcgtttacgtaccgtttccttaccgtcccgtttccccg

SEQ ID NO: 41787 - DNA, 762 bp, Homo sapiens
  misc_feature: GYAE6OF01CL4WD.39.1.A01.1.454.CMB.1.raw
  modified_base (348)..(348): a, c, t, g, unknown or other
  misc_feature (348)..(348): n is a, c, g, or t
tcagtcgcactagtcacgaccggtgctcgatttagacgtctcatcaagggaaggaaggggcagcaagatggtgttgcagacccaggtcttcatttctctgttgctctggatctctggtcgccgtacggggacatcgtgatcgacccagtcctccagacctcccgtggctgtcgtctcgtgggcgaggacgggcccaccataccaactgacaacgtccacgccgaggtagttagtttaacaacgtacggtaacccaaataaattaaacgtaactttaccgttcgtacgttacggtaccagacaacgaaaccgaggacacgtcctacgtaagttcgctatacgtttacgnggactacgtcccggtaacccgggtacggttcccgggtaccctacggaccgtacttccggacggcgggacgacgggtccggggtactacgggaacgtacgtaaggttacttaccctaaccgttcgtaaccctacccagttaccgacgggtaccacgtccgacggacggtacggaccggtagaacgtaggttcggtacggtaacgttagtttaattcgtaggtacctagtacgttaagttaatttaacgtacgtttacgtaccttacggtaacggttacgggtttaccggggaccccggggtaacgtacggtaccggtaaggtaacgtacgtaaaccgaaacggtaaccggtgggtaccggtcgtaccggaccctaaccgtactttcgtacgtttacctccgttcctttacccccg

SEQ ID NO: 41788 - DNA, 803 bp, Homo sapiens
  misc_feature: GYAE6OF01DXL1Z.39.1.A01.1.454.CMB.1.raw
  modified_base (183)..(183): a, c, t, g, unknown or other
  misc_feature (183)..(183): n is a, c, g, or t
tcagtcgcactagtcacgaccggtgctcgatttagacgtctcatcaagggaagggaaggggcagcaagatggtgttgcagacccaggtcttcatttctctgttgctctggatctctggtcgcctacgggacatcgtgatcgacccacgtctaccacgacctccctggctgtcgtctcgtgggngaccccccccgagggccaccactacaacgtgaccaacgtccacgaccgagtagttacgtttaaccacgacggtaccaaactaaataagtaactttacttccgtacgttacggtaccagtacaacgtaaaaccgaggaccaagccctacctaaagttcgcctaccttatttacgtcgggactacgttaccgtaacccggggtaacggttcccggggtacccctaggacccgtacgttaccgacggccggacgacggtccgggttcgtaggaacggtacgagttacgtttacctacgttaccctaccgaccctaacgtcctaaggaccctaacggtccccgttggaacccgtaggtaacccggttggaaaccgggttagtacgggtaggtactttaacggttttaactttaacgtcggttacacggtaactagtttaatttaagttaagttaccggttaccctaacggtagggttttacccgggttttacgggggaccccggggttaactaacgggttcgtagggtaacgaaaccttaccggaaaacggttacgtcgggttcgtaccgtacccgtcaacccgtacgttcgtttaccggttaccttcccgtcgtttacccccg

SEQ ID NO: 41789 - DNA, 842 bp, Homo sapiens
  misc_feature: GYAE6OF01CV77E.39.1.A01.1.454.CMB.1.raw
  modified_base (384)..(384): a, c, t, g, unknown or other
  misc_feature (384)..(384): n is a, c, g, or t
tcagtcgcactagtcacgaccggtgctcgatttagacgtctcatcaagggaaggaaggggcagcaagatggtgttgcagacccaggtcttcatttctctgttgctctggatctctggtcgccgtacgggacatcgtgatcgacccagtctccacgacctcccgtggctgtcgtcgtcgtgggcgaggacggccacgatacaactgacaacgccagaccgaggtagtttacgtttaaccgaacgaacgtaaccaaagtaaaagttaaacgtaactttaccgttcgtaccgttacggtaacccgaacgaaccgaaacggaaaaccgaacggtaaccaccgtacccgttaacgttaacgttcgtacccttactaacgttttaccggnggtacctaaccggttacccggtacccggggtaccggtccccgggtacctacggaaccgtacgtcgacgggaccggtacgtacggtccgggtactaggaaacgtaccgttaacgttacgtttacctaaccgtccctaaccgtaccaacgtacgacggtaccacggttccgaccggacggtaacggtacgtaaggtaacgttcggtacgttacgggttaatttaacggttttaattacccgtagacgtaacgtaacgttagtttaaacgtttacgtaacgtttaccgttaccgtacggttaaccgggttaccggtttaccggggacgggtaaccgtacggaggttaaccgaagtaaacccgtaaacgtaaaccggtacggttacggtaccggtacgtaccccgtacccttaaccgtaccggttcgttacggtttaccctaaccgttccctttacccccgg

SEQ ID NO: 41790 - DNA, 820 bp, Homo sapiens
  misc_feature: GYAE6OF01A4QNO.39.1.A01.1.454.CMB.1.raw
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
tcagtcgcactagtcacgaccggtgctcgatttagacgtctcatcaaggggaaggaaggggcagcaagatggtagttgcgagtacccaggttcttcatttctctgttcgctcctggatctcttggtcgccgtacggggactagtcgtgatggtacccagtctccagtactccgtggctgtgtctcgtgggcgagtacgggccacgatcgaacgtgcaacgtccagccgaggngttcgtttanaccgaggtccaacaagtaagacttacgtcgtcttacggtacccaggtaccaacgaaaacccgacggtaacctaacggcccttaccgtaaagttcgacctacgtaacgtttaccgcgggactacgtccgtaccggggacgttacccgggggtccctaggaccggtacgttcgaggtccggtcgtacgggtcggtacgtaggaacgactagtaacttttacgactcgtaccacgacgttccgacggacgtacggtcctacggaccgtaggtacctacgggtaaacgtacggttacgggttaccgtaacggtttaacggtttaacgtttaccggtttacgttaccgtacggtaactaacgggtttaatttacgttaaccgggttacgttcccgtaacggtaaccggtttaccgggttttaccggggggaaaccccggggtaacgttaccggtaccgggtaaggttacggtaaaccgttaaccgggtaaaaccggtacggttacgggttacgggtccgaaacggtacccgtaacgttacgttaaccggtttggttaaccctttccggtaacggtttcccccg

SEQ ID NO: 41791 - DNA, 812 bp, Homo sapiens
  misc_feature: GYAE6OF01BNNKZ.39.1.A01.1.454.CMB.1.raw
  modified_base (337)..(337): a, c, t, g, unknown or other
  misc_feature (337)..(337): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgccgtacggggacatcgtgatcgacccagtctccagacctcctggctgtgtctcgtgggcgaggacgggccaccactacaactgacaacgtccagaccgagtagttcgtttaacacgacggtaccaaacaagtaagtaacttacgttcgtacgttacggtaccagacgaacgaaaccgaggacacggtcctacgttaagttcgactactacgtttacgnggactacgtacccggtacccggggtaccgggtcccggggttccctacggaaccgttactcgacggtcggaccggacggtccgggtacaggaacgacctaaggttactttaccgactcctacccgaacctacgtaccacgtaccgaccgtacctacggaccggaacggtacgtagaaaacggttgtagggtacggttacgtttaacttttaacgtacgttacgacgaacggttaactttaaacgtttagtttaaaccgttaacggtttaccgttacccggtacggtttaaccggggttttaccggggttaccgggggaacccgggttaaacgacggttacggtaaacggggtaaacctaccgtaaacccgggttaaaacgtaccggggttggttacccggacgttacggaaccccgttaaccgtttaacgttcccgtttaacgtttacccgttaccgtttaacccgttccccccgg

SEQ ID NO: 41792 - DNA, 754 bp, Homo sapiens
  misc_feature: GYAE6OF01C90MO.39.1.A01.1.454.CMB.1.raw
  modified_base (180)..(180): a, c, t, g, unknown or other
  misc_feature (180)..(180): n is a, c, g, or t
  modified_base (207)..(207): a, c, t, g, unknown or other
  misc_feature (207)..(207): n is a, c, g, or t
  modified_base (350)..(350): a, c, t, g, unknown or other
  misc_feature (350)..(350): n is a, c, g, or t
tcagtcgcactagtcacgaccggtgctcgatttagacgtctcatcaagggaaggaaggggcagcaagatggtgtgcagacccaggtcttcattctctgttgctctggatctcgtggtcgccgtacggggacagtcggtgatcgacccgagtcctcagtacctcccgtggctgtgtctcgngggcgaggacgggccaacactacaacngacaagccagcctaaggtagttcgtttaaccgacgtacggtaaccaaacgtaaaagttaaacgtaacttaccgttacggtacgttacggtaaccgacgaacgaaaccgaaaacgacggaactacgtaccttacgtaaggttcnctacgtaacgtttaccggaggcctaacgtacccggtaacccgggtacgggtacccgggtacccaacggtaccgtaagttccggaacggtcgggcgtaacgggcgggtactacgggaactaacgtacgttattacccgactccctacgaaaccgtacgtcaacgtacgaccggtcctaggacgtacggtacaaggtaaagtacgagttacggtaccgttaagtttaacgtacgtacgtaccgagtacgtaacgttaagttagtaacgttaacgtacgtacgtaacgttcgggtttaccgggaaccgggtaacgacggtcgtaacggaacgaacgtaaccgtaaacgacgtaggacgtcctacgtaccgaacctagttacctaggtttcctacgtccgttaccccg

SEQ ID NO: 41793 - DNA, 662 bp, Homo sapiens
  misc_feature: GYAE6OF01AQXD0.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatcgacccagtctccagacctccctggctgtgtctcgtgggcgagagggccaccatcaactgcaagtccagccagagttcgtttacacagtaccaaacaagtaagaatttacttcgtacttggtaacccaggacaacgaaaaccaggacacgtcctaccgttaagttcgctactagtttaccgtgggaccacgtccgtacccggggacggttcccgggtccctacgaccgtattccgacgcggacacggtcggtactgacgacctagtacttccactctacacatacgagcacgcctgacgtacggtactaggaagtgttcggtcgtactttaagtttacttagtcgtctacgtacgtagtttaattagttacgtacgttaccgtacgtaacggttacggttttaccggggaccgggtaacgtaacggtccggtaggtaacgtacggtaacctaaacggtacgttaggtacggtccgttacaccgtacgtacgttcgttaccgttcttacccgttcgtttaccccg

SEQ ID NO: 41794 - DNA, 800 bp, Homo sapiens
  misc_feature: GYAE6OF01DQFHI.39.1.A01.1.454.CMB.1.raw
  modified_base (141)..(141): a, c, t, g, unknown or other
  misc_feature (141)..(141): n is a, c, g, or t
  modified_base (494)..(494): a, c, t, g, unknown or other
  misc_feature (494)..(494): n is a, c, g, or t
tcagtcgcactagtcacgaccggtgctcgatttagacgtctcatcaagggaagggaaggggcagcaagatggtgttgcagacccaggtcttcatttctctgttgctcgtggatctcgtggtcgaccgtacgggacagtcgngactcgacctagtcctaccgacgtacctcccgtggtcttcggtcgtcgtcggtcggggacggacgggaccgggacccaacctacgtaccaacgtcgaacgtaaccggtaccacggtaccgaagggttacgttttaccggtttaaccgaacgtaaccggttaaccaaaacgtaaagttaaacgtactttacgtaccggtacgttacggaccaagaaccgaacgaaaccggtacgacctacgtaccgttaacgttagtccgacttacgttacgttacggcgactaccgtcccgggtaccgggtaccgggtacccggtcctacggaccgtactacggacggcgacgcggtcggtanagacgtacgattacgtcacctcgaccacgtctacgacgcgtacgaccgtgaccgtaggacgtaggtagttacgtgttaacgtagtttattacgtacgactagtacgtacgtttaagttacttaaggtacgttaccgttacgtaccgggttacgtttaccggggtaccgggtaacccgtaacggacgtacgggtagaacgttaaccgaaacgggttaacggtaccggttagggtaacctcgtaaaccgttacccggtacgtttaacggttcccttacggttttccctaaccgttcccgtttccccgg

SEQ ID NO: 41795 - DNA, 729 bp, Homo sapiens
  misc_feature: GYAE6OF01BZQ5V.39.1.A01.1.454.CMB.1.raw
  modified_base (465)..(465): a, c, t, g, unknown or other
  misc_feature (465)..(465): n is a, c, g, or t
tcagtcgcactagtcacgaccggtgctcgatttagacgtctcatcaaaggaagggaaggggcagcaagatggtgttgcagacccaggtcttcatttctctgttgctctggatctctggtcgaccggtacgggactatcgtgatacgacccagtcctccacgcctcccgtgtctgtcgtctcggtcgggcgacggcggaccaaccactacaacgtcgacaacgccacgaccgagtacgtttagttaccacgaacgtaccaaactaaataagtaacttacgtacgtacgtacgtacacgacgaacgaacgagacacgtcctacgtacgtctactacttacgtacgtcggactacgtaccggtacccgggtaccggtccggtaccgtaaccgtacgtcgacggacggcgacggtcggtacacggtaacacgtagttacccccctatacctacctacactactacgacnccgtacgtccgacgacggtacgtacggtaaggtaggtacgttgggtaagttacgtttaacgtttacgtacggtacgtacggtaagtacgttaagttaacgttaagttacgttaccgttaacgttaccggttaaccggtttaccggggttaccggggaaccggtacgtaaggtaccgaagtaaccgtaacgtaaccgaaacggttacgtcgggacgtcggactccgtaagtctttcgtacgttaccttctccgttcccgtacccg

SEQ ID NO: 41796 - DNA, 846 bp, Homo sapiens
  misc_feature: GYAE6OF01BF19Z.39.1.A01.1.454.CMB.1.raw
tcagtcgcactagtcacgaccggtgctcgattttagacgtctcatcaagggaaggaaggggcagcaagatggtgttgcagacccaggtcttcatttctctgttgctctcggatctctgggtcgcctacggggacatcggtgatgacccagtctccagactccctggctgtcgtctcgtgggcgagacgggccaccacgtcaaacgtcgcaacgtccagccagtagttcgttttaacactacggtaccaaacaaataacgaattacgttacgtcttacggtaaccagacaacgaaaccgaggacagtcctactaacgttcgctactagtttacgtcggactacgtccgtacccggggtacggtcccgggggtcctacggaccgtacttcgacggtcggacgtacgggccggggtcgtaggaacggaccgtacgtactttacgaacctcgtaccaaccgtacgtccgaacggtaccgacggtcccgtacggacccgtaacgggtccgttaacgggaacgtacggttacggtacggtaccgtttaacggttttaacgtttaccgtacggttaccgtaacgtacgtaacgtttaacgttaacggttacggttaaccggtttacctacgggtttaacggtttacccggggttttttacggggggaaccccgggggggttaaccctaacggggttaccggttacgggtaaaccggttaaccgttaaaaccggttaaaaccgtaaccgggtttacgggtacccgggttaacggtacccggtaacccgtaaacccgttaaccgtttacccgtttaaccggtttccgtttaaacccgtaacccggtttcccccgg

SEQ ID NO: 41797 - DNA, 599 bp, Homo sapiens
  misc_feature: GYAE6OF01EY6BU.39.1.A01.1.454.CMB.1.raw
  modified_base (169)..(169): a, c, t, g, unknown or other
  misc_feature (169)..(169): n is a, c, g, or t
  modified_base (433)..(433): a, c, t, g, unknown or other
  misc_feature (433)..(433): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatgacccagtctccagactccctggctgtgtcnctgggcgagagggccaccatcaactgcaagtccagccagagttgtttacacaggtccaacaactaagaattacttccgcttggtaccagtcagaaaccaggacaggcctacctaagttcgctctatttactggggctagtccgtacccggggtacggtacccgggggtccctacggaccgattcgaacgtccggcacggtcgggtctagacgacaggtactttccgactcactaccatcagcacgcctgcaggtctagaacgtntggtcgatagtttactacgtgtacgacgtacaagtttacttaagtacgtacgtactacgtacgttacgttttcggggaccgggtaacctaaggtccgtagggtaactagtaacctaaaacgacgtggtaacgctacgacaccgtatctaagtttctcgacttcccg

SEQ ID NO: 41798 - DNA, 621 bp, Homo sapiens
  misc_feature: GYAE6OF01APP9D.39.1.A01.1.454.CMB.1.raw
  modified_base (336)..(336): a, c, t, g, unknown or other
  misc_feature (336)..(336): n is a, c, g, or t
tcagtcgcactagtcacgaccggtgctcgatttagacgtctcatcaaggaagggaaggggcagcaagatggtgttgcagacccaggtcttcatttctctgttgctctggatctcgtggtgcctacggggacatcgtgatggacccagtctccagactccctggctgtgtcgtcgtgggcgagagggccaccatcaactgcaagtccagccagagtgttttacacaggtccaacaataagaattacttcgcttggtaccagcagaaccaggacagcctactaagttgctcatttacgtggacagtcgtacccgggagtcccgggtccctgtaccgtnttcgacggtcggacaggtccgggtactcggaacgtacgacggtactttccacctcctaccacctattccagtccgtacggtcccttggccgtagggtctaggaagtagtacggttggactttaaggtttacgttacgtcggtaccgtagtccgtaagttatttacgtagttactccgtagtacgttacggtttacgggacccgggtacaggtcgtaggagtacgtacgaaacggtacgtggtacggtctcgtacacctacttcgtagttccttcgtcgttacccg

SEQ ID NO: 41799 - DNA, 991 bp, Homo sapiens
  misc_feature: GYAE6OF01DCOYV.39.1.A01.1.454.CMB.1.raw
tcagtcgcactagtcacgaccggtgctcgatttagacgtctcatcaagggaaggaaggggcagcaagatggtgttgcagacccaggtcttcgatttcctctgttgctctggatctctggtcgccgtacggggactacgttccggttggactacgaccccgtaggttccttcccgaacggtacccttccccgtgggtccgttcggttccgttccgttccggttcgggggaccggtacggaaccggggaccctaaccctacgtaccgtaaacgttcggaccgtaacggttcccgaacggacccgtaaggttaacggtttacgttttaacccgaacgtaccggtaaccctaaaacggtaaacgttaaacggtaactttacgttaccgttaccgttacgggtaacccgacggtaaccgtaaacggaaacccgtacgggaacctaaccggtacccgttaaccggttaacggttaccgtaccttacgtttacgttttaccggtacgggtacctacgttaccggtacccgggggtacggttacccggggttaccctacggtaaccgttacgttaccgaccgggtccggtacggtcggtaccggggttcacgggtaacgtacgttacgttaccgtttaccgaaccgttccgttaacccacttacctaccggtaccgtaccgtaccggtaccgtacggtaccggaacgggttacgtaaggacggtacggttcggtaaccggtttacttaacggttttaacttacggttacgtacgtaaccgtaacgtttaaggttaactttacgttaacggttcccttaacccgggtaaccgtttaacgggggtttcccggttaccgggggggtaaccccgtaacgtaacgggtccggttaaacgggaaatacccgggttaaaaccggaccggtaaccgggttggtaaccgtccgaacgtacccgtacgtttacgtcgtttacccgttcctacgtccccgtttaccccgg

SEQ ID NO: 41800 - DNA, 786 bp, Homo sapiens
  misc_feature: GYAE6OF01A7AUA.39.1.A01.1.454.CMB.1.raw
  modified_base (501)..(501): a, c, t, g, unknown or other
  misc_feature (501)..(501): n is a, c, g, or t
tcagtcgcactagtcacgaccggtgctcgatttagacgtctcatcgaaggaaggaaggggcagcaagatggtgttgcagacccaggtcttcatttctctgttgctctggactctctggtcgccgtacggggacacgttcgtgaatacgacccgtagtcctccacgacctcccgtggctgtctctgtcggcgagcggaccacatcaacgtcgacaacgccagccgtagtagttacgtttaacacgtacggtaccaaactaagtaacgtacttacgttacgacgttacggtaaccaagtaccgaacgaaaccgaggaacctaaccgtcccgtaaccgttaagttccggaccttacttaacgttttacggccggacttaccggtacccggtaccggggtacggttacccggtccgtacgtcgtacgttacgacgggtcgacggtacgggtcgtacgtacgacggtacgtacgtactttcgactactccaactgtaccaggtacncggttaccgacgtacggtacggtacgtaacggaggttacgtaggttaccgggtactttacgtttacgtaccgttaggtaacgtacgtaagttaacgttagtttacgttaacggttccgttaaccggttaacggtaccggtttaccggggttaccgggtaccggtaaccggtacggtaacggttcggaaacgtaccgtaaacggtaacgttacggtacggtacggaacccttcggtaaccttacgtaccggttcgtttacttaccgttcgttacccgttacccccg

SEQ ID NO: 41801 - DNA, 850 bp, Homo sapiens
  misc_feature: GYAE6OF01C3A8Y.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctggatctctggtgccgtacggggacatcgtgatcgaccctagtcctaccacgacctccccgtggcctggttcgtccgtggtcgggacggagggccggacccacctactaccgtaacgcgaccgtaccgaccacgaccgtaaggttagttttacgtttaaccaacgttaccggaaaccctaaataaagtaaacgttaaccttacgtccgttacggtacgtaccgacgtacgaaaaccgaaccgacggaacgtaccgtacccttacgttaacggtcaccgttacttaacgtttaccgggacggtactaaccggttaccccggggtaacccggggtccccgggttaccccgggttccgaccgggttaacccgtacgtaccgacgggcccggtaggaccgggttcgtggacggtagacggtacttaccgtttacgacctaccgtaaccctcgtactacgacggtaccgtacgtaccggtcggaccggttacgtaacgtaaggtaggtacgttcgggttacgttaacgttttacgtttacgttaccggtcgttacgacgtttaaccggttatttaacgtttaacgtttaccgttacgttacccgttaacggtaccgggttttacggggtacccgggggtaaccgtaaacgtccggtagggaacgtaaccgtaacgtaacggtaaaccgtgggttacggtacgtcggtacctacgcttaccggttctacgttaacctcgtcccgttaccg

SEQ ID NO: 41802 - DNA, 833 bp, Homo sapiens
  misc_feature: GYAE6OF01CXVUY.39.1.A01.1.454.CMB.1.raw
  modified_base (176)..(176): a, c, t, g, unknown or other
  misc_feature (176)..(176): n is a, c, g, or t
tcagtcgcactagtcacgaccggtgctcgatttagacgtctcatcaaaggaaggaaggggcagcaagatggtgttgcagacccaggtcttcatttctctgttgctctggatctctggtgccgtacggggacatcgtgatcgacccagtctaccagactcccgtggctgtgtctcgngggcgaggaggccaccagtcaactgccaagtccagcctaagacgtttcgttttaaccacgtacggtaccaaaactaagtaaagtaacttacgttcgtacgttcggtaccacgacaacgaaaccgaggaccacgtcctaccgtaagtcgctacgttaactttacggtcgggctaacgttccggtaaccccggggtacggttccccggggttaccgtacggtaaccggtacttccgaagggtccgggtcgacggggtccggttcgtaggaaccgtaacgtaacgttaccttttaccgaccgttacccttaaccacccgtaacgtcccggagacccgtacggtacccgtcgaccggacgggttaacgtaacggtaagtaacgttggttacgtacgtttaaagtttcgttaacgttgaccgtacgtaacgttaagtaactttaggtaacgttacgttaccccgtaagtttaaccgggtttacgggtttaccggggaaccccggggtaaaccgtacgggtacccggttaaggtaaacggttaaacccggtaaaccgtaaacgggttaaccggtagggttaccggtcctaaccgggtaccctaacccgtttacgttacccgtttaccgtttacccctttcccgttaccccgtttaacccccgg

SEQ ID NO: 41803 - DNA, 795 bp, Homo sapiens
  misc_feature: GYAE6OF01DGXAX.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgccgtacgggacatcgtgatcgacccagtcctccagacctccctggctgtgtctcgtggcgaggacggaccaccatcaacgtgacaacgtccagaccagtagtttctttaacgacgtacggtaccaaactaaataaagtaattaccttcgtacgttgtaaccagacaacgaaaccgagacctacgtccttacgtaagttcgcttactagtttacggcggactaccgtaccggtacccgggtaccggtcccgggtaccctaggtaccgtacttacgacggccggacgcgggccggtacgtaggaacgtaccgtagttacgtttccgacctcctacccgacctgtaccgaacgccgtaccgccgtcggaacgtccgtacgtaggtaacgttacggttcggtaacgggttactttaacggttttaaccttaacgtggttaccgtaaggtttaacgttaagttttaacggtttaacgttaacggttacccgtttaacccgtaacgggtttaaccggtttaccgggtttacccggggggaacccggttaaccggtacgggtcggtaaacgggttaaacgaacccgttaaacggaaaccgggttagttaccgggtcggtaaccctacgaccctaaccgttccgttacgttaacccgtttcgtccctttacccgttacccccgg

SEQ ID NO: 41804 - DNA, 616 bp, Homo sapiens
  misc_feature: GYAE6OF01DBQD1.39.1.A01.1.454.CMB.1.raw
  modified_base (406)..(406): a, c, t, g, unknown or other
  misc_feature (406)..(406): n is a, c, g, or t
  modified_base (442)..(442): a, c, t, g, unknown or other
  misc_feature (442)..(442): n is a, c, g, or t
  modified_base (534)..(534): a, c, t, g, unknown or other
  misc_feature (534)..(534): n is a, c, g, or t
tcagtcgcactagtcacgaccggtgctcgatttagacgtctcatcaaggaagggaaggggcagcaagatggtgttgcagacccaggtcttcatttctctgttgctctggatcctcctggtcgcctacggggacatcgtgatgacccagtctccagactccctggctgtgtctctgggcgagagggccaccgatcaaactgcaagtccagccagagtgtttacatacggtcaaacaataagtatacttcgtcttaggtaaccagcagaaaccaggaacacgcctacctaaagtgactctaactttacgtggacacgtacgtacccgggacgtacccggggtcctcggaccgattccgacgacggcgtacgcggttcaggacacgagtaacttcgactactcgactancagtcagcctagcaggactagaacgatcgtagtacngtttaatctagtacgagacttagtactatacggtatcctaacggttagtccgggtttacggggtacccggtaacgacgtcgtacggtaaacncggttaaccgtaaaggtaacgttgggacctggtaaccgtacgaccgttaacttccggtttaacgtccctatacttaccccgg

SEQ ID NO: 41805 - DNA, 900 bp, Homo sapiens
  misc_feature: GYAE6OF01AGZ9O.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatcgacccagtcctccagacctccctggctgtcgtctcgtgggcgaggacggccaccatcaactgacaagtccagccagtacgttacgtttaaccacgacggtaccaaactaaagtaaacgtaatttaccgttcgtccgtttacggtaacccaacgaccaaacggaaaacccgacggaaccgacgtaccctaccgttaaaggttcgtaccttaccgttaacgtttaccggtcggggtacctaaccgttcccggttaaaccccgggggtccggttcccccgggggttcccgttacggtaacccgttacgttaccggaacggtcccgggacgaccggggttccggggttactaggaaccggtaacgtaggtttaacctttaccgtaccgtttacccttaacccgaaaccctacgttaacccgacgtcccgtaacggtccccgtacggaccggttacggaacgttaacgggaacggttacggttcgggtaacggttacgttttaaacttttacgtttacccgtacgtaacgtcgtaacgttaagtttacgtttagtacgttaccgttaccgttacggtaaacggttttaccccggggttacggggaaccccgggtaacgttacgggtaccgtaacggtaaaccggtttaaaccgaaaaccggtaaaccggggttaccgttggggtttaaaccgcccgttaaccgggtaacccttaccgttacggtttcccgtaccgtttacctttcccgtcccggttttaccccccg

SEQ ID NO: 41806 - DNA, 794 bp, Homo sapiens
  misc_feature: GYAE6OF01CHY01.39.1.A01.1.454.CMB.1.raw
tcagtcgcactagtcacgaccggtgctcgatttagacgtctcatcgaagggaaggaagggggcagcaagatggtgttgcagacccaggtcttcagtttctctgttgctctggatctcgtggtcgccgtacggggacagtcggtgatcgacccagtctccgagtacctcccgtggtctggtcgtctcgtgggcgaggacgggcccaaccacgtaccaacgtcgaccgaacggtcccgagccgagtagttcgtttaacgaccggtacggtaccaaactaagttaaacgtaacttacgtcgtaccgttaggtaccaaggacctaaacgaaccgacggaacctacggtaccttaccgtaaggttcgccttacgtaacgtttacggcgggtctaaccggttcccggtaaccccggggtacggttcccgggggtaccctcggaaccggttcttaccgggacgggtccggacggacggtccggggttacaggaacgaccgtagttactttccgacgtcctaccacctagtaccgacggtaccgtacgtcccgtcggacggtacgggtacgtacggtaacgttcgtacgggtacggttattaacggttttaactaccggttacgaaccgtacgtagtttaacgttataacggttacgtaccttaccgtacgggttaacggtttccgggttacgggggaacccgtacgtaacggtacggtagggtaacgtaacgtaaaccgtaacggtaggttcgtacggcgtacctactacggtacttcgtattcccgtctacccgtccccg

SEQ ID NO: 41807 - DNA, 714 bp, Homo sapiens
  misc_feature: GYAE6OF01A612I.39.1.A01.1.454.CMB.1.raw
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
tcagtcgcactagtcacgaccggtgctcgatttagacgtctcatcaagggaaggaaggggcagcaagatggtgttgcagacccaggtcttcatttctctgttcgctctggatctcgtggtcgccgtacgggacattcgtgatcgacccagtcctaccagacctccgtggctgtgtctcgtggcgacggcggccacatacaactcgacacgtcacgcagtagttcgttacacgacgacaaataataagtattactcgtacgttagacagacaacgaaccagacacgtcctactagtcnctatacttacgcggactacgtccggtaccggtacggttccccgggtaccncgtacgtacgttcgacgtcggacgtacggtcggtacgacgaacgactaaccgttatttaccaaccgttccaccgaaccctagtaccgacgtcgaacgtccgtagtacgacggtacagtaacgtagtcggtacggtacctttagtaccttaggtccgtaacgacgtacgtttaagttaccgtttaaggttaccgttacgttaccgttaacggtacggtttaccgggtttaaccggggaaccgttaaccgacggttaccggtaacggtaactaaccgtaaaccgggtaacgtaccgagggttccgaacgtacggacccttaacgttcgttaaccgttcctttaaccggtacccgtttcccgttaccccg

SEQ ID NO: 41808 - DNA, 723 bp, Homo sapiens
  misc_feature: GYAE6OF01CUBY4.39.1.A01.1.454.CMB.1.raw
  modified_base (130)..(130): a, c, t, g, unknown or other
  misc_feature (130)..(130): n is a, c, g, or t
  modified_base (478)..(478): a, c, t, g, unknown or other
  misc_feature (478)..(478): n is a, c, g, or t
  modified_base (687)..(687): a, c, t, g, unknown or other
  misc_feature (687)..(687): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgccgtacggganatcgtgatcgacccagtcctccacgacctcccgtggctgtgtctcgtgggacgaggacgggcccaaccctataccaaacgtgaccaaacggtccagaccaagtagttcgttttaacacgacggtaaccaaacaaagtaaagtaacttacgtcgtacgttacggtaaccagacaacgaaaccgaggactacgtcctacgtaagttcgctactagtttacgtcggactacgtccggtacccggggacggtcccgggtcctacggaccgtgtaccgacggtccggacgaggtccgggtcgtagaacgtactagttacgtttacaaccgtctacccgaccctagtaacccgngtaaccgaccgtccgtacgaccggtacggtactaaggaaacggtacgtttggaacggttacgttaaggttttacttaactggtaacccgaggtaactttaaagggtttactaaggttaacggtacttacctaacgttagggtttaccggttaccgggggaccggtaactacgggtgtacggagaaccgtagaaacggtcgttggacggntacgaccctatacttctacgtctccgtacttcccgg

SEQ ID NO: 41809 - DNA, 801 bp, Homo sapiens
  misc_feature: GYAE6OF01CN32A.39.1.A01.1.454.CMB.1.raw
  modified_base (440)..(440): a, c, t, g, unknown or other
  misc_feature (440)..(440): n is a, c, g, or t
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagacctcccgtggctgtgtctcgtgggcgagacgggcccaaccatacaaactgaccaaagtcccaagccgaagtagttgttttaaccacgtaggtacccaaacaaattaaagtaactttacgttccgtacgttaggtaaccctaggaccaaacgaaaaccgaggaaccaacgtacccttaccgtaaagtttcgactccgtaactttacgtagggactacgttaccggttaccccggggaacggttcccggggtaccctccggtaaccgtaacgttcgaacggcggaccgngggtaccgggtcgtaggaccgaaccgtaagttactttacctaaccgtaccttaccaacccgtatcccgaacggtacctaacggccctcggtacgaacgggtaccgtaaggaaacgtacggtttcggtacgggttaacgttagttttaacgttaacgtcgttaccgagtaccgttaagttaagttaactaggtttactaaccgtacggtaacgtttacccgggttaacggggccccgggtaacgtaggaccggtaggtacgaaaccgtaccgtaaaacggttacgtagggttacggaaccgttaccgacccgtaacccgttacgttcgttacgtttaacccttcggttaccctttacccccg

SEQ ID NO: 41810 - DNA, 686 bp, Homo sapiens
  misc_feature: GYAE6OF01A1FSS.39.1.A01.1.454.CMB.1.raw
tcagtcgcactagtcacgaccggtgctcgatttagacgtctcatcaaggaagggaaggggcagcaagatggtgttgcagacccaggtcttcatttctctgttgctctggatctctggtgccgtacggggacatcgtgatcgacccagtctccagacctcccgtggcttgtgttctcgtgggacgaggacggacccacctactaccaacgtcgacaacgtccacgccaggtacgttgtttacacgacggtaccaaacaaataagtaatttacctcgtacttaggtacccagaccgaaacgaaaccgaggaccacgtcctaccgtagtcgactctattcgcggacacgtcccggtaccggggacggttcccggtcctacgtaccgtattccgacggtccgcgacggtccgggtactgacgaactcgtacttcacctccacacgtactcgacggactaccgccgtagaccggacgttacgtaggtaaacgtgttacggtacggttaacttaagttttacgtacgttacgtacgaggtacttaaggttattacggtacgttcctaaccgtcgttagggtttacccgggttaccggggaccgggtaactacggtcgtaacgagtaccaaacggtacgtagttggtaggcctacgactaacgtcctagttacccgttcttctccgttccccg

SEQ ID NO: 41811 - DNA, 652 bp, Homo sapiens
  misc_feature: GYAE6OF01EJM8Y.39.1.A01.1.454.CMB.1.raw
  modified_base (405)..(405): a, c, t, g, unknown or other
  misc_feature (405)..(405): n is a, c, g, or t
  modified_base (625)..(625): a, c, t, g, unknown or other
  misc_feature (625)..(625): n is a, c, g, or t
tcagtcgcactagtcacgaccggtgctcgatttagacgtctcatcaagggaaggaaggggcagcaagatggtgttgcagacccaggtcttccatttctctgttgctctggatctctggtgcctacggggacatcgtgatgacccagtctccagactccctggctgtagtctcgtgggcgagagggcctaccatcaactggcaagtccagccagagtcgtttacacaggtccaacaataaggaattacttcgcttcggtaccagcaagaaaccaggacagcctacctaagttcgctacgtactttacgtgggtacacgttccgtaacccgggtaggtcccggggtcctgaccgagttcgagcggcgtagcgggtctgacgacagtctttacgactctacgaccctntacacgtccacgtccgtcggaccgaggtccgtaacgtaacggtactcggttcgggtacctaaggttttactaacgttcgaccgtacggtacctagttacttaagtacgttacgttacctacgtacggtttaccgtttaccggggaccggggttaacccaagggtccgtaggaacgtagtaaccgaaaccggtgtacgggtcggttcaggcctaacccgtntacccgttgtacttccgaatttccccg

SEQ ID NO: 41812 - DNA, 669 bp, Homo sapiens
  misc_feature: GYAE6OF01EABP0.39.1.A01.1.454.CMB.1.raw
  modified_base (446)..(446): a, c, t, g, unknown or other
  misc_feature (446)..(446): n is a, c, g, or t
tcagtcgcactagtcacgaccggtgctcgatttagacgtctcatcaagggaaggaaggggcagcaagatggtgttgccagacccaggtcttcatttctctgttgctctggatcgtctggtgcctacgggacatcgtgactgacccagtctccagactccctggctgtgtctctgggcgagaggccaccatcaactgcaagtccagcctagacgttgttttaccacctaaggtacccaaacaaactaaagtaactttacctttcgactttggtaaccaggaccaaggaaaacccacggaacctaaggcccttacccgtaaagtttcgcgttactaattttaccgtcggggcctaacgtccgtacccggggtagtcccggggtccctggaccgtattcaggtccggcgaggcgggtctgacgtacagtactttcaactcgtacaccgntcaggcaagcctgcgacggtctagaagtagtcgtggtactaagtttacttacttgtcctagtctagttacttagtacgttacgtccttacgacggttacgttttacggggacccggggtaactacggtcgtaggtacgtacgtaccgtaaacgtaaccgttaggttacggtccgtacgtacccgtaacctcttaccgttcgttccttccgtacgtttaccccg

SEQ ID NO: 41813 - DNA, 646 bp, Homo sapiens
  misc_feature: GYAE6OF01AEGPQ.39.1.A01.1.454.CMB.1.raw
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
  modified_base (483)..(483): a, c, t, g, unknown or other
  misc_feature (483)..(483): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagacgggccaccagtccaactgacagtccagccagtagttgttttacacaggtaccaaacaaagtaacgtaatttacgttcgtacgtttacggtaacccaggacctaaacggaaacccaggaccacggtccttaccgtaagttcgacctactatttaacggtggccagtcccgtaccgggtcgtcccggggtccctgaccgtatcgaggcgcgnggcggtctgagacagtcttacactctcactntcgacgacctacgtcgtcgacaggacctaggaacgtgtggtaggactttagtttactacgtnagactacttaagtattacgtagtcgtacctaggtacgttacggttccgggaccggtaactacggcggtacggtagtacctaaccggtaaagtcccgttaggacggttccctagaacccgttacgacgtttaccgttagttacctttaccgcccgtttaccccg

SEQ ID NO: 41814 - DNA, 689 bp, Homo sapiens
  misc_feature: GYAE6OF01D71FY.39.1.A01.1.454.CMB.1.raw
  modified_base (316)..(316): a, c, t, g, unknown or other
  misc_feature (316)..(316): n is a, c, g, or t
  modified_base (378)..(378): a, c, t, g, unknown or other
  misc_feature (378)..(378): n is a, c, g, or t
tcagtcgcactagtcacgaccggtgctcgatttagacgtctcatcaaagggaaggaaggggcagcaagatggtgttgcagacccaggtcttcatttctctgttgctctggatctctggtgcctacgggacatcgtgatgacccagtctccagactccctggctgtgtctctgggcgaggaggccaccatcaactgacaagtccagccaagagttgtttacacgagtaccaaacaaataaagaattacgttcgacgttacggtaaccagacaacgaaacccgaggaaccacgcctactaagttgactactattacgnggactaagtccgtacccgggacgtccggggtcctagaccgattacgagcggacaggtcggtntgacgtacaagtattacgactctacgaaccactacgaagtacgaacgtcgtacgacgaacggtactaaggaaaggtagttaggtacggtagttaacgttttaagttacgtacgttacgaggtacgtaagttaacttaagtaagtaacgtaccgttaacgtaacggttacggttttacggggaacccggggtaacgtaacggtacggtaacggtaaagtaaccgtaaacgtaaaaccgtaacggttaggacggtacgaccgtacaaacccgtacgttaccgttaccgtttacttaccgttactttacccccg

SEQ ID NO: 41815 - DNA, 887 bp, Homo sapiens
  misc_feature: GYAE6OF01ENONC.39.1.A01.1.454.CMB.1.raw
tcagtcgcactagtcacgaccggtgctcgatttagacgtctcatcaaggaggaaggggcagcaagatggtgttgcagacccaggtcttcatttctctgttgctctggatctcgtggtcgccgtacgggacagtcgtgatcgacccagtcctccagacctcccgtggtctgtcgtctcgtagggcgaggacggccaacataccaacgtgactaagtccgagccagtagttacgtttacacgtacgtaccaaactaagtaagtacttacgttcgtacgttaccggtacaagaccaaacggaaaccgaacggacctaccgtaccttaccgtaagttcgaccttacgtttaagtttacggcgggtactacggtacccgggtacccggggtcgggttaccccgggtcctaacggtactacgttccggacggaccggtacggtaacgggtccggttacgtacggaacggaacgttacgtttaaccttaccgtaaccgttacctaacctacctaggtacccgtaacgaccgttacgtcccggtagtaacgggtacccggtagtaaacgggtagttacggtaccgggttacgttaccgttttaaaggttttacccgtccggttaacggtaccaaagggtttacgtttaaacgttttacctaaggttaaccccggtccggtttaaccctaagggttttaacccgggtttacgggggtaaccccggggtacggtaaccgtagggttccggttaagggtaaacccaaaccgggttaaaacccggtaaaccgggtttcccgtggggtttaccccgaaagttacccccgggaaacttaacccggggttcctttacccgggttacccttttaaccggtaccccgtttccccgttaaccccg

SEQ ID NO: 41816 - DNA, 715 bp, Homo sapiens
  misc_feature: GYAE6OF01BGA7R.39.1.A01.1.454.CMB.1.raw
tcagtcgcactagtcacgaccggtgctcgatttagacgtctcatcaaggaagggaaggggcagcaagatggtgttgcagacccaggtcttcatttctctgttgctctggatctctggtgcctacggggacagtcgtgatcgacccagtctccagacctcccgtggctgtgtctcgtgggcgaggacgggccaccatcaacgtgacaagtccagccagtagttacgttttacacgaggtaccaaacgtaataagtaattaccgttcgacgtttcggtaccagaccaacgaaaccgaggacacggtcctaccgttaagttcgactactaactttacggcggacctacgtccgtacccggggtagtccccgggtccctaggaccgtattccgacggcgacgacggtcggtacgtaggacgacgtaggtactttcgaaccgtcctacgaacccacttacgagaccgtacgcgtcgacgtacggtacgtacggtaagtacgtagtacggtacttagtttacgttagttacgtagtacgtagttagttaagttaacgtacgttacgttaccgttacgttacggttaccgggttttaccggggaaccgggaaccgtacggtaacgtacgtaagttaacgaaccgtaaacgtacggtacggttacggtacaccgtacgaaccgtacgttaccgttacgtttacttcccgttccgttacccccg

SEQ ID NO: 41817 - DNA, 851 bp, Homo sapiens
  misc_feature: GYAE6OF01D3AQO.39.1.A01.1.454.CMB.1.raw
tcagtcgcactagtcacgaccggtgctcgatttagacgtctcatcaaggaagggaaggggcagcaagatggtgttgcagacccaggtcttcatttctctgttgctctggatctctggtgccgtacggggacatcgtgatcgacccagtctccagacctcctggctgtcgtactcgtgggacgaggacggcccacacgtacaacgtcgacgaacgtaccgagaccgtaaggtagttacgtttaacgaccgtacggtaaccaaacgtaaataaagtaactttaccgttcgtacgttacggtaacccagaaccgtaaacgaaaaccgaggaaccacgtacccttacgttaaagttcgccgttaacttacgtttacggcgggactaccgttacccggtacccggggtacggttccccgggtaccacggtaccgtagttaccgacgggccggtacgacgggtccggggtactacggaacgaacgtaggttacttttaccgaccgtacctaacccgactacgttaccgaacggtcccgtaacgtaccggtcgtaaccggtacggaaccggttaagaacggttaggttcggtaacggttaaaccttttagtttacgttaccgttacggtaacgtaggtacgtttaaagtttacgtttaaaccggttacggtaacctttacccggaaggtttaacggggtttacccggggtttacggggaaaccccggggtactacgggtaccggttaacggaaaccgtacctaaaccgggtaaacgttcgtcgggtaaccggtcctaaaccgtcctaaaccgttccctttacgggtcctttacccggtaccttccgttaaccccccgg

SEQ ID NO: 41818 - DNA, 792 bp, Homo sapiens
  misc_feature: GYAE6OF01AFJEM.39.1.A01.1.454.CMB.1.raw
  modified_base (444)..(444): a, c, t, g, unknown or other
  misc_feature (444)..(444): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgccgtacggggacatcgtgatgacccagtctccagactcctggctgtgtctcgtgggcgaggacgggccacctatcgaactggacaacgtccagccagagttagtttacacgaggtacccaaacaaacgtaaacgtaactttacttcgtcttacggtaacccaacgacaaagaaaacccgaggaacctaaccggtaccttaccgttaacgttacgcctaacgttattttacggtcggtacgtacttaccggtaacccgggggtacggttcccggggtccctggaacccgtattccgaacggtcgggtaccgtacgggccgggttanacggaagaaccgtgttaacttttacaaccttctaacccgaacctattaaccgacgacgacccgtcccgttacggcccggtaacggtaccgtaagggtaaacggtacgttgggtaacggttactttaacggttttacgtttactacggtaacctagtaaccgttagtttaacgttaagttaacgtcttaaccgtacgttacgtttaccggggttttcggacccgggggttaactacggtacgttagggacgtaaccggtacgtaaacccggtacggttacggtacgggtcgtacgtaacccaccgttaaacgttcccgtacgtttcccgtttagtccccgtttaccccg

SEQ ID NO: 41819 - DNA, 773 bp, Homo sapiens
  misc_feature: GYAE6OF01B2STE.39.1.A01.1.454.CMB.1.raw
  modified_base (334)..(334): a, c, t, g, unknown or other
  misc_feature (334)..(334): n is a, c, g, or t
tcagtcgcactagtcacgaccggtgctcgatttagacgtctcatcaaggaaggaacggggcagcaagatggtgttgcagacccaggtcttcatttctctgttgctctggatctctggtcgcctaccggggacatcgtgatgacccagtctccagactccctggctgtgtctcgtgggcgagagggccaccatcaactgcaagtccagaccagagttcgttttaacacgtacggtaccaaacaataagaatttacttcgcttcggtaccagcagaaaccaggaccagcctccgtaagttgctactagtttacgtcgggctactccgtacccgggnggttcccggggtccctaggaccgtattccgacgcggacacggtccgggtctaggacgacgtagtactttccacttcctacaacccagtccaacgggacctacggtaccgtacgtaccgtaacgggtacgtaacggtaaggtacgttcgggttacgggtacctttaacggtttttaacgtttaaccggttcggttaacgtacggttaccgtaacggttttaactttaacgtttaacggttaaccgtttacccgttacggtaaaccggtttaccgggtttttaccgggggaccccgggggtaacccgtaaccggtacgggttacgggtaaacgtaccggtaaacgtaaaacccggtaacgtttacgggaccggttccggtaccgaacccgtaacgtaccgttcgtttaccggttcccgttaaccgttcccgtttacccccg

SEQ ID NO: 41820 - DNA, 787 bp, Homo sapiens
  misc_feature: GYAE6OF01DNMOL.39.1.A01.1.454.CMB.1.raw
  modified_base (341)..(341): a, c, t, g, unknown or other
  misc_feature (341)..(341): n is a, c, g, or t
tcagtcgcactagtcacgaccggtgctcgatttagacgtctcatcaaaggaaggaaggggcagcaagatggtgttgcacgacccaggtcttcatttctctgttgctcgtggatctcgtggtcgaccggtacgggactagtcgtagatcgaccagttccaccacgtaccctccgtggcttggtcgtctcggtcgggacggaggaccggacccaacctacgtacctaacgtcggaactaaccgtccgacgaccgtaagttacgtttacgttaacgacgtaacgtaaccaaataaagttaacgttactttaccgttcgtacgttacgacgacgacaacgaacgngactactacctacgttagtccattacgttacgttaggacgtacctacgtaccccgggtaccggggtacccgggttcccggttaccaaggtacccgttcgtacgggacggcccggacgtacgggggtccgttagaacggatacccgttagtttacctttacccgaaccttacgtaccgaacccttagtaccgaaccggttacacccgggtactcgggaactaacgggtacgtaagtaacgggttgtacggtacggttacttttaagttccgtaggtcgaacgtataacggtttattaaagtcgtaaccgttgaccgttggtttaaccgggttacggtaccggggaacggttacacggtttacggaagttaaccgaaccgtaaaggaccggttggtgtaccggctacgtctaacgtttcaccgtttcttacctcgtccccgttacccg

SEQ ID NO: 41821 - DNA, 991 bp, Homo sapiens
  misc_feature: GYAE6OF01A3XJ3.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctggtatctctggtcgcctacggggacatcgtgatgacccagtctccagactcctggctgtcgtctcgtgggcagagggccacatcaactgacaagtccagccagtacgttacgttttacaccgacggtaccaaacgtaaacgttaagtaaactttaccgttaccggtacgtttacgggtaacccaacggtaccgtaaacgtaaaacccggaacggtaacgaaccggtacccttaacccggtttaaaggttaccggtaaccttaccgttaaccgtttttaaccggtacggggtaccttaaccggttccccggtttaacccggggggtaccgggtttcccccggggttcccgttaaccggaacccggtacgttaccggtaacgggtcccgggtacggtaccggggtccggggttacttaacgggaacgtaccgtaacgggttacttttacccaactttcccgtaaccgtaacccactttaccggaacgacctacgggtcccctacggtacggtaacgggctttaacgggaaacggttcgttacgggtacggtaccgttttaaagttttacgtttacgttaccggttaacgtacgggtaaccggtttacgtttaaacgtttaacggtttaccggttaaccggttaccgttaccggtttaaaccggggtttaacccgggtttttacggggggaacccccgggttaaacggtaccgggggttaaacggttaacggggttaaaaccgaaccggttaaaacccgggtaaaccggtttaacgggttacccggttacggggtttaaccccgtaccgggtaaccctttaaacccgggttcttttaacccggtttccgtttaaccccgttttcgtaaacccccgttttcccccggg

SEQ ID NO: 41822 - DNA, 720 bp, Homo sapiens
  misc_feature: GYAE6OF01A6JKB.39.1.A01.1.454.CMB.1.raw
  modified_base (325)..(325): a, c, t, g, unknown or other
  misc_feature (325)..(325): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgccgtacggggacatcgtgatgacccagtctcagacctccctggctgtgtctcgtgggcgagaggccaccatcaactgacaacgtccagccagtagttgttttacacgtacggtaccaaacaaataaacgtaactttaccttcgtcttaggtaccagacgaagaaaccgaggacacgtcctaccgtaagttcgctactagtttacgnggctacgtccggtacccgggtacggttcccgggtccctacggaccgtagttcgacggtcggcgacgggtccggggtactaggaacgacaacgttactttaccgaccttccaccaccgtaatcgacgtaccgacgtccaggaccggtacggactaggaagtgtacggtgggtaacctttagtttacttaacgtcgtacgtacgttactaagtttacgttaacgtaggttacccgttacgtaaccggttacggtttaccggggtttaccggggaacccggggtaactaacggtcgggaggttaaacggtaccgtaaaccgtaaacggtacggttgggacggtctaccgaccctaaccgtacgttacccgttggttaccttccgtaacgtttcccccg

SEQ ID NO: 41823 - DNA, 751 bp, Homo sapiens
  misc_feature: GYAE6OF01EO26B.39.1.A01.1.454.CMB.1.raw
  modified_base (326)..(326): a, c, t, g, unknown or other
  misc_feature (326)..(326): n is a, c, g, or t
  modified_base (371)..(371): a, c, t, g, unknown or other
  misc_feature (371)..(371): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgccgtacggggacatcgtgatcgacccagtctccagacctccctggctgtcgtctcgtgggcgaggacgggccacatcaactgacaagtccagccagtagttcgttttaacacgtaggtaccaaacaagtaagtaactttacttcgcgttacggtaccagacaacgaaccgagacacgtcctacgtaagttcgacttactatttacgngggactacgtccgaccggggtacggtcccgggtcctacggacgtntcgacggcggcacggtcgggtctggacgactagtactttaccacctctaccacgactgacgctacgcgtgacgtcggacgtaggaaacgtgttacggtaggtacgtttaagttttactacggttataccgacgtacgttaagtttaacgtttacgttaacggtttaccgttacccgtaacgtttaacgggttacccgggtttttaccggggggaacccggggtaaccgttaacgggtccgggttaaggaaaccggtaaccgttaaacccggtaaaaccgggtaacggtttagggtaccggttccggaaaccgttacccgttaaacgttccgtttaaccgtttaccggtttacccttaccgtttcccgtttaaccccccgg

SEQ ID NO: 41824 - DNA, 750 bp, Homo sapiens
  misc_feature: GYAE6OF01C47ZA.39.1.A01.1.454.CMB.1.raw
  modified_base (511)..(511): a, c, t, g, unknown or other
  misc_feature (511)..(511): n is a, c, g, or t
tcagtcgcactagtcacgaccggtgctcgatttagacgtctcatcaaggaagggaaggggcagcaagatggtgttgcagacccaggtcttcatttctctgttgctctggatctctggtcgccgtacggggacatcgtgatcgaccctagtctccacgactcccgtggctgtcgtctcgtgggcgaggacggccacatacaactgacaacgtcacgaccagtagtttctttacacgtacgtaaccaaactaaattaaagtaactttacttcgtacgttagtaaccagtacgaacgaaaccgacggaacaccgtaccttaacgtaagtcgtactacttactttacggacggtactacgtaccgggacccgggtacggggttcccggtcgtacgtaccgtactacgcggcgaccggacggtccggttacagtaacggtactagtttacttacctaactcctaaccctaactacgtacgacgtaccgtacgcgttacggcggaaccgtaggtaanaccgttggtccggttaagttaacgtttagtttaccttacgtcgttaaccggcttaaaggttacttaagtttagttaacgttacgtcccgtttaagttaccgggtttacgggtaccggggaaccggtactacgggtacggtaaccggttagaaaccgtaaaccggtacggttaacgggttcgaacgtccggtaacgtacctaccgtagttacccgttagtcctaacccgttcgtaacccc

SEQ ID NO: 41825 - DNA, 763 bp, Homo sapiens
  misc_feature: GYAE6OF01C0BF0.39.1.A01.1.454.CMB.1.raw
  modified_base (396)..(396): a, c, t, g, unknown or other
  misc_feature (396)..(396): n is a, c, g, or t
  modified_base (514)..(514): a, c, t, g, unknown or other
  misc_feature (514)..(514): n is a, c, g, or t
tcagtcgcactagtcacgaccggtgctcgatttagacgtctcatcaaaggaaggaaggggcagcaagatggtgttgcagacccaggtcttacatttctctgttgctctggatctctggtagaccgtacggggacatcgtgatcgacccagtcctaccgagacctcccgtggctggttcgtcgtcgtggggacgacggacggcccaaccataccaactcgacaacgtccacgccaagtacgtttacgtttaaccgaacgtacggtaaccaaaacgtaaacttaaacggtaactttaccgttcgtacgttacggtaacctaggaacaaacgaaacccgaggaaccacgtacccttaacgttaagttcgacttacgtaacgtttaaccggcggtaaccncgttacccgggtacccggggtaccgggttccccgggtacctacggaaccgttagtcgacggccggacgacggtccggtcacggaacgacgtacgttcttacgacctcgtacaccgtanacgtacgacgcgtcgacgacgtacgagtaacgaagtcgtcggtacgttcttaagtttctacgtcgtaacgtacgtacgtttaattaacgttaacgttacggtaccgtttacgttaacggttacggtttccgggtttaaccggggacccgggtaactacggtacggtaaggtaccgtaacgtaaccgtaaccgtaacgttggacggtctccgaactcgtacgtcgtacgtttccacgttccgtaaccccg

SEQ ID NO: 41826 - DNA, 883 bp, Homo sapiens
  misc_feature: GYAE6OF01CBPWQ.39.1.A01.1.454.CMB.1.raw
  modified_base (129)..(129): a, c, t, g, unknown or other
  misc_feature (129)..(129): n is a, c, g, or t
tcagtcgcactagtcacgaccggtgctcgatttagacgtctcatcaagggaaggaaggggcagcaagatggtgttgcagacccaggtcttcatttctctgttgctctgatctctggtgccgtacggganatcgtgatcgacccagtcctaccgaagtcctcccgtggctgtcgtctcgtgggacgaggacgggcccaactactaccgaacgtcgacctaacggtcccaacgaccgaaggttagttacgtttaaccacgaacggtacccaaataaagtaagttaactttcgtgtaccgtttagggtaacccaggacgaaacggaaacccgaggtaaccaccgtaccttaaccgttaaaggttccgacctttacaacgttttacggacggtactaccgtacccgggtaacccggggtcgggttaccccggggtaccctaccggaaccgttaaccgttcgggaacggtaccggacggtacgggtaccgggttacgtaacgggaaacgtaacgtaacgttcttttaacccgaccttacctaacccgaccttaacgtacgaaccgtactaaccggtcccgtaagggtacccgacggttagtaaccgggtaagtcggtttacgggttaacgttaaccggtttaatttttaccggtaacgttacggttaactacggttaactttacgttttaaagttaacgttaacggttcgtttaacggtaccggttaacgggtttaccggtaccgggggaaacccggtagaaccgggttacggttaagaaacggtaccgaaaaccggttaccggtacgttagggttaccggtccgtaacccgtacttaccgtacggtttactttaccggttccttcccggttaacccgtttacccccg

SEQ ID NO: 41827 - DNA, 843 bp, Homo sapiens
  misc_feature: GYAE6OF01A94IE.39.1.A01.1.454.CMB.1.raw
  modified_base (532)..(532): a, c, t, g, unknown or other
  misc_feature (532)..(532): n is a, c, g, or t
  modified_base (676)..(676): a, c, t, g, unknown or other
  misc_feature (676)..(676): n is a, c, g, or t
tcagtcgcactagtcacgaccggtgctcgatttagacgtctcatcaagggaaggaaggggcagcaagatggtgttgcagacccaggtcttcatttctctgtgctctggatctcgtggtgccgtacgggactgtcgtagactcgaccagtcctccaagtcctccgtggtctggtcgtcgtacgtcgggagacggaccggaccctaccataccaagtcgaccgtaaccgtccgacgaccgtaggttaggttttaccgtttaaacgaaccggtaaacccggtaaacctaaaaacgtaaaagttaaaacggtttaaccttttacccgttacggtacgtttacggaaaccgaacgaaaccgaaaccgaaaaccggacgtaaccgacccgttaccttaacgttaacggttcgtacctaacgttacgttacggtacggtaccttacggtacccgggtacccggggtaccgggttccccggtccgtacgaacgttctaccggcggaccggtacgacgggtcgggttaaacgaccggtaanaaacgtacgttaacttcccgtaaccgtcctaacgtacctaagtcgaacgttaccgacggtcgtacgacggacggtaatacggtaacgttaggtacgttcggttaacgttttacgtttagtaccgtacgtactaacggtaagttntttaacgttaaggtactttaccttaccggtacgtacggggtttacgggttacccgggtaacgtacggtacggtaacgttcgaaagtcgtaaacggtaacggccgttagggacgttacgaccgtacctaacgttccgttactcgttaccttaaccgtccccttacccg

SEQ ID NO: 41828 - DNA, 949 bp, Homo sapiens
  misc_feature: GYAE6OF01BVT3M.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctgatctcgtggtgccgtacgggacatcgtgatcgaccctagtctccagacctcctggctgtcgtctcgtgggcgagaggccaccagtcaactgacaagtccagccgagacgttagtttaacacgacggtaccaaacgtaaataagtaactttaccgttcgtacgttacggtaaccacgacaaacggaaaccgaggaactaccgtaccttaccttaagttcgtaccttacgttaacttttaccggtacggggtacctaccgtaccccggttaccccgggggtaacccgggtttaccccggggggtttccccgtaacggaacccgttagtttacccggacgggaccggacggtcgggtaccgggggttccgtaggaaacggtaccgtaacgttaacgttttaccctaccttaccgttaccaacccgtaccgtacgtaaccggtaccgtacccggttacccgttgggacccggtaacgggttaccggtaaggtaaaggtttaggttaaccggggtttagaacccgtttttaaaggttttttaaaccttacccggttagggttaacccgtaacgggtaaccttttaagggtttaacgttttaacggttaccggttaacccgtttaaccccgtacgggttaaaccggggttttcccggggtttttaacccgggggggaccccggggtaaacccttaggggtaccggtaacggtaaacggtaaacccgttaaaccgaaaacgggtttccggttagggttacccggggccttaacccggtaacccgtaaacccgttactttacccggttaccggttttaccttaaccccggtttcccgtttacccccccg

SEQ ID NO: 41829 - DNA, 938 bp, Homo sapiens
  misc_feature: GYAE6OF01BHYFA.39.1.A01.1.454.CMB.1.raw
  modified_base (149)..(149): a, c, t, g, unknown or other
  misc_feature (149)..(149): n is a, c, g, or t
tcagtcgcactagtcacgaccggtgctcgatttagacgtctcatccaaggaaggaaggggcagcaagatggtgttgcagacccagtcttcatttctctgttgctctggatctctggtgccgtacgggacatcgtgatcgacccagtccnccagtacctcccgtggcttgtcgtctcgtagggcgaggacggaccacactacaactcgacaacgtccacgccgtaagtacgtttcgtttaaccgacgtaacggtaccctaaaactaaagttaacgtaacgttttacgttaccgtaccgtttacgggtaacccacggtaaccgaaacggaaaacccgacggaaccgtaaccggttcccgttaaccgttaacggtttccgtacttaccgttaacgtttaccggcggtacctaccgttacccgggtacccgggtacgggttccccgggtcctacggtaccgtagttccgacggccggacgtcggtccggtacgtagacgtaacgtagttaccgtttacctacctacctacacctagtacgtaccgaccgtaccggtccgtacggactacgggtacttaacggagttcggtaggtaccgttaacgtttacggttttaaccgttcgtaacgttacgtacggttaacgtttacggtttaaactttacgggtaaccgttacccgtttaaccggttaaccgggtttaaccgttttaaccccggggggttacccgggggtaaacccgggggtaacctttaaacccggggtggttaaaccgggtaaaaccgttaaaccccgggttaaaaccgtaaaaccgggtttcgggtttaacgttaccccgggttaacgtaaccccggttacccgtttacccggtttaaacccgttttcccgggttaaaccccttttacccgttttaacccggccccgtttttaaacccccccggg

SEQ ID NO: 41830 - DNA, 863 bp, Homo sapiens
  misc_feature: GYAE6OF01CT0TF.39.1.A01.1.454.CMB.1.raw
  modified_base (596)..(596): a, c, t, g, unknown or other
  misc_feature (596)..(596): n is a, c, g, or t
tcagtcgcactagtcacgaccggtgctcgatttagacgtctcatcaaggaagggaaggggcagcaagatggtgttgcagacccaggtcttcatttctctgttgctcgtggactccttctggtcgccgtacggggacagtcgtgatcgacccgagtcctccgagcctccgtggctgtcgtctcgtgggcgaggacggccacatcaagtgacacgtccagccagtacgtttgtttaccacgtacgtaaccaaataaagttaacgttaacgtttaccgttcgtaccgttttacggtaccaacggaccgtaaacggaaaaccgtaacggaacccgtaccgtacccgtttaaccgttaacggtttcgtaccttaccgtttaacgtttttaccgggacgggttacctaccggtttaccccggttaaccccgggggtcggtttccccgggggttacctacgggtaccgttacgttccggacgggtaccggcgtacggttccggttctaacggtaacgtaccgtagtttaccttttaccgaccttccgtaccaccgttaagcctacgtaccgcgtcccgtaggtcgacggtcgtaagaacggtnttacgggtacgttacgtttacgttttacgtacgttacggtactacggttaccttaaggtttaccttaacggttacgtaccgttaccgttacggtttacgggttttacccggttaccggggtaacccgtaacgtcggtaaccggttacggtaacgtaaaccgttacccggtaaacggttccggttggttaaacccggttgtaacccgtacccggttacgtttcgttacccggttccttaacccgttccgtttacccggttacccccgg

SEQ ID NO: 41831 - DNA, 764 bp, Homo sapiens
  misc_feature: GYAE6OF01A3965.39.1.A01.1.454.CMB.1.raw
  modified_base (549)..(549): a, c, t, g, unknown or other
  misc_feature (549)..(549): n is a, c, g, or t
tcagtcgcactagtcacgaccggtgctcgatttagacgtctcatcgaagggaaggaaggggcacgcaagtagtggtcgttgctagaccctaggtcttcatttctctgttgctctggatctctggtgccgtacggggtacatcggtagattcggtaccctagtccttccgaagtaccttacccgtagggtccttgtgttctcgtagggccggaggacgggccacgactcgaacgtgacgtaacgtccacggtccgagtaggttacttttacacgtacggtaccaaacgtaacgtaaataacgtttactccgtacgtttacggtacctagacgtaacgtaaaccgaggtacgtacggtcctaccgttaagttcggtctacgtacgttacggtcggactcgtaccggtacccggggtacgttccggggtaccttaagcgtaattcggacggacggacgtacggtccggtagtacgaagtacgtaacgtacgttaaccgcttaccgacccgactacgtacgaacgacgttacgtacgtacgtaccgtacggtnttaaccggataggtcgtaagtaccgttaaggtttactacgttaacgcgtaactaggtctttaacgtagtaacgttcgtacgtacgttacggttacgggttaccggggaccgtaaccgaggtaacgttacggaacacggttaaaaccgacgttcggtactggttaccgactaccgtaacgtcttacggtacccttacgtaaccgtcggtttacccc

SEQ ID NO: 41832 - DNA, 787 bp, Homo sapiens
  misc_feature: GYAE6OF01CDKYE.39.1.A01.1.454.CMB.1.raw
  modified_base (657)..(657): a, c, t, g, unknown or other
  misc_feature (657)..(657): n is a, c, g, or t
  modified_base (753)..(753): a, c, t, g, unknown or other
  misc_feature (753)..(753): n is a, c, g, or t
tcagtcgcactagtcacgaccggtgctcgatttagacgtctcatcaaggaagggaaggggcagcaagatggtgttgcagacccaggtcttcatttctctgttgctctggatctctggtcgccgtacggggacatcgtgatcgacccagtcctccacgtactcccgtggctggtcgtctcgtgggcgaggacgggcctaacactaccaacgtcgactaacgtccgacgaccagttacgttagtttaccaacgtacggtaacccaaacgtaaataaaacgtaactttaccgttcgtaccgttacggtaacccgaacgtaaccgaaacggaaaaacccggtaacggaagtaaccccccccccccgtagttaacccgttaaagtttcgtaccttacttaacggtttaccggtacggaccgtaaccgtacccggtaacccgggggtaccgggttcccggggttaccccgtaacgggaccgttaacgtaccgacgggccggtaccggtacgggtccgggttacgtaacggaaccggtaacgtacgttaaccgtttccgtaccgtactaacccgaaccgttacgtacacggtaccgtaccgtcgacgtcggaacggtacgtaggtaacggtacgtgggtacgtaacgttaagtttacttcgtanacgtgtactgttaagttaatacggtctacgtcgtacggttggttaccggcgggaactaggtcgtacggaatacgaaccgtaagtcgtagtcgtacncgaccgtacgtcttcggtattcctctcgtacccg

SEQ ID NO: 41833 - DNA, 674 bp, Homo sapiens
  misc_feature: GYAE6OF01CSZSC.39.1.A01.1.454.CMB.1.raw
  modified_base (224)..(224): a, c, t, g, unknown or other
  misc_feature (224)..(224): n is a, c, g, or t
  modified_base (294)..(294): a, c, t, g, unknown or other
  misc_feature (294)..(294): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (483)..(483): a, c, t, g, unknown or other
  misc_feature (483)..(483): n is a, c, g, or t
tcagtcgcactagtcacgaccggtgctcgatttagacgtctcatcaagggaaggaaggggcagcaagatggtgttgcagacccaggtcttcatttctctgttgctctggtatctcgtggtcgccgtacggggatagtcgtgacgtcgaccctagtctaccacgtacctccgtggcttgtgtcgtcgtgggcgaggacggacctacatacaacgtgacacgtccngacagtagttcgttacacgacgtacaataatactacgttactcgtgtacgacgagacaacgaagacgacncgtacctcgtaagtctactacgtattcgtcgactccgccggtaccggccggttccgcctagacgtctacgcggccgagcggtcggtcaggacaacgtagttccttacgacctcgtacacgtanaccggatccngtcgacgtacgtacgagttaaggagtcggttagtacggtacgtttagttaccgttnccggtcgtaacgtagttaattagtttaacgcgttctacgtcggttacgttaccggggttacgggaccgtaacgtacggttcgtaaggtaccgtaaacgttaaccggaacgttacggttcgggaagtcccgtttaacaacgttcggttacccgtacgttttccgtaaacccttcgtaacccgtttaccccgg

SEQ ID NO: 41834 - DNA, 745 bp, Homo sapiens
  misc_feature: GYAE6OF01B939N.39.1.A01.1.454.CMB.1.raw
  modified_base (157)..(157): a, c, t, g, unknown or other
  misc_feature (157)..(157): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (449)..(449): a, c, t, g, unknown or other
  misc_feature (449)..(449): n is a, c, g, or t
  modified_base (473)..(473): a, c, t, g, unknown or other
  misc_feature (473)..(473): n is a, c, g, or t
  modified_base (503)..(503): a, c, t, g, unknown or other
  misc_feature (503)..(503): n is a, c, g, or t
  modified_base (540)..(540): a, c, t, g, unknown or other
  misc_feature (540)..(540): n is a, c, g, or t
  modified_base (547)..(547): a, c, t, g, unknown or other
  misc_feature (547)..(547): n is a, c, g, or t
  modified_base (704)..(704): a, c, t, g, unknown or other
  misc_feature (704)..(704): n is a, c, g, or t
tcagtcgcactagtcacgaccggtgctcgatttagacgtctcatcgaaggaaggaaggggcagcaagatggtgttgcagacccaggtcttcatttctctgttgctctggactctcgtggtcgaccgtacggggacagtcgtagatacgaccagtccncagtacctccgtggctaggtctctcggtcgggcgaggacggcccaaccatccaaacgtgactaacgccacgtccaggtagttagttaaccagtacgtaacaaactaagtaaagtaacttaccgtcgtacgttagtaacccgagacaacggaaaccaggactacnccgtaacctaaggtcnctacttaacgttcgaggactacgttccggtaacccgggtcggtacccgggtcacggtaacgtcgtacgaggccggtacacgggtacggtactaagggaactaacgaacgttnttaccgacctaccgtacaacgtanacgtacgcgtaacgtccgagtaggaccgtntaaggagtacgttagacggtaaccgtttatttaacgngacgtancgggtaactaagttaacgtaagttacggtaccttacccgtaaggtaacgttttccggggtaggggaaccccgggattaaggtaccgaggtaaccctaacgtaaaccggaaaacgttggtaccgttacggccccggtaaactaccggaaacccgtttnttaccggtactttaaaccccttatccccggtttaaaccccg

SEQ ID NO: 41835 - DNA, 687 bp, Homo sapiens
  misc_feature: GYAE6OF01EHRPI.39.1.A01.1.454.CMB.1.raw
  modified_base (333)..(333): a, c, t, g, unknown or other
  misc_feature (333)..(333): n is a, c, g, or t
  modified_base (418)..(418): a, c, t, g, unknown or other
  misc_feature (418)..(418): n is a, c, g, or t
tcagtcgcactagtcacgaccggtgctcgatttagacgtctcatcaaggaagggaaggggcagcaagatggtgttgcagacccaggtcttcatttctctgttgctctggatctctggtcgccgtacggggacatcggtgatcgacccagtcctccagacctccctggctgtgtctcgtgggcgaggacggccacatacaactgacaacgtccagccagtacgttacgtttacacgacggtaccaaactaataagtaactttacgttcgtacgttacggacctagaccaacgaaaccgagacacgtcctacgtaagtcgacctactatttacgnggctacgtccggtaccgggcggtccggtcccacgtacgtatcgacggcggcgacggtcggtacgaggacgactacgtactttacncttaccgtacaccgtctacgacgtccacgctcggacgaggtctaaggaacgtgtcgtacggtactttaagtttacgttcgttacgtacgtagtacgttattacgttaaggttacgtaccgttaccttaggtaaccggtttaccgggttacggggacccgggtaacgtacggttcggaagggttaaccgaacgttaaccgaaccggttacggttcggacggtaccgcgtaccaccgttagttcctacgtttaccttccgtccttaccccg

SEQ ID NO: 41836 - DNA, 849 bp, Homo sapiens
  misc_feature: GYAE6OF01EE5XD.39.1.A01.1.454.CMB.1.raw
  modified_base (266)..(266): a, c, t, g, unknown or other
  misc_feature (266)..(266): n is a, c, g, or t
  modified_base (321)..(321): a, c, t, g, unknown or other
  misc_feature (321)..(321): n is a, c, g, or t
  modified_base (370)..(370): a, c, t, g, unknown or other
  misc_feature (370)..(370): n is a, c, g, or t
tcagtcgcactagtcacgaccggtgctcgatttagacgtctcatcaaggaaggaacgggcagcaagatggtgttgcagacccaggtcttcatttctctgttgctctggatctcgtggtgccgtaacgggacatcgtgactacgaccccagttcctaccgagtaccttcccgtggctgtcgttctacgtgggacgagaccgggccaaccgtataccaacgtgaccaacgtccagcccaggtcgttacgtttacacgacgtaccaaanaactaagttactttaccgttcgacgttacggtaaccagaccgtaacggaaaaccncggtaacctacgttaccttacgtaagttcgaccttagttacgttacggnggtactacgttacccgggtaccggtacggttcccggtaccgtagaccgttacgtacgaggtcccggagtcgggtaccggtacgtaaggaacgtaccgttacgttactaccgtaaccttcaccggaaaccttgaccacgtacctacgtacccgttagaacggtcggtaacgtaggaacgttacgggttcggtaacggttaaaccgtttaagttttaaccgttaacggttccgttaaacgggtccgtttaagttaaacgtttaacgttttaacggtaacggttaaccccgtttaccgggttaaccgtttaccggggttttaaccgggtttacccggggggaacccggtaaactaccgggttacgggtaaactaaggttaaccgtaacccgggttaaaccgtgtttcggggaacgtcccacgttaaccggaacccctttttgcccgtttacggtttaaaccctcgtttaaccccgttacccg

SEQ ID NO: 41837 - DNA, 523 bp, Homo sapiens
  misc_feature: GYAE6OF02IMB7H.39.1.A01.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaagggaagggaaggggcagcaagatggtcgttgcagacccaggtcttctatttctctgttgctctggatctctggtgcctacgggacatcgtgatgacccagtctccagacttccctggctgtgttactctgggcgagagggccaccatcaactgcaagtccagccagagtgtttacacaggtccaacaataagaattacttcgcttggtaccagcagaaaccaggacagcctcctaagttgctcatttacngggcagtccgtacccgggagtccggggtccctgaccgattcagcggcagcggtctgagacagatttcactctcaccatcagcagcctgcaggctagaagatgtggcagtttattacttgtcagcagtattatagtatcctcagtacgtttaggaccggggtaaccaacgctaggagtatacaaacgaactagtacggctagaccacactctacgtcttctatcccg

SEQ ID NO: 41838 - DNA, 625 bp, Homo sapiens
  misc_feature: GYAE6OF02HDU4X.39.1.A01.1.454.CMB.1.raw
  modified_base (241)..(241): a, c, t, g, unknown or other
  misc_feature (241)..(241): n is a, c, g, or t
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
tcagtcgcactagtcacgaccggtgctcgatttagacgtctcatctaagggtaagggaacggggcagccaaggattcggtgttgctagacccaggtcttcatttctctgttgctctggatctctggtgcctaccggggacagtcgtgagtgacccagtctccgtagactccctggcttagtgtctctgggcgagagggccaccgatcaacgtggcagtcctagccagaggtgttttaccanaggtccaacaactaagaattacttcgcttggtaaccagctagaaaccaggtacagcctctaagtgcgtcattacnggacagtctaccggagtccgggtccngacgattacagcggcaggcggtctaggaacgtacaggtatttcactctcgaaccgatacacgccagtccctcgcgaaggcctagaacgtatagtcggcttagttttacttacgttagtacagcctaagtacttagtacgttagtaccctagtacgtaaccgttttcggggaccggggtaactaaggtccgtagggtacgtattaccgaaacggtacgttcggtacgggtccgttcggaccttaccgtacgttccgttcggttaccttaccggtacttccccgg

SEQ ID NO: 41839 - DNA, 515 bp, Homo sapiens
  misc_feature: GYAE6OF02I522G.39.1.A01.1.454.CMB.1.raw
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (438)..(438): a, c, t, g, unknown or other
  misc_feature (438)..(438): n is a, c, g, or t
  modified_base (497)..(497): a, c, t, g, unknown or other
  misc_feature (497)..(497): n is a, c, g, or t
tcagtcgcactagtcacgaccggtgctcgatttagacgtctcatcaagggtaaggaaggggcagcaaggatggtgttgcacgacccaggtcttccatttctctcgttgctctggatcctcctggtgcctacggggacatcgtgatggacccagtctccagactccctggctgtgtctctgggcgagagggccaccatcaactgcaagtccagccagagtgttttacacaggtccaacaataagaattacttcgcttggtaccagcagaaaccaggacagcctccctaagttgctctatttactgggcatctacccgggagtccggggtccctgaccgattcagcggcagcgggtctgagacagatttcactctcacatcagcagctgcagctgaagatgngcagttnttaactncagtcagttattatagtagtcttnagtactttggcccgggggtacaacgctggagtatcgaaacgattacgtggcttgcgacngtactcgcttcattcccg

SEQ ID NO: 41840 - DNA, 494 bp, Homo sapiens
  misc_feature: GYAE6OF02IIMRF.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctcagtactttggccggggaccaagctaggagatcaaacgactgtggctgcacatctgtcttcatcc

SEQ ID NO: 41841 - DNA, 526 bp, Homo sapiens
  misc_feature: GYAE6OF02HWMEJ.39.1.A01.1.454.CMB.1.raw
  modified_base (266)..(266): a, c, t, g, unknown or other
  misc_feature (266)..(266): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccgagagtgttttacacaggtccaacaataagaattacttcgcttggtaccagcagaaaccnggacagcctcctaagttgctcatttactgggcatcgtacccgggagtccggggtccctggaccgattcgaggtcggcagcgggtctgagacagattcactctcaccatcagcagcctgcagctgaagatgtacgctagttattactgtcagctagtatatagtacgtctacagtacgtttgggaccggggacaaggcgtaggagtatacgtaacgaacgtggtacggctagaccaccgtagtccgtagtcttcattcccg

SEQ ID NO: 41842 - DNA, 697 bp, Homo sapiens
  misc_feature: GYAE6OF02JX2FY.39.1.A01.1.454.CMB.1.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (359)..(359): a, c, t, g, unknown or other
  misc_feature (359)..(359): n is a, c, g, or t
tcagtcgcactagtcacgaccggtgctcgatttagacgtctcatcaagaaggaagggcgagcaagatggtgttgcagaccaggtcttcatttctctgttgctctgatctctggtgcctacgggacatcgtgatgacccagtctccagactccctggctgtgtctctggcgagaggccacatcaactgcaagtccagccagagtgttttacacaggtaccanaataagattactcgcttggtaccagcagaaacnggacagcctctaagttgctacatttacaggcagtctacccgggagtcccggggtcctacgaccgattacgagcggacacggacggttccgtggaagaccgtaagngtttacctacgcgttaccaccgaattccgacggtacaacggtcctcggtaccgagggtaccttaggaaacggtacgttacgttacggggacttacgggttttaacttacggttacttacggaacgtccggtaacgttatttaagttaaggttaccgttacctaccgtacggtttaacgttttaccgggcccgggggtaaaccgtaacggtaccgttaagggtaccgtacgggttaacctaaaacccgggtacgttaacgggttacggtaccggtttacgacccggtaccttaaccggttctttaccgggtttactttaccccggttatttacccccgg

SEQ ID NO: 41843 - DNA, 592 bp, Homo sapiens
  misc_feature: GYAE6OF02GS837.39.1.A01.1.454.CMB.1.raw
  modified_base (300)..(300): a, c, t, g, unknown or other
  misc_feature (300)..(300): n is a, c, g, or t
tcagtcgcactagtcacgaccggtgctcgatttagacgtctcatcaaggaaggtaaggggcagcaagtaatggtgttgcagacccaggtcttcatttctctgttggctctggatctctgggtgcctacggggacatcgtggatgacccagtctccagactccctggctgtgtctctgggcgagagggccaccatcaactgcgaaggtccagccaggagtgttttacactaggtccaacaataagaattactcgcttaggtaccagcagaaccaggacagcctcctaagtgctcatttacngggcatcgtacccgggagtccggggtcctggaccgattcaagcggacagcgggtctagagacagatttcactctacactatcagcagcctgcacggctaggaagagtggtacggctagtttacgttacgtgtacgacgctaagttattagtagttacgtcctactacgtacgtttacggggcccggggtaactaacggtccgtacggtacgtaccgtacgtaaaccggtaacgttacggtacggcgtacggaccctaccgtacgttccttcggtaccttccgacgttccccg

SEQ ID NO: 41844 - DNA, 532 bp, Homo sapiens
  misc_feature: GYAE6OF02IATPH.39.1.A01.1.454.CMB.1.raw
  modified_base (394)..(394): a, c, t, g, unknown or other
  misc_feature (394)..(394): n is a, c, g, or t
tcagtcgcactagtcacgaccggtgctcgattttagacgtctcatcaagggtaagggaaggggcagcaagatcggtgttgcagacccaggtcttcatttctctgttgctctggatctctggtgcctacggggacatcgtgatgacccagtctccagactcccctggctgtgtctctgggcgagagggccaccatcaactgcaagtccagccagagtgttttacacaggtccaacaataagaattacttcgcttggtaccagcagaaaccaggacagcctctaagtgctcatttactgggcatcctacccgggagtccggggtccctgaccgattcagcggcagcgggtctggagacagatttcactctcaccatcagcagcctgcggctgaagntgtgctagtttattacgtgtcagcagttattatagttagttcctagtacgtacgttttcgggaccggggtaccaaggctaggagatacgaaacgtacgtggtagctcgcacgactcgtgttccttctacttcctcccg

SEQ ID NO: 41845 - DNA, 635 bp, Homo sapiens
  misc_feature: GYAE6OF02F1DN8.39.1.A01.1.454.CMB.1.raw
tcagtcgcactagtcacgaccggtgctcgatttagacgtctcatcaagggaaggaagggggcacgcaagatggtgttgcagtacccaggtcttcatttctctgttgctctggatctctggtgcctacggggactatcgtgatggtacccagtctccagtactccctggctgtgtctctgggcgagagggccaccatcgaactgcaagtccagccgagagtgtttacacaggtccaacaataagaattacttcgcttggtaccagcagaaaccaggacagcctcctaagttgctcactttaactgggacatacgtacccgggtaggtccggggtcctggaccgatttcagcggcaggcgggtctggagacagtatttcactctcaaccatcgagcacgcctgacacggctaggaaagtactaggtcggactaagtttaacttaacgttgtactaggtcctaagttattaacgtagttacgttccctagtaaggttaccggttttacgggggaccggggtaacctaaaggtcgtacgggtaacgtagtaaccggaaaacggtaacgtcgggtacggtaccgttacgtacctacccgtacgttccgttacggttccgttaccgtacgtttacccccgg

SEQ ID NO: 41846 - DNA, 531 bp, Homo sapiens
  misc_feature: GYAE6OF02IL9CW.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcagtccgtacccggggagtccggggtccctgaccgattcaggcggcagcgggtctgagacagatttcactctcacatcagcagcctgcgaggctagaagagtgtggctagtttattactgtcagtctagttattaatagtagttcctctagttacgttttcgggaccggggtaaccaggcgtgacgatacgaaacgtactggtggctcgctaccagtcttcgtcttacattcccg

SEQ ID NO: 41847 - DNA, 701 bp, Homo sapiens
  misc_feature: GYAE6OF02FSIBO.39.1.A01.1.454.CMB.1.raw
  modified_base (321)..(321): a, c, t, g, unknown or other
  misc_feature (321)..(321): n is a, c, g, or t
tcagtcgcactagtcacgaccggtgctcgatttagacgtctcatcgaaggtaagggaaggggcagccaagatgggtgttgcagacccgaggtcttcagtttcctctgttgctctgggatctctggtgcctacgggacatccgtgatgacccagtctccagactccctggctgtgtctctcgggtcgagagggtccacctatcgaacgtgcaagtccacgccagagttgttttaccgacaggtccaacgtaattaacggattaccttcgtcttcggtacctagacaaggaaccaggaccagcctctaagttgctcacttacnggcagtctacccgggacgtcccggggtcctgaccgtattccaggccggcagggcggggtctgacgactagtactttcacttcacaccctagtccgacgtacaaggtcccttgcgacggtaccttagtaacgtattcggtacggtacctaaggttttaactttaccgttagttacgtacggtacccttaagtttaacgtttttaggtacggttaacgggttacccttaccggtacggtttaaccggtttttaacggggaccccgggggttaaaccaaacggtcggttacggggacgtacgtaccgaaaaccggtaacgttacggttacgggtccttacggacctacccgtaccgttccgttacgtcctttacaacttcccg

SEQ ID NO: 41848 - DNA, 510 bp, Homo sapiens
  misc_feature: GYAE6OF02F4KDV.39.1.A01.1.454.CMB.1.raw
  modified_base (478)..(478): a, c, t, g, unknown or other
  misc_feature (478)..(478): n is a, c, g, or t
tcagtcgcactagtcacgaccggtgctcgatttagacgtctcatcaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctacagtacgttttgggccggggtaccaagcgtaggagatacaaacgacgtggnggtctgcacactctcgtcttctctccttcccg

SEQ ID NO: 41849 - DNA, 522 bp, Homo sapiens
  misc_feature: GYAE6OF02GGOIY.39.1.A01.1.454.CMB.1.raw
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
tcagtcgcactagtcacgaccggtgctcgatttagacgtctcatcaaagggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttacngggcatctacccggngtccgggtcctgaccgattcagcgcagcggtctgagacagatttcactctcacatcagcagctgcaggctagaagagtgtggactagtttattacgttgtacagctagtatatagtagtcctcgagtacgtttcgggaccgggtaccagtcgtgagtatacgaacgtaacgtgtacggtcgtgaccacgtagtccgtacgtcttactattcccg

SEQ ID NO: 41850 - DNA, 793 bp, Homo sapiens
  misc_feature: GYAE6OF02JZUDU.39.1.A01.1.454.CMB.1.raw
  modified_base (238)..(238): a, c, t, g, unknown or other
  misc_feature (238)..(238): n is a, c, g, or t
tcagtcgcactagtcacgaccggtgctcgatttagacgtctcatctaaggaaggaaggggcgaggcgaaccgactgggttcgttggcgtagacccaggttcgttcatttctctgttgctctggatctctggtgcctacggggacattcggtgatgaccctaggttctcctagactcccttggctgtgtctcgtgggcgagagggccaccgagtcaacgtggcgaacgtccacgcacgnggttcgtttacgacaggtccaacgtaataaggaaacttacgttccgcgttggtaacctagtacctaagaaaacccgtaggtaacacggtaccctaccgtaaagttcgcctacgtaccgttttaaccgagggcctaacggtaccggtaacccgggggtacggttacccgggggtacccttacgggtacccggtaactttcggaaacggtcgggtaccaaagggtcgggtacgtacggtaaggaaccaaggttactttaccgtaactctacctaaccctattccgaagaccgggtacaccgtaggtcgaacgtacgtcggtaaacgaggtacggtacggtaaccgtaagtttaaccttaacggttcgtacgtacggtactaacgttagttaacgttagtaccggtcctacgtaagttacggtttacggccggggtaaccgaaggtccgttagggacgtacgttacgtaaaccggtaacggttaacgggtcggtaacgtacggtaacgacccgttaaggttaccgttaggttaccggttcggtaaaccgttccccggg

SEQ ID NO: 41851 - DNA, 499 bp, Homo sapiens
  misc_feature: GYAE6OF02IJHYJ.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcgcagcgggtctgagacagatttcactctcaccatcagcagcctgcgaggctgaagatgtgcagttattactgtcagctagtattatagtatctcagtacgtttggccggggaccaagcgtgagatacaacgaactagtgctgcaccagtcctagtcttcatcccg

SEQ ID NO: 41852 - DNA, 550 bp, Homo sapiens
  misc_feature: GYAE6OF02FWWFB.39.1.A01.1.454.CMB.1.raw
  modified_base (303)..(303): a, c, t, g, unknown or other
  misc_feature (303)..(303): n is a, c, g, or t
tcagtcgcactagtcacgaccggtgctcgatttagacgtctcatcgaaggaagggaaggggcagcaagattggtcgttgcgagacccagggtcttccatttctctgttgctctggatctctggtgcctacgggaccatcgtgatgacccagtcttccagactccctggctgtgtctctgggcgagagggccaccagtcaactgcaagtccagccagagtgtttacacaggtccaacaataagaattacttcgcttggtaccagacagaaaccaggacacgcctcctaagttgctcatttacgnggcatctacccgggagtccgggtcctgaccgattccagcgcgagcgggtctgagacagatttcactctcaccatcagcagcctgcaggtctgaacgagtgtggtctagtttattacttgtcgagcagtatagtagtacgtcctctagtaccgtttcgggcccggggtaaccaaggcgttagggagtgtaacgaacgaacgtaggtacggtcgtacgcctacctactaccgtgtccttctacttcccg

SEQ ID NO: 41853 - DNA, 561 bp, Homo sapiens
  misc_feature: GYAE6OF02GIS1Q.39.1.A01.1.454.CMB.1.raw
  modified_base (292)..(292): a, c, t, g, unknown or other
  misc_feature (292)..(292): n is a, c, g, or t
  modified_base (394)..(394): a, c, t, g, unknown or other
  misc_feature (394)..(394): n is a, c, g, or t
tcagtcgcactagtcacgaccggtgctcgatttagacgtctcatcaaggaaggaaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacngggcatcgtacccgggagtccggggtcctgaccgattcagcggcagcggtctggagacagtatttcactcacaccatcagcagcctgcaggctagaagatgngactagtttatacgtgtacagctagtattagtagttagtcctagtacggttacgttttcggggaccggggtaactaacggtcgtagggaagtacgtacgaaaacggtacgttaggtcggcttacgacctaaccgtacttacgttacgttacctttacactttacccg

SEQ ID NO: 41854 - DNA, 656 bp, Homo sapiens
  misc_feature: GYAE6OF02JSG9W.39.1.A01.1.454.CMB.1.raw
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
  modified_base (396)..(396): a, c, t, g, unknown or other
  misc_feature (396)..(396): n is a, c, g, or t
tcagtcgcactagtcacgaccggtgctcgatttagacgtctcatcaagaaggaagggcgagcaagatggtgttgcagaccaggtcttcattctctgttgctctgatctctggtgcctacgggacatcgtgatgacccagtctccagactccctggctgtgtcttcttggcgagagggccaccatcaactgcaacgtccagtccagacgttgttttacacacggtaccaaccaataacggaatttaacctcgcttggtacctagctagaaaccaggaccaagcctactaacgttgcgtctactttactgggctagtctaacccggngtccgggtcctcgacgntcacgtcggcgagcgggtctggagacgagtacgtttcgacttcgtccaaccgtntacccgtagaccacgccctagaccgacggtcctaaggtaagacgtttggacggtacgtacgtttttaacttacggttacgttccgtaagccgtaaaggtttactaacggtttaagtaccgttccgtaccgtagtttaccggtttacgggaccccggggtttaacgaacgttacggcgggtaagactaacggtaaccggaacgtttaggtcgtaccggtacgtcccaacgacgttcttacggtccgttttacattaccccg

SEQ ID NO: 41855 - DNA, 717 bp, Homo sapiens
  misc_feature: GYAE6OF02HXUMI.39.1.A01.1.454.CMB.1.raw
  modified_base (337)..(337): a, c, t, g, unknown or other
  misc_feature (337)..(337): n is a, c, g, or t
tcagtcgcactagtcacgaccggtgctcgatttagacgtctcatcaaggaagggaaggggcagcaagatggtgttgcagacccaggtcttcatttctctgttgctctggatctctggtcgccgtacgggacatcgtgatcgacccagtctccagactcccgtggctgtcgtctcgtgggcgagcggccacatcaacgtgacaacgtccacgaccaggtacgttacgtttaacacgtacggtaccaaacaaagtaaagtaatttacgttcgtacgttacggtaccacgacaaacgaaaccaggacacgtccctacgtaagtcgctactacgtttacgngggacctagtccgtacccggggacgttccccggggtccctacggacccgtattacgacggccggcgacggtcgggtactggacgacgagtactttacgtacctcgaccaacctataccgagtccgacgtacccgtcggacgacggtccgtaaggaaagttacgtgggtacgttactaaggtttttaacttacgttgtacgtacgtacttaagttattaacgtttagttacccgttactaccgtacgttttacgggttccggggaccggggtaaacaacggtccgttaagggacgtaacgtaccgaaacggtacgttacgggtagaccgttagacccgtaacgtacttccgttacggtttccttaccgtaccgttaccccg

SEQ ID NO: 41856 - DNA, 593 bp, Homo sapiens
  misc_feature: GYAE6OF02GNIM3.39.1.A01.1.454.CMB.1.raw
  modified_base (318)..(318): a, c, t, g, unknown or other
  misc_feature (318)..(318): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacaggtccaacaataagaattacttcgcttggtaccagcagaaaccaggacagcctactaagttgctcattacgtgggcatcgtacccggagtccgggtccngaccgtatcagcgcagcggtctgagacagtatttcactctcaccatcagtcacgcctgacgaggcctaggaagagtgtggactagtttacgttaacgtgtacgagtctaagttatttaactagttagtaccctacgttaagtacgttttacggggaccggggtaaccctaaggtaccgttaggaacgtacgttaccggaaaacgtaacggtaggtacggtaccgtagtaccctaccgtaacgttccgttacgttcccgttacctctttacccccg

SEQ ID NO: 41857 - DNA, 687 bp, Homo sapiens
  misc_feature: GYAE6OF02HTG5K.39.1.A01.1.454.CMB.1.raw
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
  modified_base (344)..(344): a, c, t, g, unknown or other
  misc_feature (344)..(344): n is a, c, g, or t
tcagtcgcactagtcacgaccggtgctcgatttagacgtctcatcaatgaagaagggacgagcaagatggtgtgcagaccaggtctcattctctgttgctctggatctctggtgcctacggggacatcgtgatgacccagtctccagactcccgtggctgtgtctctgggcgagagggccacatcaactgacaagtccagcagagtgtttancaggtccaacataacgaattactgctgtacnacanaacagacagtcacctaagtcnctactattaactggccatcaccggtataccggggtccctgacccgatttaccgacgccggcacggaccggttccgngtaaggaccaagggtaacttcgtaaacctttctaaccctacgaaactcccaagttaacgaccgggtcctacgtccggaaccggtaccggttaagaaacggtaacggtacgtacgggtacttaacgtttaaacgttaacgtttacgtactaacggtactaaggtaacgttaacgttaaacggtttaacgtacccgtacgtaacgtttaaccggttttacgggacccggggggtaaaccaaaccgggttaatcgggtaaagtcggtaaaccgtaaaacgtaacgtcggtaacgggtacccgtcgtacccgaaaccgttacttacggttacgttacgttacctacg

SEQ ID NO: 41858 - DNA, 939 bp, Homo sapiens
  misc_feature: GYAE6OF02GBWQC.39.1.A01.1.454.CMB.1.raw
tcagtcgcactagtcacgaccggtgctcgatttagacgtctcatcaagggaaggaagggcaggcaagatcggtgttgcaggaacccaggtccgttctactttcttcgtgttgctctggatctactggtgcctacgggacactcgtgattggacccagtctccaggtacctcccttggctgttagtctctcgggcgagacgggccgaccatcaactgcaagtccaggccagagtcgtttacacaggtccaacaataacgattacttcgcttggtaccagcagtaaaccaggtactagcctcctaagttgctcactttacgtcgggccactccgtaacccggggacggtacccggggggtccccttgggaacccggtagtttccgaacggtccgggtactaacggtcccggggttacttaggaagtaaccgacggtaacttttaccgtaaaaccttccttaccgaaccctaacgttacccgtaacggtaccgtaaacgggtccccttacggtacccgaaacgggtaccctttaacgggaaaaccggtaacgtttacggggtaaccgggtaaacccgtttaaaccgggtttttaaaacgtttaaacccgtttacgggttacccgttaaacgggttacccttaaacgggtttaaactttttaaaacggttaaaacggttttaaaccgggttaacccctttaacccggtaaaccgggtttaaccgggtttttttttaacggggggtaaccccggggggggttaaaacccctaaacggggttacccgggtttaaacggggaaccggttaacgtttaacccggtaaaaacccgggttaaaccgttttacgggttacgggggtaccctttacgggaacccgtaaacccgttaacgtttacccggttaacgggtttcccgttttaacccgaacgttttaacccccggg

SEQ ID NO: 41859 - DNA, 848 bp, Homo sapiens
  misc_feature: GYAE6OF02I9O9V.39.1.A01.1.454.CMB.1.raw
tcagtcgcactagtcacgaccggtgctcgatttagacgtctcatcaaggaagaagggcgagcaagatggtgttgcagaccaggtcttcatttctctgttgctctggatctctggtgcctacgggacatcgtgatgacccagtctccagactccctggctgtgtctactgggcgagagggccacctactcaaactggacaagtcccagcccagacgtgttttaacacgaggtccccaaacgaattaacgaaatttaaccttcgccgtttaggttaccacggactaggaaaacccaacggaaccgaagtaccgttccctaaacgttttacggaccttccgtaactttttaacgtcggggtacctaacgttccttaacccgggtacggttaccccgggggttccccgttacggtacccggttaacgttccgtacgggtaccggtaccgaggtccgggggttaccgtcgggttacgaaccggtagtaaactttcgtaaccgttccgtacgtaacccacttccgaacgtacgaacgtacccgtacggttaccgacccggtacgttccggaaaaggtacctttaggtacgggtacgttaacgggtttttaacgttttactttaacgggttacccgttaaagggcctttaaaggtttaaaccgtttaagttaacggtttaaacggttcccgtttactaacggggtttacccgtttacgggggttaccggggtaaacccgggaacggttaccgttaacgggggattacggtaacggtaaaccgtaaacggtcggttagtaaccggtgaaccgtcccgtaaacgttcgtttaccgtacctttgaaccgttttacccg

SEQ ID NO: 41860 - DNA, 627 bp, Homo sapiens
  misc_feature: GYAE6OF02H3PB4.39.1.A01.1.454.CMB.1.raw
  modified_base (288)..(288): a, c, t, g, unknown or other
  misc_feature (288)..(288): n is a, c, g, or t
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattacttcgcttggtaccagcaagaaaccaggacagcctctaagttgctnattactggcatctacccgggagtcccgggtcctgaccgtattcagcggcagcgggtctgacgacagtactttcactactccgaaccattccgaagccaacggtccctggccgagggtcctaggaaaggtacttgggtacgtacgttagttttaactttacttgttacaggtctacgttaattaagttagtacttcccgtagttacggttaccgttttcgggggacccggggtaaccaaggttcgtagggtaagtacgttaacgaaaccggtaacgttcgggtggtaccgtccggacctaaccgtacttccgttaccggttacttccgtactttaccccg

SEQ ID NO: 41861 - DNA, 581 bp, Homo sapiens
  misc_feature: GYAE6OF02GXEDV.39.1.A01.1.454.CMB.1.raw
  modified_base (300)..(300): a, c, t, g, unknown or other
  misc_feature (300)..(300): n is a, c, g, or t
  modified_base (465)..(465): a, c, t, g, unknown or other
  misc_feature (465)..(465): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacgggacatcgtgatgacccagtctccagacctccctggctgtgtctcgtgggcgagagggccaccatcaactgcaagtccagccagagttgttttacacaggtaccaacaataagaattacttcgcttggtaccagcaagaaaccaggacagcctacctaagttgctctatttacgngggcattccgtacccggggacggtcccggggtccctggacccgtattcaggccggcacgggccggggtctggagacaggtactttcactctaccaccatcagcagcctgcagctagagatgtgctagtttattactgtacagactagttattatagtagtccctntagttacgtttcgggacccggggacctagacgtggagtactaacgtaaaccggtacttcggacggtccgtagacccgtaccgtacgttccgttcgttaccttccgtactttccccg

SEQ ID NO: 41862 - DNA, 655 bp, Homo sapiens
  misc_feature: GYAE6OF02JS4TV.39.1.A01.1.454.CMB.1.raw
  modified_base (435)..(435): a, c, t, g, unknown or other
  misc_feature (435)..(435): n is a, c, g, or t
tcagtcgcactagtcacgaccggtgctcgatttagacgtctcatcaaggaagggaaggggcagcaagatggtgttgcagacccagtcttcattctctgttgctctggatctctggtgcctacgggacgatcgtgatgacccagtctccagactccctggctcgtgtctctgggcgagagggccaccatcaactgacaagtccagccagagtcgttttacacaggtaccaacaaataagtaattaacttcgtcttcggtaccagacaacgaaaaccaggaacacgacctacctaaagttcgctactacgtttaacgtgggcctattacccgtaccggggtaccggttacccggggtcccctaggaaccgtactttacgacgcgggacgtaggtccgggtctacggagtacagtatttcacgtctcaactatccganctacgcctgacgaggtctaagaagtacgtggtcggacttagttttactacgtcgttacgagtacctagttaatttagtacgttacgtcctgtaaggtttacccggtttacggggaccgggaactactcggtaggtacgagttaacccgaaacggttggttcacgggccgtttacaaccgtaccttagtttcccgtagtttccttacccgacctttacccg

SEQ ID NO: 41863 - DNA, 612 bp, Homo sapiens
  misc_feature: GYAE6OF02IH7U6.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattacttcgcttgtaccagcaagaaaccaggacagcctctaagtgctctattactgggctatccgtaccggggacggtcccggggtcccctggtacccgtacttcgacggtccggcacggccggggtctaggagaacgagtactttcacctcttaccgacctatccgagccacgtcccgtgccgagggcctaggaactagtggtacggtacttacgtttattactgtaccagactagttacttaattgtacttcgtactagttacgttttcgggacccggggtaacgtacgcggtcggtagactaacggaaacgtaacgtcggtcggtactagaccctaccgtaacgttccttacggtacctttcacgttccccg

SEQ ID NO: 41864 - DNA, 905 bp, Homo sapiens
  misc_feature: GYAE6OF02JCETL.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatgacccagtctccagactccctggctgtgtctcgtgggcgagacgggccaccgatccaaaccgtcgaacgtaccgtacgaccgtacgaggttacgttttactaaccgaacggtacccgtaaaccaaagtaaagtaaacgtttaacctttaccggtacgttacggttaccgtaacgacaacggtaaaacccgaacgggaaccgaaccggtacccgttaccccgttaaacggtttacgtaccgttaccgtaactttttaaccgttacgggggtccgtaagttacccgttaccccgggggtaaccgggttacccggggggtttacccccgttaccggtaaccggtaacctttacccggtacgggacgggtcccggaacggtaccggggttaccgttacggtaagggaaccgaacggtaacgttttacctaacgtccttaccgaacccgttaactccggtaacgaccggtacctaccgtcggtacgggaaccggttaccgaaggtaaaccggtcgttgggtaccgttaaggttacttttaaaccgttccgtagtaccgaaagtcccgggttaaatttacggtttttagaaacgggtttccgttaacctcccgtaacggttttacggggtttacccgggggacccggggtaaaccttaaacggtcggttaacgggagttaaacgtaaaccgtaaccggtaacggtggttaacggtcctaacggcccgtaacttacgtgtttccctacggttcttaccttccccggttaacccg

SEQ ID NO: 41865 - DNA, 835 bp, Homo sapiens
  misc_feature: GYAE6OF02IFM8Y.39.1.A01.1.454.CMB.1.raw
tcagtcgcactagtcacgaccggtgctcgatttagacgtctcatcaagggaacggaagggaccagcaacgactggtgttagcccagacccaggtccttaccacctttcctctggttgcgtccttgggatctcctggtttggccgtacgggacatcgtgactggacccacgtcctcccaggtacctccctggtctgtcgtctctggggcgaggagggccaaccgagtccaacgtcgcaagtccaagtcccagagttcgtttacacgaggtaccaaactaactaagaagttactcgcttaggtacctagcgtaaggaaaccacgggacaccggaccctaaccgttaaggttcgcttacgtatttaccggaggggtacctagtacccgtaacccggggtacggtccccgggggtaccctacggtaacccggtatttaacccgaaaacgggtccggtacgaacgggttaccggggttacctacggggacgtaaacccgtaagggttacctttaacccgttaaccgtaccggtacccaacccctaagttacccgtaaccggaccgtaaccgtttacccgttacgtaaccgtaacgggtaccgtaggtaaaggtagtacggtcggtaccgttaggttttaacgttaacgttccggttaacgacggtacgttaacgtttaattaacgttaagtttacgtaccgttacgtaccggtttaccggtttacggggtacccggggtaacgtacggtacgtaggtacgtacgttaacgtaaaccggtcttacggtacggtcgtacggtacctaccgtacgttccgttacgtccttaccgtcttacccg

SEQ ID NO: 41866 - DNA, 556 bp, Homo sapiens
  misc_feature: GYAE6OF02F31JO.39.1.A01.1.454.CMB.1.raw
tcagtcgcactagtcacgaccggtgctcgatttagacgtctcatcagggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttacgcttggtaccagacagaaaccaggacagcctcctaagttgctcatttactgggcatccgtacccgggagtccggggtcctgaccgattcgagcggcagcggtctgagacagtatttcactctacaccgatccagcagcctgcaggctagaacgtatgtggactagtttattacgtgtcagtcgaagttattattagtagtacctactagtacgttttacgggcccggggtaacaacgtcgtaggatacgtacgaaacgtaacgtgtacggtacgtcgaccgacgtacttacgtacgttcttacacttaccccg

SEQ ID NO: 41867 - DNA, 636 bp, Homo sapiens
  misc_feature: GYAE6OF02IZIFM.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgtttacacagtccaacaataacgaattactcgcttcggtaccagacagaaaccaggacagccctacctaagtgctctactttacgcgggctagtccgtacccggggtacggtcccggggtcccctagaccgtacttcgacggccggccgtaggccgggtctacgagaacgtagtactttcacttcactaccatcgacgcacgtctcgacgacggtctacggaagtagtacggtcggtacgttaacgtttacttacgttgtacagtactagtttatacgttagtacgttaccgtcgtaacgttaccggttttacgggacccggggtaaactcggtaacgtagggacgtacgttaacgaaacggtacgtacggtacggtacgtagaccctacgtacttcgtacgtttccttactacgttacccg

SEQ ID NO: 41868 - DNA, 667 bp, Homo sapiens
  misc_feature: GYAE6OF02IGY4O.39.1.A01.1.454.CMB.1.raw
tcagtcgcactagtcacgaccggtgctcgatttagacgtctcatcaaaggaaggaaggggcagacaagactggtgttgcagacccaggtcttcatttctctgttgctctggatctctggtgcctacggggtacatcgtgatgacccagtctccagactccctggctgtgtctctgggcgagacgggccaccatcaactgcaagtccagccagtgtgttttacacaggtccaacaataagaattacttcgactttggtacccagtcaagaaaacccagggacagccccttaccgtaaacgttggcctacgtattttaccgtaggggctattcggtaaccccggggtaggttccccgggggtccctggacccgattcaggcggacaggcggggtctggagacaggtactttcacgtctacgaccaatccgagccagcctgcaggcctaggaacgtgtaggtcggacgtaagttttacttaccgttagttcgagtctaaggttatttaacgtagttacgttaccgtactaaggttaccgttttacggggacccgggggtaacctaaggtccgttagggagtacgtaccgaaaacggtacgttaggtacgggtcgtaccgaccgtaacccgtagttccggttaccgttactttacccgtactttcccccgg

SEQ ID NO: 41869 - DNA, 599 bp, Homo sapiens
  misc_feature: GYAE6OF02HK0HV.39.1.A01.1.454.CMB.1.raw
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
  modified_base (411)..(411): a, c, t, g, unknown or other
  misc_feature (411)..(411): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatgacccagtctccagacctccctggctgtgtctctgggcgagacgggccaccatcaactgacaagtccagccagagttgtttacacgacggtaccaacgaataagtaattacttcgcttaggtaaccagtacaagaaaccaggacacgcctctaagtgctacatttacgnggacactccgtacccgggaggtcccgggtccngaccgattcaggtcggcgacggtccgggtctaggacgtacgaggttactttcgactctaccacctatcgacncgacgcctcgcgacggactagaagagtaggtgacgttagtttacttacgtgtacgagtactagttattagtagtcgtacctacgtacgttcgtttacgggaccgggttacacggtcgtaggagtactacgaacgtagtaggtacggtactacgaccgacgtagtccgttacgttcctactattccccg

SEQ ID NO: 41870 - DNA, 556 bp, Homo sapiens
  misc_feature: GYAE6OF02F7JQX.39.1.A01.1.454.CMB.1.raw
  modified_base (389)..(389): a, c, t, g, unknown or other
  misc_feature (389)..(389): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcagaggccaccatcaactgcaagtccagccagagtgtttacacaggtaccaacaataagaattacttcgcttgtaccagcaagaaaccaggacagcctcctaagttgctcatttactgggcatcctacccgggagtccggggtccctgaccgattcagcggcagcgggtctgagacagatttcactctcacatcagcagcctgcaggcagaagtntgtgctagtttattactgtacagactagttatttaagttacgttagtcctacgtagttaccggttttacggggaccggggtaaccaacggtccgtagggaacgtagtaaccgaaacgtaacggtagtacggtctagccgacctactcctgttccttctacttccccg

SEQ ID NO: 41871 - DNA, 682 bp, Homo sapiens
  misc_feature: GYAE6OF02HAT51.39.1.A01.1.454.CMB.1.raw
  modified_base (220)..(220): a, c, t, g, unknown or other
  misc_feature (220)..(220): n is a, c, g, or t
  modified_base (297)..(297): a, c, t, g, unknown or other
  misc_feature (297)..(297): n is a, c, g, or t
tcagtcgcactagtcacgaccggtgctcgatttagacgtctcatcaagggaaggaaggggcagcaagatgggtgttgcagacccgaggtcttcatttctctgttgctctggatctctggtgcctacggggacatcgtgatgacccagtctccagactccctggctgtgtctctgggcgagagggccacatcaactgcaagtccagccagagttgtttacncaggtccaacaaataagaattacttcgcttggtaccagcagaaaccaggacagcctacctaagttgctcatttacgngggcatccgtacccggggagttccccggggtccctggaccgtattcgagccgggcaggccgggtctggaacgtacgtagattttccactccgttcaccattcagctacgccgtcgcgacggtcgtaggtaagaacgttggttacggtacgttaacgttttaacgtttacgttacgtacgtacggtctaacggtttaagtttacgttaagtaacgttccttacgtacggtttaacggtttttccggggacccgggggtaaccgtaacggtccggttagggacgtactaccgtaaaaccgggtaccgttacgggcgggtaccgttacggacccgttacccgtacgttaccggttcggttacctttaccgtacccgttttaaccccgg

SEQ ID NO: 41872 - DNA, 616 bp, Homo sapiens
  misc_feature: GYAE6OF02G5QI1.39.1.A01.1.454.CMB.1.raw
  modified_base (283)..(283): a, c, t, g, unknown or other
  misc_feature (283)..(283): n is a, c, g, or t
  modified_base (398)..(398): a, c, t, g, unknown or other
  misc_feature (398)..(398): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctctaagttgctnatttacgtggcatctacccgggagtccccgggtcctgaccgtattcagcggacaggcggtctgacgacagtatttaactcgtacaccctatcagcagcctgcacggctagaagtntggtaggactagtttactacgtgtacagactagtattataagtcgtaccttacgacgttacgttttcggggacccgggggtaacctaagggtccgtaacgggtaagtaacgtaaccggtaaaaccgtaacgggttggtaccgggtacgtaccggtaccctaaccgttaaggttccgtttaccgttaccgttacccgttacgttaccccgttacccccg

SEQ ID NO: 41873 - DNA, 684 bp, Homo sapiens
  misc_feature: GYAE6OF02HG3XF.39.1.A01.1.454.CMB.1.raw
  modified_base (332)..(332): a, c, t, g, unknown or other
  misc_feature (332)..(332): n is a, c, g, or t
  modified_base (368)..(368): a, c, t, g, unknown or other
  misc_feature (368)..(368): n is a, c, g, or t
tcagtcgcactagtcacgaccggtgctcgatttagacgtctcatcaaggaggaaggggcagcaagatggtgttgcagacccgaggtcttccagtttctctgttgctcgtggtatcttctaggtcggccgtacggggactagttcggtaggacgtcgaccctaggtcctccaggacctcccgtggctgtcgtctcgtgggcgaggacggccacctataccaacgtgacctacgtcacgtccagtagttcgtttacacgtacggtaccaaactaaagtaagtaatttacttccgtcgttacggtaccgtacgacgaacggtaaaccgaggaacncgaccttactaacggtcgtacctagttagttaccgngggtacctacgttaccggtacccggggtcggttccccgggtaccctcggtaccgtacttcgaccggcggtacgacgggtcgtcgtacgaacgcgtagtgttaccgtacgtaccgtaccacctactcgacgcgacgtccgtgcgacggtctagagtgtgtacgtcttaagttctctacgtacacggttactagtttacattacggtacgtcttacggtagttcggttcgggaccggtacacgtcgagtacacgaagtaccgtaaggtccgtacgtcgaccgtactacgcgtttacctcgttaccgtctacccgtccc

SEQ ID NO: 41874 - DNA, 875 bp, Homo sapiens
  misc_feature: GYAE6OF02HQJIH.39.1.A01.1.454.CMB.1.raw
tcagtcgcactagtcacgaccggtgctcgatttagacgtctcatcaagggaacggaaggggcagcaagatggtgttgcagacccaggtcttcatttctctgttgctctggatctctggtgccgtacgggacactcgtgatgacccagtctccagacctcccgtggactgtcgtctcgtgggcgaggagggccactatacaacgtcgactaagtaccgagacctagtagttacgtttaacacgtaacggtacctaaaactaaagtaaacgtaaattaccgttaccgtacgttaccggtaacctaaggactaaacggaaaaccgtaagggtaaccaacggtacccgttaaccgttaaaaggttcgtaccttacctaaagttttaaccgtacggggaacctaacggttacccggtaaacccgggggtacggttaccccgggggtaccctacgggtaccgtaacgttaccggaacggccggtacgaacgggtaccgggttacgtaacggaacgaaacgtacgttaaacgttttacccgacttacccgtaacctaaccccgtaattaccgaggacctaaccgggttcccgtagtacccgtaagggtaacgtaaggtaaagttaacggttacggtacgggttacttaacggtttttaaacgtacgttacggttagacgtaaccgtaaggtttaaacgtttaaactaacggttaccgtttacctacggttaaacgggtttaccgggtttacgggggaacccggggttaaacgtaaggtaccggttaaggttaacgtaccgttaacggttaaaccgaacggttacggtacggtacgttaccggaacctacgttacgttcttacgtacttacctacgtaccccg

SEQ ID NO: 41875 - DNA, 605 bp, Homo sapiens
  misc_feature: GYAE6OF02HY4PP.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgtttacacaggtccaaacaataagaattacttcgcttggtaaccagcaacgaaaccaggaccagcctactaagttgctctatttacgtggacatccgtacccggggacgttcccggggtccctcgaccgtattccgagcggcgaggccgggtctgagacagtactttcactctccaacctatcagcacgcctgcgaggctagaagtagtgtaggaccttagtttacttacttgtactagactaagttattaagtaacgttacgtccttacgtagtttaccggtttcgggacccggggtaacaaggtccgttaggaacgtacgtaaccgaaaacggtacgtcggttaggacctacggacctaccgtacttcgtcgtcctttacgtaccttcccg

SEQ ID NO: 41876 - DNA, 581 bp, Homo sapiens
  misc_feature: GYAE6OF02GCSI9.39.1.A01.1.454.CMB.1.raw
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (338)..(338): a, c, t, g, unknown or other
  misc_feature (338)..(338): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatgacccgagtctccagactccctggctgtgtctctgggcgagagggccaccatcaactgcaagtccagccagagtgttttacacaggtccaacaataagattacttcgcttggtaccagcagaaaccaggacagccctactaagttgctnattttacngggccatccgtacccgggtagtcccggggtccctggacccgtnttccgacgcggcaggccggggtctggagacaggtactttcgactctcacctatccagcacgctcgcaggcctaggaagtatgtggactagtttacttattgtacgagactacgtatttagtacgttacgtccgtactaggttacgttttacgggaccggggtaaccaggtcgtagggatagaccgaacgtacgtggtagacgttgacctacctagttccgtcgttccttaccgtacttccccg

SEQ ID NO: 41877 - DNA, 627 bp, Homo sapiens
  misc_feature: GYAE6OF02HYFHT.39.1.A01.1.454.CMB.1.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgtttacacaggtaccaaacaataagaattacttcgcttggtaccagcaagaaccaggacagcctactaagttnctctatttacgnggcagtccgtaccggggacgtcccggggtccctaggaccgtacttcgacggccggtcgacgggccgggttacnggacgactagtacttttccacgtcctacacctanacgacgcaccgtcctaagcgactaggaagtagtggtcggtacgttagtttagttactgtacgagtacttagttattagtacgttacgttccgtacgtacggttacgtttacggggaccgggtaacctaaggtcggtagtacgtacctaacgaacggttacgtcggttacggctacgacctaacgtactccgttacgttccgttacctcgttcccgtacccg

SEQ ID NO: 41878 - DNA, 622 bp, Homo sapiens
  misc_feature: GYAE6OF02IPV7O.39.1.A01.1.454.CMB.1.raw
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagtaattacttcgcttaggtaccagacaagaaacaggacagcctctaagttgctctatttacgtggctatccgtacccgggagtcccggggtcctgaccgtattcgagcggcaggcgggtctgagacagtatttcacgtctacaccatcacgacacgtcctgcgaggctagaagtagtggtggtacgttagtttacttactgtacaggtactagttattaacgttagttaacgttaccttacgtaagttaccggttttaccggggacccggggtaacctaaagggtcgtagggaacgtacgtaacgaaaccggtaacgtcggttacggtaccgttacggaccctaccgtacttaccggtttcgttacctttacgtaccctttccccgg

SEQ ID NO: 41879 - DNA, 763 bp, Homo sapiens
  misc_feature: GYAE6OF02IOIVB.39.1.A01.1.454.CMB.1.raw
  modified_base (307)..(307): a, c, t, g, unknown or other
  misc_feature (307)..(307): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgcctacgggacatcgtgatgacccagtctccagactccctggctgtgtctcgtgggcgagagggccaccagtcaactgcaagtccagccagagttgtttacacaggtaccaacaataagaattacttcggcttggtaccagaccaagaaaccaggacacgcctacctaagttcgactctaactttacgngggacctagtaccgtaccggggacgtccccggggtccctaggacccgtatttcgacggccggcgtaaggccgggtctaggacgtacaacgttactttcaccgttctaccaaccgtacgtaccgagaccgtaacggtcccgttacggccgtaacgggtaccgtagtaaacggtacgttcggttacggtacgttaacggttttacgtttaacgtcgttaccgaaggtacgttaacgtttaagttaacgttaacgtaccgttacccgttacgttacggttaaccggtttttcggggaaccccggggtaaaccgtaacgggtaccggttacgggtaacggtaaccgttaaccggtaaaaccggtaacggtttacgggttaaccggtcggttaccgtaacctacccggttaacgttacccggtttacgtttacccgtttacctaacccgtttaacccccgg

SEQ ID NO: 41880 - DNA, 734 bp, Homo sapiens
  misc_feature: GYAE6OF02J15Y2.39.1.A01.1.454.CMB.1.raw
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgttttacactacggtaccaaactaataagtaattaccgttcgtacttggtaacccagtcaacgaaaccaggacacgcctactaagttgctacatttacgnggtacacgtaccgtacccggggacggtcccggggtcctcggaccgtattacgnggaccggcgacggtcgggtactaggacgaacgtagttacgtttaccaacgttccgtaccaacccgtatacccgacgacctaacggtccctacggcgacggtaccgtaggaaaggttgttacggtcgggttaacgttaacgttttaactttaccgttacggtaccgtagttaaccgtaagtttaaacgtttaagttaacgttaccgttaccgttacgtaaccgggttttacggtttaccggggacccgggggtaactacgggtaacggtcggtaacgtacgtaaccggtaaacgtcggttcggtagtcccgttaacgtacccgttaaccggtcttacccgttcgttacccgttaccttacgttcccccg

SEQ ID NO: 41881 - DNA, 691 bp, Homo sapiens
  misc_feature: GYAE6OF02I4RNK.39.1.A01.1.454.CMB.1.raw
  modified_base (424)..(424): a, c, t, g, unknown or other
  misc_feature (424)..(424): n is a, c, g, or t
  modified_base (541)..(541): a, c, t, g, unknown or other
  misc_feature (541)..(541): n is a, c, g, or t
  modified_base (599)..(599): a, c, t, g, unknown or other
  misc_feature (599)..(599): n is a, c, g, or t
  modified_base (606)..(606): a, c, t, g, unknown or other
  misc_feature (606)..(606): n is a, c, g, or t
tcagtcgcactagtcacgaccggtgctcgatttagacgtctcatcaagggaaggaaggggcagcaagatggtgttgcagacccaggtcttcatttctctgttgctctggatctcgtggtgccgtacggggacatcggtgatgacccagtctccagactccctggctgtatctcgtgggcgaggacgggccaccatcaactgacaagtccagccagacgttgtttaacacgacggtaccaaacctaaataaagtaacttaacttcgcgtttacggtaccagacaaagaaaccgaggaaccagccctaccgtaagttcgctactaagttttacgagggtactaacgtcccggtaacccggggtacggtacccggggtccccttacggaaccggtactttacgacggtcggacgacggtaccgggtntacggaagacgtaacgttatttccgaactctaccgaactaacgttcacgcaagtcctagaccgtaagggccttaaggaagtagtggtcgtacgtaagttttactacgttcactatanaacgtttaatactagttacgtccgttagtacttaacggtttcggggaacccgggtaanaacggtntagggaactaggtaacgaaaccgttaagaggttcgacgttaacgaaccgtaacttcgtccgttacttacttacgttacttacccg

SEQ ID NO: 41882 - DNA, 722 bp, Homo sapiens
  misc_feature: GYAE6OF02I3CQ8.39.1.A01.1.454.CMB.1.raw
  modified_base (132)..(132): a, c, t, g, unknown or other
  misc_feature (132)..(132): n is a, c, g, or t
  modified_base (140)..(140): a, c, t, g, unknown or other
  misc_feature (140)..(140): n is a, c, g, or t
  modified_base (169)..(169): a, c, t, g, unknown or other
  misc_feature (169)..(169): n is a, c, g, or t
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
  modified_base (397)..(397): a, c, t, g, unknown or other
  misc_feature (397)..(397): n is a, c, g, or t
  modified_base (499)..(499): a, c, t, g, unknown or other
  misc_feature (499)..(499): n is a, c, g, or t
  modified_base (537)..(537): a, c, t, g, unknown or other
  misc_feature (537)..(537): n is a, c, g, or t
tcagtcgcactagtcacgaccggtgctcgatttagacgtctcatcaaggaagggaaggggcagcaagatggtgttgcagacccaggtcttcatttctctgttgctcgtggatctctggtgccgtacgggganatcgtgangacccagtctccagacctccctggctgtntctcgtggacgagacggccaaccancactgacaagtccagaccaggagttacgtttaacacgtacggtaccaaanaaacgtaaagtaattaccttcgtagttcggaaccagacaagaaaccgaggactacgtacctcctaagtcgtacgtacttattacgtcggactacgtccggaaccggggttcggtaccggggtccctacggtacctaactcggacggcggtacncgggtcggtctaggacgtaatcggttacttcgtaactcctaaccacgttacgtaccgaacggtcgtaacgtccgtaccgaaggttcccgagtaaacgggtancggtagttccgtaagtttacttacgttagaacgtacgntaaagttatacgtagttaccggtacctagttaaccggtcggtttaacggggtccggtaaaccgggtgtaccgaaggttccgaaagtttaaccggaacgggttacaacggggtttacgctaaacccggtactttaaccgacgggttattaccgggttcctttaccggttacttccccgtaaccccg

SEQ ID NO: 41883 - DNA, 721 bp, Homo sapiens
  misc_feature: GYAE6OF02HD58J.39.1.A01.1.454.CMB.1.raw
  modified_base (300)..(300): a, c, t, g, unknown or other
  misc_feature (300)..(300): n is a, c, g, or t
tcagtcgcactagtcacgaccggtgctcgatttagacgtctcatcaaggaacgaaggggcagcaagatggtgttgcagacccaggtcttcatttctctgttgctctggatctctggtcgcctacggggacatcgtgatgacccaagtctccagactccctggctgtgtctcgtgggcgagacgggccaccatcaactgacaagtccagccagagtgtttacacaggtaccaacaataagaattacttgcttggtaccagcaagaaaccaggacagcctacctaagtcgctctatttacgngggcactccgtacccgggacgttcccggggtccctggaccgtattacgacggcggacgacggccggggttcctaggaacgtacgtaacgtacttttaccaacgttacctacccgaaccctaacgttacacgtaccgaacggtccctaggaccgtaacggtcgttaaggaaacggtacgttgggtaacggtacgttaaggttttaactttaaccgttacgttacgaacggtaccgtaaagtttaactttaacgttaacgtttacgtaccgttacgtaacggttaccggttttacggggaacccggggtaaccgaaacggtcgtaacgggtagtacgtaaccgtaaacggtaacgttgggtacggtacctacgacctaaccttaacgttccgttacggttccttaccgttaccgttaaccccg

SEQ ID NO: 41884 - DNA, 715 bp, Homo sapiens
  misc_feature: GYAE6OF02H9F4E.39.1.A01.1.454.CMB.1.raw
tcagtcgcactagtcacgaccggtgctcgatttagacgtctcatcgaaggaaggaaggggcagcaagatggtgttgcagacccaggtcttcatttctctgttgctctcggatctctggtgcctacgggacatcgtgatgacccagtctccagactccctggctgtgtcctctgggcgagagggccaccatcaactgcaagtccagccagagtgttttacacaggtccaacaataagaacttaacttcgcttggtaccagcagaaaccaggacagcctcctaagttcgctctatttacgtgggctatcgtacccgggtagtccggggtccctgaccgattcaggcggcagcgggtctggacgacagtattttccgacttcctacctaacccgacttaccgacggtacccaacggtcccttacggccggaacgggtccgtacggaaacggtacggttggtgggtaccgtaaggtttttaactttaaccggttcgttaccgacggtaccgtaacgttaactttaagttacgttaacgttacccgttaccgtaacggttaaccggtttttcggggaccccggggggttaacctaaacgggtaccgttaggggaacggtacgttaccgaaaaccggtaaccgttacgggtaccggtaccgtacggtacccgtaaccgtacgttacccggttcgttacccgtttaccctacgtttaccccg

SEQ ID NO: 41885 - DNA, 682 bp, Homo sapiens
  misc_feature: GYAE6OF02IRK00.39.1.A01.1.454.CMB.1.raw
  modified_base (206)..(206): a, c, t, g, unknown or other
  misc_feature (206)..(206): n is a, c, g, or t
tcagtcgcactagtcacgaccggtgctcgatttagacgtctcatcaaggaaggagggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagngttgtttacacaggtaccaaacaataagaattacttcgcttggtaaccagcaagaaaaccaggacacgacctaccgttaagttgcctactagttttaaccgtggggtactacgttaccggtaaccccggggtacggttccccgggggtcccctagtacccgtattccgaggccggacgacggccggggtactaggaagactagtacttttacacttctacaccgtatcgacgtcgaacgcctacgcgaggcgtagaagagtggtaggcgtaagttaattacgtacgtcgacgacgtaagttatacgttaagtacgttacgtactacgtacggttttaccgggacccggggtaaccgtaacggacggttacgtaaacgtacgtaaaccgtaaaccggtaacgttacggtacggtccgtaacccgtaaccgaaccgttacgttaccgttaccttccgttaccctacccgttacccccg

SEQ ID NO: 41886 - DNA, 882 bp, Homo sapiens
  misc_feature: GYAE6OF02IJXRL.39.1.A01.1.454.CMB.1.raw
  modified_base (438)..(438): a, c, t, g, unknown or other
  misc_feature (438)..(438): n is a, c, g, or t
  modified_base (588)..(588): a, c, t, g, unknown or other
  misc_feature (588)..(588): n is a, c, g, or t
tcagtcgcactagtcacgaccggtgctcgatttagacgtctcatcaagggaaggagggcagcaagatggtgttgcagacccaggtcttcatttctctgttgctctgatctcgtggtgcctacgggacatcgtgatgacccagtcctccgagactcccgtggctggtcgttctcgtgggacgaggacggcccaccatcctaaactcgactaacgtccagccaaggtagttcgtttacacgacggtaccaaaactaagtaaacgtactttacttccggtacttacgggtaacctaaggtaccaaaacggtaaaacccgaggtaaccgcgtacccctaccttaaagggttcgacccttacgttaacttaccgtgggtacctacggttccggtaaccccgggggtcggttaccccgtccgaacggtactcgtcgacgccggngtaccggtcggtagcgacgtacgtacgttacttcgtacccgtaccttacgacgtttacgaacggccgtaccggtacgtaacgtccggtacggacgtacgggttaaaacgcgtacggttacgggtcgttaaacggtttacggttttaaccncggtttaaccgaagtacgttaaacggtttaaccgtttaaagtccggtaagttaccccggtttaagttacccgggttaaggttttaacccggggggttaccggaaacccccggggtaaaagggtttcgggtacccgggttaaccgggtaaactttacccggggaaaacccgttaacggttaaccggggttacggttcccggttaaaccgaacccccggttaaacgtttacccggttaaccttttccccggtttcggtttaacccccctttaccggtttaacccccgtttccccgg

SEQ ID NO: 41887 - DNA, 763 bp, Homo sapiens
  misc_feature: GYAE6OF02FMZS9.39.1.A01.1.454.CMB.1.raw
  modified_base (220)..(220): a, c, t, g, unknown or other
  misc_feature (220)..(220): n is a, c, g, or t
  modified_base (323)..(323): a, c, t, g, unknown or other
  misc_feature (323)..(323): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatcgacccagtctccagacctccctggctgtgtctcgtgggcgagacgggcccacatcaacgtgcaacgtccagccagtagttntttacacgacggtaccaaacaataaagaacttaccttcgtcgttacggtaccagacaacgaaaccaggacacgacctacgtaagttcgcctactaatttacgngggctacgtcccgtacccggggtacggtcccggggtcctacggtaccgtagttccgacggccggacgtacgggccgggttctacgggaactacgtacgttacttttaccaccttaccgtaccctaaccgtactacccgggtacgaccgaaccggtcccgtcgggtaaccgacggggtactaacggggtaaacgtaggttcgggtacgggttacgtttaacggttttacttacggtcggttactaacggtcgttaagtttactttaacgttaagggtaccttaccttacggtaacggttttaccggggtttacgggggaacccggggtaaacctagggtacgtaacggtaacgtaaccgtaacgtaaaccggttacgtgggtacggtccgtacgtaccctacgttacggtctttacccgttcctacggtaccctttcccgg

SEQ ID NO: 41888 - DNA, 668 bp, Homo sapiens
  misc_feature: GYAE6OF02G13XY.39.1.A01.1.454.CMB.1.raw
  modified_base (331)..(331): a, c, t, g, unknown or other
  misc_feature (331)..(331): n is a, c, g, or t
  modified_base (374)..(374): a, c, t, g, unknown or other
  misc_feature (374)..(374): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgccgtacggggacatcgtgatcgacccagtcctccagacctccctggctgtgtctcgtgggcgaggacggccacatacaactgacaacgtccacgccagagtttcgttttacacgtacggtaaccaaactaagtaaacgtaacttaccttacgtcgttacggtaaccagacaacgaaccgaggacacgcctactaagttcactctacttacgnggcacgtccggacccgggtacggtcccggggtcctcgaccgtnttccgaggccggcgacggtcggtgagtacgacagtcttacactcaccacctntacgacnccgacgtccgtcgacggtagacgtaggaagtagtcggtacggtacttaacgttttacgttcgttagtacctagtacttagtttactagtttaacgttccgttaaccgtgggtttaaggttaccggttaccgggggaaccgggaacgtacggtacggtacgagtacgtaacggtaacgtacgttgtacgggctccgaacgtaccgtcgttccggttcttcgttctacccttccccg

SEQ ID NO: 41889 - DNA, 721 bp, Homo sapiens
  misc_feature: GYAE6OF02HOEDL.39.1.A01.1.454.CMB.1.raw
  modified_base (345)..(345): a, c, t, g, unknown or other
  misc_feature (345)..(345): n is a, c, g, or t
  modified_base (683)..(683): a, c, t, g, unknown or other
  misc_feature (683)..(683): n is a, c, g, or t
tcagtcgcactagtcacgaccggtgctcgatttagacgtctcatcaagggaaggaaggggcagcaagatggtgttgcagacccaggtcttcatttctctgttgctctggatctctggtcgccgtacgggacatcgtgatcgaccagtctccagacctccctggctgtgtctcgtgggccgagacggccacgatacaactgcaacgtccagaccagtagttacgtttaacacgtacggtaccaaactaagtaagttaacttacgttcgtacgttaggtaaccagacgaaaccggtaaacgacggaacctacgtcccttacgtaagttcgccttattacgtttacgnggtacctaccgttaccggtaacccggggtccgttcccgggtacccgtagaccgtacttcgcggacggacgcgggtacggtctaggacgtacgagttacttacgacttccgtacctaaccgtaacgtcggtaccgacctacggcccgttaacggaccgacggtaccgtaggaaggttacgttcgggtacgtacgtttaagttaccgttagtacgtacgtacttacggtattatagttaacgttcgtaccttacggtacggtttaccggttacgggaccggtaaccgtacggcgttaggacgtacgtacgaaacgtcgtacggtcgtacgtaccgtaccncgttacggttaccttcgtaccgttacctcctaccccgg

SEQ ID NO: 41890 - DNA, 704 bp, Homo sapiens
  misc_feature: GYAE6OF02JED7S.39.1.A01.1.454.CMB.1.raw
  modified_base (392)..(392): a, c, t, g, unknown or other
  misc_feature (392)..(392): n is a, c, g, or t
tcagtcgcactagtcacgaccggtgctcgatttagacgtctcatcgaagggaaggaaggggcagcaagatggtgttggcagacccaggtcttcatttctctgttgctctggatctctggtgcctacggggacatcgtgatggaccagtctcagactcccgtggctgtcgtctctgggcgaggagggccaccatcaactgacaagtccgagccgagtacgttggttttacacgtaggtaccaaacgaataagtaattactccgtacttagggtaccaagacgaacgaaaccaggacaggaccctcctaagttcgctctaatttacgtagggtctactaccgtacccggggacggtcccggggtccctggaaccgtattacgacggtccggacncgggtaccggtcgtacggagtaaccaggttactttacacgttccactaaccgtactcgacgtcgaaccgtcctaggcctacggtacgtagaacggtgtcgtaggtaccttaaggttacgttacgttacgtacgtacgtaccgtaagttacgttaagttacggtaacgttaccgtaccgtaacggttacggttttacggggacccggggtaacgtaacgggtaaccgtagggtacgtacgttaacgaacggtacggtacgtacggtacgttacgacgttactacgttacgtcgttaccttcgtaccttacccg

SEQ ID NO: 41891 - DNA, 752 bp, Homo sapiens
  misc_feature: GYAE6OF02HFKJ4.39.1.A01.1.454.CMB.1.raw
  modified_base (706)..(706): a, c, t, g, unknown or other
  misc_feature (706)..(706): n is a, c, g, or t
tcagtcgcactagtcacgaccggtgctcgatttagacgtctcatcaaaggaaggaagggggcagcaagatggtgttgcagacccaggtcttcatttctctgttgctctggatctctggtgcctacggggacatcggtgatgacccagtctccagacctccctggctgtgtctcgtgggacgagacgggccaccatcaactgacaacgtccagccaagtagttacgttttacaacgtacggtaccaaacaaattaaacgaacttacgttacgcttacggtaaccaagacaagaaaaccaggaccacgacctaccgtaagttcgactacgtaatttacggtcggactaacgttccggtaaccccggggtaggttcccccggggtaccctcggaaccgtactacgacgggccggactacgggccgggttactacggaacgtaacgtaggtacttttaccaaccgttcctacccaaaccgtactaaccgacgtaccgaagtcccgtaggaccgtacggaccgtaaggaaacgtaagttcggtaaggtaccgtttaaggttttaaacgtttacgtacttacgaacgtacgtaagtttaaacgttaagttaaccgttacgttacccttacggtaaggttaccggttttccgggaacccgggggtaaacaggtccgtaagggacgtaacttacggaaaacgtacttacgggtntaacgtacggacctactacgttccttattccgttacctcgtacccg

SEQ ID NO: 41892 - DNA, 841 bp, Homo sapiens
  misc_feature: GYAE6OF02F1F3P.39.1.A01.1.454.CMB.1.raw
tcagtcgcactagtcacgaccggtgctcgatttagacgtctcatcaagggaaggaaggggcaggcaacgtatcggtggttgccaaggaccctaggtcttcgatttctctgttgctctggatctcgtggtgcctacggggacatacgtggatggacccagttcgttccagtacttcccttggctgtcgtctcgtggggcgaggacgggcctacgagtcaacgtgggacaagttccgacgccgagggtacgttgtttaacactacggtccaaacgaataagaatttaccgttcgcgttaggtaccaggtcaggaaaaccctaggacaagtcctacgttaaggttgccttctaacgttttacgcggggaccggtaccgtacccggggtaacggttccgggggtcccggtaccgtaaccggtacttaacggtacggacgggtacggacggtacggggtaccggtacgtaacgtaacctaggtacgttttacgtacgtaccggtccggaaccctacttacccgtaacgcgtaaccgaccggtacgtaccgggtacgtaacgtaaagaaacggttcggttacgggtaacgtttaccgttttaacggttaccttacggtaacgttacggaaccggttattaaccggtttaagtaggtaaccgttaccggtctaaacggttccgttttacggggtaccgggggaaccttaaaccgtggtacggtcgtaaaccgttaaccgtaaacggtaacggttacgttacgggtaccgtacggttaacccggtaaccgttagttcccggtttcggttacccggtttagtccccgttttaccggttaccccgtacccg

SEQ ID NO: 41893 - DNA, 925 bp, Homo sapiens
  misc_feature: GYAE6OF02FP3I3.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagtagttgttttacactaggtccaaacaaataaagtaattacttcgtcttacggtaccagacaagaaaccaggacagcctaccgtaagttcgcctactactttacgtgggtaccacgttacccggtaacccggggacggtttccccgggggttcccctacggtaaccccggtatttcccggaacgggtccggggaccgtaacgggtccgggggttccttagggaacgtaaccgtaacggttactttttacccgaaccttccttaccgaacccgtaaacttccgaaaccggtcctaaccggtcccgttacggaccggtacgggtacttaacgggtaaacggtacggttcgggtaacgggttacctttaaagggttttttaaccgtttaaccgtttacggttaccgtaacgttacgttaaacggttttaaacgtttaacgtttaaacgggtttaacccggttccgtttaaaccggtttaaccggggttttaaccggggttttttacccggggggaaccccggggggttaaaaccgttaaacgggttacccgggttaacggggtaaaccggtaaaccgttaacccggtaaaaaccgggtttaccggtttaacggggtttaacccgggtacccgtttacgggtaaccccgttaacccgttacggttttaccccggtttacggttttacccctttttacccggtaaccgtttttacccccccggg

SEQ ID NO: 41894 - DNA, 729 bp, Homo sapiens
  misc_feature: GYAE6OF02HYGMG.39.1.A01.1.454.CMB.1.raw
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
tcagtcgcactagtcacgaccggtgctcgatttagacgtctcatcaaaggaaggaaggggcagcaagatggtgttgcagacccaggtcttcatttctctgttgctctggatctctggtcgccgtacggggacatcgtagatcgacccagtcctccagacctcccgtggtctgtcgtctcgtagggcgaggacggccacatacaactgacaacgtccagcctagtagttcgtttacacgtacggtaaccaaacgtaaactaaagtaacttacgttcgtacgttaggtaaccaggcaaacgaaccgagacacgtcctacgtagtcnctacgtattcgnggactacgtaccggtaccggacggtcccggtcctacgacctagtcgacgcggactcgggtcggtacgtagacgtacgtacgtactttaccgactcgtacaactactcgacgcgacgtcgtacgacgtagacgtaagaacgtgtggtacgtactttagttaacttcgtcgactacgtaacgttagttaattacggtacgttaccgtaccgttacgttaacgggttttccgggttaaccggggaccgggttaaaccgtaggtcccggttaagggaacctttaacgtaacccgggttaaacggtacgggtttccggacggtaccgttaacccgttaccgaaccggtttacttaccccggtttaacggtccctttaccggaccccgttttaccccgg

SEQ ID NO: 41895 - DNA, 631 bp, Homo sapiens
  misc_feature: GYAE6OF02INF89.39.1.A01.1.454.CMB.1.raw
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
tcagtcgcactagtcacgaccggtgctcgatttagacgtctcatcaaggaagggaagggcagcaagatggtgttgcagacccaggtcttcatttctctgttgctctggatctctggtgcctacgggacatcgtgatgacccagtctccagactccctggctgtgtctcgtgggcgagagggccaccagtccaactgacaacgtccagccagagttgtttacgacaggtaccaaacaataaagtaattactcgacttggacagacaagaaaccaggacacgtcctacgtaagttcgctactatttacgnggacatccgtaccgggagtcccgggtccagacgtattcgacgcgcgacggcggtctgaacgacagtattacacgttcncgaacctatacgagcgtacgcctcgacacgntaaggagtatggagtacgttagtttacgtaactgtacgagtactaagttaatatgttaacgtctaacgttacgttacggtttacggggaccgggtaacgaagtacgtaggaacgtacgtaaaccgtaaacggttacgttacgggtacgttaccgacggttacccaacgttaccggttcttaccgggtttaccctttacgaccgtttacccccgg

SEQ ID NO: 41896 - DNA, 884 bp, Homo sapiens
  misc_feature: GYAE6OF02HUQCM.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatcgacccagtctccagactccctggctgtgtctcgtgggcgaggagggccaccatcaactgacaacgtccagccagagttgtttaaccacgtaaggtaccaaacaaataaagtaattaaccgttcgtacgtttacggtaaccaagacgaaacgtaaaaccgaggaaccacgtacccttaccgtaaagttcgaccttactaagtttacgtacgggtactaacgttaccggtaacccggggtacggttccccggggtaccctacggaccgtattacggacggccggacgaggtaccgggtactacggaacgtaccgtaagttaacgttttacccgaacttaccgtaccgtaaaccgtacgtaccgtaacggtacctaaccggtaacccgtcggaaccggtaacgggtaccgtttaaggaaaaccggttagttacggggtaacgggtacctttaaagggtttttaacttaacccggttacgggttacctaaggtaaacgttaagttaaacgtttaaaccgttaagggttaaccttacccggttacgttaaacccgggtttaaggggttttaccccgggggaacccgggggttaaaacctaacgggtacgggttaacgggtaaagttaacccggttaaaccgtaaaaacccggggttaggtaccgggttacgggtaaccgtacccgggaacctaaacccgttgtttcccggttaacccgttttacttaccggttaacccgttaacccccgg

SEQ ID NO: 41897 - DNA, 641 bp, Homo sapiens
  misc_feature: GYAE6OF02H522O.39.1.A01.1.454.CMB.1.raw
  modified_base (442)..(442): a, c, t, g, unknown or other
  misc_feature (442)..(442): n is a, c, g, or t
  modified_base (461)..(461): a, c, t, g, unknown or other
  misc_feature (461)..(461): n is a, c, g, or t
tcagtcgcactagtcacgaccggtgctcgatttagacgtctcatcaaaggaaggaaggggcagcaagatggtgttgcagacccaggtcttcatttctctgttgctctggatctcgtggtgcctacggggacatcgtgatgacccagtctccagactccctggctgtgtctcgtgggcgagacgggccacatcaacgtgcaacgtccagccaggtagttcgttttacacgtacggtaccaaaacaaataaagtaacttaccgttcgtcgtttacggtaaccagaccgaacgtaaaaccgagggtaaccaagccctaccttaagttcgtcttactatttacggtggactaacgtccggtacccggggtacggttccgggtcccgtagtaccgtacttcgacggaccggcaggtcggtctagacgactacgtactttcgactacnctaaccatcagctacgtcncgcgagcgtagacgtagtgtgtactttagttacttacgtgtacgagtatagttatagttacgtacgttaccgtcgtaacgttaccggttccggtaaccggggacaacgtcgacgtagtacgacgtaaagtcgtaggtcggcgtacgacgtactgttccgttcgtacttctccttaccccg

SEQ ID NO: 41898 - DNA, 819 bp, Homo sapiens
  misc_feature: GYAE6OF02HM5JC.39.1.A01.1.454.CMB.1.raw
  modified_base (465)..(465): a, c, t, g, unknown or other
  misc_feature (465)..(465): n is a, c, g, or t
tcagtcgcactagtcacgaccggtgctcgatttagacgtctcatcaaaggaaggaaggggcagcaagatggtgttgcagacccaggtcttcatttctctgttgctctggatctcgtggtcgcccgtacggggacatcggtgatcgacccagtcctccaagtccctcccgtggtcttggttcgtcttccggtggggcggaaggacgggaccccaacgtactaccgaacgtacgacgtaacggtccaggaccaaggtagtttacgtttaccacgtacggtaccaaaagaaattaagtaaactttccgtacggacgttttccggaaccacgaacgaaacgaaaaccgaggaaccaccgtcccctaaccgttaagtcgtactacgttaacgtttaccgcggactaccgtaccggtaaccccgggcgggtttccccggtaccctacggaccttacgtcgacggacccggngcgggtacgtcgttacggaaacgtcgtaactcgttttaaccaccgttccaacggtaaacccttaggaccgaagtccggactccgtcggaaccggtacggtacgtaacggtaaaggttagtacgggtacgggttaccttaaaggttttacgttacgttacgtcgaacgttacgtaaagttattaaggttaacgttacgttaccacggttaccggttaccgttacgggggacccgggttaacggaaggacggtagggtactaaccgaaccgtaaacgtaaccgggtagtccggaccgttacggccgtaacgttaccgttacgttccgtttacccttacgttacccggtttaccccg

SEQ ID NO: 41899 - DNA, 736 bp, Homo sapiens
  misc_feature: GYAE6OF02GN9G4.39.1.A01.1.454.CMB.1.raw
tcagtcgcactagtcacgaccggtgctcgatttagacgtctcatcaagtaaggaaggggcagcaagatggtgttgcagacccaggtcttcatttctctgttgctctggatctctggtgcctacgggacatcgtgatgacccagtctccagacctccctggctgtgtctcgtgggcgagacgggccacatcaactgcaagtccagccagagttgttttacactacggtaccaaactaaataaagtaattacgttaccgtcttacggtaccagcaacgaaaccaggacacgcctacctaagttcgcttactactttaccgtgggactacgtaccggtaacccggggacggtcccccgggggtccccttacgggacccgtactttccgaacggtccgggaccgtacgggtcggggttctagggaacgaacgacgtaacttttcctaactccgtaccaaccctacttaccgacgtaccacggtccctaggccagggtctaggaaagttcgtgggttcggtacgtttaacgttttacgttaccgtttacgtacggaccgtagttaagttaaacttacgttaacggtttaccgttacccgttaccgttaagggttaccggtttttaccgggggaccccggggttaaccaacggccggtaaggaacctacgtaaaccgtaaccgtagtacggtacgtcgttacgaaccctacgtacgtcgttcgttacttcctacttaccccg

SEQ ID NO: 41900 - DNA, 557 bp, Homo sapiens
  misc_feature: GYAE6OF02FK8MG.39.1.A01.1.454.CMB.1.raw
  modified_base (366)..(366): a, c, t, g, unknown or other
  misc_feature (366)..(366): n is a, c, g, or t
  modified_base (499)..(499): a, c, t, g, unknown or other
  misc_feature (499)..(499): n is a, c, g, or t
tcagtcgcactagtcacgaccggtgctcgatttagacgtctcatcaaggaagggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaataaagaattaccttcgcttcggtaaccagcaagaaaccaggacagcctctaagttgctcatttactgggcagtccgtacccgggacggtcccggggtccctgaccgattcaggcggacaggcgggtctgacganagtatttcgactctcacctatcagcacgcctgcaggctgagtagtgtgcgtagtttacttacgttgtacgagctagtattatagttacgtccttatacgttacgtttggggacccggggtactaagtcgaggnacgtacaaacgtactaggtcgctcgaccgacacttcgtcgttaccttcgtcttccccg

SEQ ID NO: 41901 - DNA, 906 bp, Homo sapiens
  misc_feature: GYAE6OF02HVF7X.39.1.A01.1.454.CMB.1.raw
tcagtcgcactagtcacgaccggtgctcgatttagacgtctcatcaaaggaaggaagggggcagcaagatggtgttgcagacccaggtcttcatttctctgttgctctggatctcgtggtgcccgtacggggacatcggtagatacgacccagtcctccagacctccgtggctgtgtctcgtgggcgagacggcccacctatacaacgtgacaacgccacggacctaacggtaggtttacgttttaaccgaacgtaacggtaacccaaaacgtaaaattaaacgtaaaccgtttaaccgttccgttacggttaccggtaaccgtaacggtaaccaaaaccggtaaaacccggtaacggggaacctaaccggttacccccgttaacgttaaacgggttccgtacccttacgtttaacggttttaaccggtacggggtaccttaaccggttacccggggttaaccccgggggtaccggttacccccgggggttacctaccgggtaaccgttacgttacggacggtacccggtacggacgggttccggtcgtacggtacgtaaagtacgttacctttaccctaaccgtacctacctaaccgtacgtaaccgtacgtaccgtaccggtaccgtacggtaccggtacggttaccggtaaaggtaacggttacggttacgggttacggttaaccgtttaacggttttaccgttacggtttaccgtaacgttacgttaacgtagtttaaacgtttacggtaagtttacccgttacgttaaccgtttaccggttaccgggttaacccggggaaccgggttaaccgaggtacgtacgacgtacgttacgtaaaggtccgtacggtacgtacgtcgacctacgttacggtcttacgtacccttcgttaccctaccg

SEQ ID NO: 41902 - DNA, 761 bp, Homo sapiens
  misc_feature: GYAE6OF02IMFCJ.39.1.A01.1.454.CMB.1.raw
tcagtcgcactagtcacgaccggtgctcgatttagacgtctcatcaaagggaaggaaggggcagcaagatggtgttgcagacccaggtcttcatttctctgttgctctggatctctggtgccgtacggggacatcgtgatacgacccagtcctccacgacctcccgtggctgtcgtctcgtggcgagacggccacatcaacgtgacaagtccagaccagtagtttcgtttacacgtacggtaccaaactaaagttaaacgtaactttacctccgtacgtttaccggtaacccaggtaaccgaaacgtaaaaacccgaggggtaaccaccggtaccccttaccgttaaagttcgtaccttacttaacgtttacggtcgggacctacgttaccccgggtaaccggggtaccggtccccggggtaccctaacggtaccgttaacgttcgacggtaccggacgtaccgggtcgggttacgtaggaaccggtaacgttacggttaaccttttccgaacttccgtaaccgaacttcgaccgtacgacgtccgtacgtcgaccgtaggtcctagaagtcgttggtgtactaagtttactcgttacgtacaacggtatagttaatacgttacttacgtaccgttagtacgggtttaacggttccggggaaccgttaacgacggtagtacgggatacgaaccggtaaacgtaaccggtgtacgggtcctaaccgagttactacgtttcgactttactccgtaccttcccg

SEQ ID NO: 41903 - DNA, 764 bp, Homo sapiens
  misc_feature: GYAE6OF02IS9Q9.39.1.A01.1.454.CMB.1.raw
tcagtcgcactagtcacgaccggtgctcgatttagacgtctcatcaaaggaaggaagggggcagcaagatggtgttgcagacccaggtcttcatttctctgttgctctggatctctggtgccgtacggggacatcgtgatgacccagtctccagactccctggctgtgtctcgtgggcgaggacggccaccatacaactgcaagtccagccagagttgttttaacacgtacggtaccaaacaataagaattacgttcgacgttcggtaaccagacaacgaaccaggacacgcctacctaagttcgccttactaacgtttaccgtgggacctaacgttcccgggtaacccggggtacgggttcccgggggttacccctcgggtaacccgtagttaccgacggtccgggtacgacgggtcgggtaccgtaggaacgtaacgtacgttaacttttaccaccgttctaaccacctactcccgaaggcctacgtacccgtcgacggtacggacgtaggaaaggttaggttacggttcggtacgtttaacgttttaactttaaccgttgtaaccgtagttaccgttaaagtttataacgttacgttacgttcctaggttacgttccgggttttaccggggaccggggttaaccgtacggtacggttacggacgtaacgtaacgaaaccgggttaacgttacgggtcggtacgttccgtaaccgtacccttacggtttcttaccggtttaccttaccgtaccgtttccccg

SEQ ID NO: 41904 - DNA, 854 bp, Homo sapiens
  misc_feature: GYAE6OF02G4AX3.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctcgtggactctctggtcgccgtacggggacatcgtgagtcgacccgtagtcctccagacctccgtgtactgtgtcgtgtagggcgtaggacggcccacctatacctaacgtcgaccgtaacggtccgaacggtccgaaggttacgtttacttttaaccgaacgtacggtaaccaaacgtaaagtaaaacgttacgtttaccgttaccgtacgtttaccggaaccctaggaaccgaacggaaaccgaacgggtaaccaacggttaccccttaccgttaagttcgtactaacttacgttttaacggcgggtactcgttaccccgggtacccggggttaccgggtaccccgggttccctacgggtaaccggttcttacggaccgggtacgtaaccgggtacgggttaccgggtacctaacggtaccggtacgtaacgtttacgtttaacccgtaccttaccaccctaaccgttagcccgtaagtaacccgtaccgtacgtccggtaacgtcgggtaaacgtaacgggtaagttacggtacgggtacgttacggtttaactttaacggttacgttacggttcgtaacgtaccgttaagttacggttaacgtacgttacgttaccgttacgttacggttacgggttccgggtaaccgggaacctcgaacggttacacggtactacggtaacgtacggttacgtcgtacctcgacggttactccgtacgtttccgtacttaccggtaccttcccgg

SEQ ID NO: 41905 - DNA, 733 bp, Homo sapiens
  misc_feature: GYAE6OF02IKFLQ.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctggatctctggtgccgtacggggacatcgtgatgacccagtcctccacgacctcccgtggctgtcgtctcgtgggcgaggacggccaccatcaacgtgacaacgtccacgcctaggtagttgttttaccagtacggtaaccaaataacgttaaagtaactttaacttcgtacgttacggtaccaagacgaaacgaacgtagactacgccttactaagtcgactaccgtagttacgtggtactacgtacggtaacccgggtcggtaccccgggtaccgtacggtaaccgtgttaccgacgggtaccggtaacggcggtaccggtacgtacgaacgtaacgtacgttaacgtttacctaacgttcccgaccttaaccgaaccgtcgacgtaccgtacgtcccgtagacgtacggtactacggaagtgttacggtagttaccgttaagtttaccttacgtcgtacctaggtaccgtaaaggtttacttaggttacgtacgttaccgcgttacggttcggttaccggggtacccggaacgtcggtagtaccggaagttaccaacggttaaccaggtccggtctacgtccgaacctacttgtaccggttccgtacttccgtacgttaccccg

SEQ ID NO: 41906 - DNA, 817 bp, Homo sapiens
  misc_feature: GYAE6OF02H9CXC.39.1.A01.1.454.CMB.1.raw
  modified_base (137)..(137): a, c, t, g, unknown or other
  misc_feature (137)..(137): n is a, c, g, or t
  modified_base (343)..(343): a, c, t, g, unknown or other
  misc_feature (343)..(343): n is a, c, g, or t
tcagtcgcactagtcacgaccggtgctcgatttagacgtctcatcaaagggaagaaggggcagcaagatggtgttgcagacccaggtcttcattttctctgttgctctggatctctggtgcctacggggacatcgtnatcacccgtagtcctaccaggacccttcccgtggcttggttcgtcctcggtggggacgacggtaccgggcccaaccattacgtaactggaaccgtaaacgtacccgacgaccgtagttaacggtttcgtttaaccacgtcggtaaccaaactaagtaaagtaactttcttcgttcttacggaccagactaacgaaacgacgtaacncgtaccctatacgttcgtccgttacttacgtttacggaggaccttacgggtccccggttaacccgggggtcggtaccccgggttacctacggaaccgttacgtccggtagggccggcgtacggggtccggttaagacggtaccgtaacgttagtttacctttaccgaacgtttccctaccaacgttacttaccgatacggctaccgtccggtaacgtacggacaggtaacgtaggttcggttacggttaagtttaacgtttaccgtttacgttactacgtaacgtaactttagtttaactttaacgttaacggttacttaccggttaccggttacgggtttacggtttaccgggaaccgggtaagtaccgttaggaaccggttagtaccgttaaacggttaacggcggttaacggtcggacttaaccgccggtaaccttccgttcgtactttcccggtactacggttaaccccc

SEQ ID NO: 41907 - DNA, 669 bp, Homo sapiens
  misc_feature: GYAE6OF02F020A.39.1.A01.1.454.CMB.1.raw
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttacactaggtccaaacaataaagaattaccttcgcttggtaccagacaagaaaaccaggaaccagcccttacctaaggttcgcttactatttaactgggacaacgttcccgtaacccgggtaggtaccccgggggtcccctggaacccgtattccgaaggtcccgggtcgacggtccggggttacctggaacgtacaggtatttccacgttcctcaactactccgaagccacgcctagccgaggtcagagtagttggtggtactagttaacgttacgttgtacgtagtacctaagttacttaagtaagttatccgttagtaccggttaacgttttcggggaccggggtaaccgtacggtcgtacgggagtacgtaaccgtaaacggtaactcgggtacggtcccgttagtaccgtaacctcgttaccgttagttacccttacctaccgttccccg

SEQ ID NO: 41908 - DNA, 875 bp, Homo sapiens
  misc_feature: GYAE6OF02H9LB2.39.1.A01.1.454.CMB.1.raw
  modified_base (668)..(668): a, c, t, g, unknown or other
  misc_feature (668)..(668): n is a, c, g, or t
tcagtcgcactagtcacgaccggtgctcgatttagacgtctcatcaaggaagggaagggggcagcaagatggtgttgcagacccaggtcttcatttctctgttgctctggatctcgtgggtgccgtacggggacatcggtgatcggaccctagtccgtcctacgtacctcccgtggtcttaggttcgttccgtcgtcggggcgacgggacgggaccctaccgtactacctaaaccgttggacgtaacggtcccaggaccctaggtaacgttcgttttaaccggacctacgggtaacctaaaacgtaaactaaacgtaacgtttaccgttcgaccgtttaccggaacctaaggaccaaacggaaaccgacggaactacggtaccccttacgtaacgttgtctacttagttaccggtggactactaccgggtacccggggtacgggtccccgggtccctcggaccgttacgtacgacggtacggcgtaacgggcggtacgtagggaacgtactacgttaacgtttaccaaccgtttaccacctaaccgtaccgtaaccggtacggaccctaaccggtcccgtaaggcccgggtaaacggggccgtttaaaggggaaaaccgttggttagggtccggttaaaccgttttaggttttaaaccgttccggttntaacccggtacgacgtttagttaaacgtttaaccgggtacgttaaccgttccggttaaggtaaccgggttttcggggttaccccggggaacggggttacccgaaggttacccggttagtaaccggtactaacccgggaaacgtcggtaggtaaccgtcggttaccgctacggtttctaccggtttactacggttaccgcttacccgg

SEQ ID NO: 41909 - DNA, 757 bp, Homo sapiens
  misc_feature: GYAE6OF02I33Y0.39.1.A01.1.454.CMB.1.raw
tcagtcgcactagtcacgaccggtgctcgatttagacgtctcatcaaggaagggaaggggcagcaagatggtgttgcagacccaggtcttcatttctctgttgctctggatctctggtgcctacggggacatcggtgatcgacccagtctccagacctcctggctgtgtctctgggcgagacgggccaccatcaacgtgacaagtccagccaagtacgttgtttacactacggtaccaaacaaactaaagtaacttaccgttcgacgttcggtaaccagaccaacgaaaccgaaggaaccacgccctaaccgttaacgttcggaccttacgttaacgttttaacggtcggggacctaacgttacccggtaccccggggtaacgggttcccgggggtaccccgtacggtaccggtacgttccgacgggcccgggtcgacgggtccggggtctaggacgaacccgtaaggttaccttttacaaccgttcccttacaaccctagtaccgtaacgaccgtacgaccgtcggtacgacggttaccgtaaggaacgtaggtcggttacgtacgtaggttttacttagttcgtaccgagtaccgttaggtacttaggtaacgttatccgtacgtagtttaaccgggttcggggacccggggtaactacggtacgtaggagtactaaccggtaaacgtcggttagtacggccgttacggacctaaccgttaccgtatttccggtaaccttccgtaccgtttcccg

SEQ ID NO: 41910 - DNA, 618 bp, Homo sapiens
  misc_feature: GYAE6OF02I3N5S.39.1.A01.1.454.CMB.1.raw
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
tcagtcgcactagtcacgaccggtgctcgatttagacgtctcatcaagggaaggaaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagtagttgtttacacgacggtaccaaacaataaagaattacttcgacttggtaaccagacaagaaaccaggacacgcctactaagtcgactactatttacgnggactagtccgtaccgggacggtccgggtccncggacctattcgagcggtcgacggtcggtctagacgactagtactttcaactctacaccgatacagcacgctagcaggacagaagtgtggtagtactaagtttatacgtgtacgtagtactaagttactaagtacgttacgtacctacgtacgttacgtttcggggaccgggtaactacggtacgtacgggtagtacgtaacgtaaacggtacgtacggtcgtaccgtacgaccgtacgtacgttaccggttctttaccgttactcgttaccccg

SEQ ID NO: 41911 - DNA, 743 bp, Homo sapiens
  misc_feature: GYAE6OF02HF0YG.39.1.A01.1.454.CMB.1.raw
  modified_base (136)..(136): a, c, t, g, unknown or other
  misc_feature (136)..(136): n is a, c, g, or t
  modified_base (158)..(158): a, c, t, g, unknown or other
  misc_feature (158)..(158): n is a, c, g, or t
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
  modified_base (554)..(554): a, c, t, g, unknown or other
  misc_feature (554)..(554): n is a, c, g, or t
tcagtcgcactagtcacgaccggtgctcgatttagacgtctcatcaagggaaggaaggggcagcaagatggtgttgcagacccaggtcttctatttctctgttcgctctggacttctcgtggtcgccgtacggganatcgtgatcgaccagtcacganacctccgtggctgtcgtcgtcgnggcgagacggccacgatcaacgtcgtacacggtcncggacgagtacgttcgtttacgacgacgtaactaaacgaaataacttaacgttccttccgtcgtttaacggaccacgaacgaacgaaaaccgtaggaaccgtctaccctaccgttaagtccgtctacgttagtttacggacgcttacgttccggacccgggtggttcccgggtccacggaccttgtcgaggcgtcgacggtgacaggaactacgtacgttagtccgtttacccacagtactacgacgaccgtcgtcgtaacgcgtacgtaacgaacgggtaaaggttacgttacggtcgtttaaacgtttacggtttaagttacgttctaaaccgggngttaacgttaacgttttacgttaacggttacttaccggtaaccggttaacggttaccgggttaccgggtaccggaaccgggttaacgtaccggtaagtacggtaaaccgtacgttaaacgtaacgttaccggtgtactaacgccgtaacgtccgttactacccggtttctcccgttaccgttcccgacc

SEQ ID NO: 41912 - DNA, 696 bp, Homo sapiens
  misc_feature: GYAE6OF02IQUCD.39.1.A01.1.454.CMB.1.raw
  modified_base (665)..(665): a, c, t, g, unknown or other
  misc_feature (665)..(665): n is a, c, g, or t
tcagtcgcactagtcacgaccggtgctcgatttagacgtctcatcaaagggaaggaaggggcagcaagatggtgttgcagacccaggtcttcatttctctgttgctctggatctcgtggtcgccgtacggggacatcggtgatcgacccagtctaccgagtacctccctggcttgtgtctcgtgggcgaggacggccaacgatacaactgactaacgtccgagccaggtacgttcgtttacgacgtacggtaccaaacgtaataacgtaattacgttcgtcgttaggtaccagtacaaacgaaaccgaggtacacgtccttacgtaacggttcgacctacgttacctttaacggcgggtacctacgttaccggtaacccgggtccggtaccccggggtccctacggaaccggtcttaccgacgggtccggaacggtcgggtcggtaccgtaggacgtaacgtacgttactttccggaccttacgtacctacgactaccgacgtacgactccgtacgacgacggtcgtaggagttacgtggtacgtaccgtaagtttactaggtcacgactgtaacgttattacgtagtacgttcctacgtaaggttccggttacggggaccgggtacaggtcaaagtcgtactaacgaagtctggtacgcgtacncctacgcgttcacgttctaccgtccgttacg

SEQ ID NO: 41913 - DNA, 913 bp, Homo sapiens
  misc_feature: GYAE6OF02H8WSA.39.1.A01.1.454.CMB.1.raw
  modified_base (175)..(175): a, c, t, g, unknown or other
  misc_feature (175)..(175): n is a, c, g, or t
tcagtcgcactagtcacgaccggtgctcgatttagacgtctcatcaagggaaggaaggggcagcaagatggtgttgcagacccaggtcttcatttctctgttgctctggatctctggtcgccgtacggggactatcgtgatcgaccctagtcctccagacctcccgtggctggtntctcgtgggcgaggacggccaccatcaacgtgacaaccgccgagaccaagtacgttacgtttaaccacgtacggtaaccaaacgtaaagttaaacgtaatttaccgtcgtacgttacggtaaccgaagtacgaaacgtaaaccgacggtaacgaacgtacccttaacgtaagttcgtactaacgttaacgtttacggtacgggtactaaccgttacccgggtaacccggggtaccgggttaccccgggtacccgttaacggaaccgttaacgttcggtaacggcccgggacggtaacgggccggggttaacgttacgggaaccgttaacggaacggtttacctttaccgaacttacccgtaaccgtacctaaccgtacgtaacggtacgtaccggttaaccgtcggaaccggtacggttaaccggtaagggtaaacggtacgttaggggtaaccggttaacgtttaaacggtttttaacttaccggttaacggttacgaaccggttaaccgggttaagttttaaacgttaaccgggttaagtttaaccccggttcccggtaacggttaaccgggttttaacccgggtttacccgggggacccgggtaactaaccggggtacggtagtaaccggtaacggttaacccggtaaagggtcctaacgggttacggtaaccggtacgtacccgtacgttacgtacccgtttacggtaccctttaccgtaacccgttcccccgg

SEQ ID NO: 41914 - DNA, 916 bp, Homo sapiens
  misc_feature: GYAE6OF02IUKI0.39.1.A01.1.454.CMB.1.raw
  modified_base (107)..(107): a, c, t, g, unknown or other
  misc_feature (107)..(107): n is a, c, g, or t
  modified_base (173)..(173): a, c, t, g, unknown or other
  misc_feature (173)..(173): n is a, c, g, or t
  modified_base (360)..(360): a, c, t, g, unknown or other
  misc_feature (360)..(360): n is a, c, g, or t
tcagtcgcactagtcacgaccggtgctcgatttagacgtctcatcaaaggaaggaagggcagcaagatggtgttgcagacccaggtcttcatttcttctgttgctcnggatctcgtggtcgccgtacgggacagtcgtgatcgacctacgtctccagactcccgtggcttgtntcctcgtggcgaggacggccaaccgtataccaacgtcgaactaacgtccgacgaccgtaggtacgtttacgttttacaaccgtacggtaaccaaactaaacgttaaaacgtaacgttaccttccgtacgttacgtaccgaacgacgaaagaaaccgacggaacctcgtacccgttacctaaggttcncctaacgtttactttacggcgggtactaacgttacccgggtaaccggggtaccgggttaccccggggttccccgtacggaaacccgttacgtttacgaaccgggtccggtaccggaacgggtccggtaacgtacggtaaccgtaccgttaaacggttccttttacccggacccgttacttaacccgaaaccctcggtaacgtaaaccggccggtaacccgtttccgaccgggtacggaccgggtactaaacggtaacgttaagggttactaaccgggttaacttttaacggttaacggtttggttaaccgttacgggtaacccggtcgttaaacgtttaaccgtttaacgttaaacgtttaaccggttacccttaccgggttaaacgtttacccggggttaacgggggtaacccgggtaacccgttaaacgggacggttaaccgggttaacgtaccccgttaaaacggtaaaccggtaggttaccggtaggttaaccgaaccgtaccggtacttaccgttacgttcccgttttaccgtacccttaccggttacccg

SEQ ID NO: 41915 - DNA, 947 bp, Homo sapiens
  misc_feature: GYAE6OF02GF21S.39.1.A01.1.454.CMB.1.raw
  modified_base (104)..(104): a, c, t, g, unknown or other
  misc_feature (104)..(104): n is a, c, g, or t
  modified_base (427)..(427): a, c, t, g, unknown or other
  misc_feature (427)..(427): n is a, c, g, or t
tcagtcgcactagtcacgaccggtgctcgatttagacgtctcatcaagggaagggaaggggcagcaagatggtgttgcagacccaggtcttcatttctctgttnctctggatctctggtcgccgtacggggacacgtcggtgatcgacccgagttcctccagtaccctcccgtaggcttggttcgtaccgttcggtagggcggaaggacgggtacccaaccgataccaacgtcgacgaacgtcccaggaccgaggtacgtttacgtttaaccaccgtaacggtaaccaaaactaaacgttaaaggttaaacttaccgttcgtaccgtttaccggaaccgtaaggaaccgaaaacggtaaaacccgaacgggacctaacggtaccccttaccgttaagttccgtaccttacgttaacgttttaccggngggtaaccttaccggttacccggtacccggggtacgggttccccggggttaacctacgggtaaccgttacgttaccgaacgggtccgggtaacgacgggtccgggttacaggtaaacgacgttaacggttacctttccgaacgttcccttaaccgaacctacgtaacgaccgccgtaacgtccgtacgaaccggtacgtacggtaacgtaaaggttacgtacggttaccggttaacgttttaacttaacggtttacgtaccggttaaagtcgtaaactttaaagttaagttttaaacggacgtttacccggttaccttaaccggggttttacgtttaccgggggttacccggggaaacccgggttaaacgtaccggtttggaaaacggtaacgttaacggtaacccgtaaaacccgggttcggttagggttaaccccgggacctttagggttaaaccccgactttacgttttacccgggttttactaacccttttaccccgggttttaacctcccccggg

SEQ ID NO: 41916 - DNA, 705 bp, Homo sapiens
  misc_feature: GYAE6OF02GSSQK.39.1.A01.1.454.CMB.1.raw
tcagtcgcactagtcacgaccggtgctcgatttagacgtctcatcaaaggaaggaaggggcagcaagatggtgttgcagacccaggtcttcatttctctgttgctctggatctctggtcgccgtacggggacatcgtgatgacccagtctccagacctccctggctgtgtctcgtgggcgagacgggccaccatcaactgacaacgtccagccagtagttgttttacacaggtaccaaactaaataaagtaacttacttcgtacgttcggtaaccaagcaaacgaaaccgaaggacacgccttactaaagttgctactagttacgtgggacacgtccggtaccgggacggtcccgggtacctcgaccgtagttcgacggccggacgacggcggtgtagaacgatagtacttcactctaccacatcacgccacgcctagacggtacgacgttaaggaaacgtgttcggacggttacgttaacggtttttaactacgttacgttacgtaagtcgttaaagtttaacgtttagtacggttaacttaccgttaacgttacgggttttaaccggtttaccggggggaccggggtaaacctaaggtacggttaacgtaacggtactaaacggtaaaaccggtacggttaggtaccggtcgtaacgacccgtaacttcgttcgttaccgttctttacccgtcgttaccccgg

SEQ ID NO: 41917 - DNA, 502 bp, Homo sapiens
  misc_feature: GYAE6OF01B701L.33.63.F08.1.454.CMB.1.raw
  modified_base (351)..(351): a, c, t, g, unknown or other
  misc_feature (351)..(351): n is a, c, g, or t
  modified_base (391)..(391): a, c, t, g, unknown or other
  misc_feature (391)..(391): n is a, c, g, or t
  modified_base (436)..(436): a, c, t, g, unknown or other
  misc_feature (436)..(436): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaattttttggcctggtatcagcagagagaaggggaagttcctagactcctgatctatggtgcatccatttgcaatcaggggtcccatctcgcttcagtggcagtggatttgggacngtatttcactctcaccgtcaccagcctgcaggctaaagtntttgctaactttattactgtacaaaagtatagactagtcgcccgntcacgtttccggccgttaggaccgaaagtgaaatacaaacgactgtagctgacacctatcgttacg

SEQ ID NO: 41918 - DNA, 502 bp, Homo sapiens
  misc_feature: GYAE6OF01EGI87.33.63.F08.1.454.CMB.1.raw
  modified_base (385)..(385): a, c, t, g, unknown or other
  misc_feature (385)..(385): n is a, c, g, or t
  modified_base (425)..(425): a, c, t, g, unknown or other
  misc_feature (425)..(425): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctcgcttcagtggcagtggatttgggacagtatttcgactctcaccgtcaccagcctgcaggntagaatagttttgactaacttattactagtacaaaagttntagtacagtcgcccgctcacgtttcggccctagggaccaaaggtgaaataccaaacgactgtggactgactccatcg

SEQ ID NO: 41919 - DNA, 485 bp, Homo sapiens
  misc_feature: GYAE6OF01BGX1D.33.63.F08.1.454.CMB.1.raw
  modified_base (420)..(420): a, c, t, g, unknown or other
  misc_feature (420)..(420): n is a, c, g, or t
  modified_base (483)..(483): a, c, t, g, unknown or other
  misc_feature (483)..(483): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaattttttggcctggtatcagcagagagaaggggaagttcctagactcctgatctatggtgcatccactttgcaatcaggggtcccatctcgcttcagtggcagtggatttgggacagatttcactctcaccgtcaccagcctgcaggctgaagtattttgctaacttattactgtacaaaagtntagactagtggcccgctcactttcggccctgggaccaagtgaatcaaacgatgtgctagcacntc

SEQ ID NO: 41920 - DNA, 506 bp, Homo sapiens
  misc_feature: GYAE6OF01CV13T.33.63.F08.1.454.CMB.1.raw
  modified_base (194)..(194): a, c, t, g, unknown or other
  misc_feature (194)..(194): n is a, c, g, or t
  modified_base (390)..(390): a, c, t, g, unknown or other
  misc_feature (390)..(390): n is a, c, g, or t
  modified_base (418)..(418): a, c, t, g, unknown or other
  misc_feature (418)..(418): n is a, c, g, or t
  modified_base (500)..(500): a, c, t, g, unknown or other
  misc_feature (500)..(500): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttacaatttttggcctggtatcagcagagagaaggggaagttcctagactcctgatctatggtgcatccactttgcaatcgaggggtcccatctcgcttcagtggcagtgatttgggacagatttcactctcaccgtcaccagcctgcaggctaaagtntttgctaacttattactagtacaaagtntagaactagtcggcctctcgtacttcggaccctagggtaaccaaaggttgaaatacgaaacgacgtgacggtcagacacctntctacg

SEQ ID NO: 41921 - DNA, 552 bp, Homo sapiens
  misc_feature: GYAE6OF01DSK2R.33.63.F08.1.454.CMB.1.raw
  modified_base (346)..(346): a, c, t, g, unknown or other
  misc_feature (346)..(346): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactctgatctatggtgcatccactttgcatcaggggtcccatctcgcttcagtgcagtgagtttgganagatttcacgtctcaccgtcaccagcctgcaggctagaagtattttgactaactttattacttagtactaaaagttatagactaggtcggaccccgtcttacctaaccgtttccggaccccgttaggggaacccgtaaaaggttacggaaacttaccgaaaaccgtaacttacgggttacggacttgacctacccgtagttacccg

SEQ ID NO: 41922 - DNA, 537 bp, Homo sapiens
  misc_feature: GYAE6OF01AXRQY.33.63.F08.1.454.CMB.1.raw
  modified_base (412)..(412): a, c, t, g, unknown or other
  misc_feature (412)..(412): n is a, c, g, or t
tcagtacacacactcacgaccggtgctcgatttagcgatcgtataaggggcgagaagtccgtctctcagttcaggacacagacgaagtggacatgaggtccctgtcctccacgctccgtgggacctcctgctgcgtctggctacccgagataccagatgtgacgtccagatgacccagtctccatcctccctgtctgcatcagtgggagacagagtcaccatcacttgccgggcgagtcggacatttactaatttttggcctggtatcagcagagagaaggggaattctagactcctgatctatggtgcatcctactttgctaatcgaaggggtcccatctcgcttcagtggcagtggtatttgggacagtatttcactctccaccgtcaccacgctcgcaggactaaagtnttttagactaacttattactagtaactaaagtatagactagtcgcccgtctctactttcggcccgttagggaaccaaaggtgaaataacgaaacgtactaggtacgacgtgaccacctgtcgtcg

SEQ ID NO: 41923 - DNA, 521 bp, Homo sapiens
  misc_feature: GYAE6OF01BMRS8.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttactaatttttggcctggtatcagcagagagaagggaagttcctagactcctgatctatggtgcatccactttgcaatcgagggtcccatctcgcttcagtggcagtggtatttggactagtatttcactctcaccgtcaccagcctgcaggctagaagtattttgactaactttacttactgtaactaaagttatagtactagtcggccctactctacgtttcggacccgtagggaacctaaaggtacgaaatccgaaaacgtaactcgtaggctagaccactagtcg

SEQ ID NO: 41924 - DNA, 533 bp, Homo sapiens
  misc_feature: GYAE6OF01AGXYS.33.63.F08.1.454.CMB.1.raw
  modified_base (283)..(283): a, c, t, g, unknown or other
  misc_feature (283)..(283): n is a, c, g, or t
  modified_base (408)..(408): a, c, t, g, unknown or other
  misc_feature (408)..(408): n is a, c, g, or t
  modified_base (456)..(456): a, c, t, g, unknown or other
  misc_feature (456)..(456): n is a, c, g, or t
  modified_base (525)..(525): a, c, t, g, unknown or other
  misc_feature (525)..(525): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggactatttactaatttttggcctggtatcagcagagagaaggggattccagactccngatctatggtgcatccactttgcaatcgagggtcccatctcgcttcagtggctaggtggagtttgggactaggtactttcacgttcctcgtacccgtcaccgagtcctgccaggaccttaaagtntttgactaactttattactagtaactaaagtatagactaggtcgcccnctctacgttcggccctagggacctaagggtcgaaataccgaaacgtacgtagtcggtactcgactaccngttcgtcg

SEQ ID NO: 41925 - DNA, 512 bp, Homo sapiens
  misc_feature: GYAE6OF01EINLB.33.63.F08.1.454.CMB.1.raw
  modified_base (219)..(219): a, c, t, g, unknown or other
  misc_feature (219)..(219): n is a, c, g, or t
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggngagtcgggacatttacaatttttggcctggtatcagcagagagaaggggaagttcctagactcctgatctatggtgcatccactttgcaatcaggggtcccatctcgcttcagtggcagtggatttgggactagtatttcactctcaccgttcaccagcctgcaggctgaagtnttttgactaacttattactgtacaaagtntagactagtcggacccgtctcactttcgggccctagggacccaaaggtaggaaatcgaaacgtaactgtaggactagacctacgattccg

SEQ ID NO: 41926 - DNA, 559 bp, Homo sapiens
  misc_feature: GYAE6OF01B0P45.33.63.F08.1.454.CMB.1.raw
  modified_base (194)..(194): a, c, t, g, unknown or other
  misc_feature (194)..(194): n is a, c, g, or t
  modified_base (402)..(402): a, c, t, g, unknown or other
  misc_feature (402)..(402): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttggccgggcgagtcgggactatttacaattttttggcctggtatcagcagagagaaggggaagttcctagactcctgatctatggtgcatcctactttgctaatcaggggtcccatctcgtcttcaggtggcaggtgagtttgggactagtatttcacttctcaccgtcaccagcctgcaggtctaaagtnttttagactaatttatactagtacaaagtatagactagtcgtacccgtactaccgtacgtttccggacccgttacgggaacccgtaaaggtacggtaaaattaccgaaaacggtaacgttaggtacggtacgtacgacctaacctagtcgtttaccg

SEQ ID NO: 41927 - DNA, 541 bp, Homo sapiens
  misc_feature: GYAE6OF01CQNXJ.33.63.F08.1.454.CMB.1.raw
  modified_base (355)..(355): a, c, t, g, unknown or other
  misc_feature (355)..(355): n is a, c, g, or t
tcagtacacacactcacgaccggtgctcgatttagcgatcgtataagggggcagaagtctctctcagtcaggacacagcatggacatgagggtccctgctcagctcctgggactcctgctactctggctccgaggtgccagatgtgacatccagatgacccagtctccaccctccctgtctgcatctgtcggagacagagtcaccatctcttgccgggcaagtcagagcatcgtcgctatttaaattggtatcagcagaaaccagggcaagcccctaaactcctgatctatgctgcgtccagtctgcaaagtcgggtcccagtcaaggttcagtggcagtggatcgtggacagtntttcactctcaccatcagcagtctagactaactgaagtattttgactaacttacttctgtacaactactagttaacaactcctacccgttactacgttttcggaccgtacggggtaaccctaaggacgttagggaacgtacgttacgtaacgggtaccgtaaacgttcggtacgggtcgttaccgg

SEQ ID NO: 41928 - DNA, 547 bp, Homo sapiens
  misc_feature: GYAE6OF01DU1V9.33.63.F08.1.454.CMB.1.raw
  modified_base (379)..(379): a, c, t, g, unknown or other
  misc_feature (379)..(379): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcgaggggtcccatctcgcttcagtggcagtggatttgggacagatttcactctcacgtcacagcctgcnggctgaagtattttgactaactttattactgtaactaaaagttatagtacaggtcgcccgtctcctaccgtttccgggaccccttacgggaacccgtaaaaggttacgggaaaacttaccgaaaaacggtaaccttggttacggaccttagacctaccgtattacccg

SEQ ID NO: 41929 - DNA, 539 bp, Homo sapiens
  misc_feature: GYAE6OF01ECLSG.33.63.F08.1.454.CMB.1.raw
  modified_base (388)..(388): a, c, t, g, unknown or other
  misc_feature (388)..(388): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcggggacatttacaattttttggcctggtatcagcagagagaaggggaagttcctagactcctgatctatggtgcatccatttgcatcagggtcccatctcgcttcagtggcagtggatttggacagatttcactctcaccgtcaccagcctgcaggcttaaagnttttcgactaactttattactgtaacaaagttatagactagtcggccctctactaccgtttccggcccgtagggaacccgtaaaggtacggtaaactacgtaaaccggaacgttggtacggtactacggacctaaccgacgttcttaccgg

SEQ ID NO: 41930 - DNA, 512 bp, Homo sapiens
  misc_feature: GYAE6OF01CKF7U.33.63.F08.1.454.CMB.1.raw
  modified_base (506)..(506): a, c, t, g, unknown or other
  misc_feature (506)..(506): n is a, c, g, or t
tcagtacacacactcacgaccggtgctcgatttagcgatcgtataagggggcgagaagtctctctcagtcaggacaccagcatggacatgagggtccctgctcagctcctggggctcctgctactctggctccgaggtgcccagatgtgacatccagatgacccagctccatcctccctgtctgcatctgtaggagacagggtcaccatcacttgccgggcaagtcagagcataagcaactatttaaattggtatcaacagaaaccagggaaagcccctaaggtcctgatctatgctgcgtccagtttgacagagcgggtcccatcgaaggttcagtggcagtggatcgtgggacagatttcactctcacataagcagtctggaacctgaagtagttttaggaagtatacttctgtacaatagtaacttatacgtaaccttactactttcggcctagggtaccaagcgtaggagtatacgaagtcggaactggtcgtctgcacctntcttcg

SEQ ID NO: 41931 - DNA, 542 bp, Homo sapiens
  misc_feature: GYAE6OF01DTXW6.33.63.F08.1.454.CMB.1.raw
  modified_base (195)..(195): a, c, t, g, unknown or other
  misc_feature (195)..(195): n is a, c, g, or t
  modified_base (437)..(437): a, c, t, g, unknown or other
  misc_feature (437)..(437): n is a, c, g, or t
  modified_base (456)..(456): a, c, t, g, unknown or other
  misc_feature (456)..(456): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtcctgcatcagtggganacagagtcaccatcacttgccgggcgagtcgggactatttacaatttttggcctggtatcagcagagagagggaagttcctagactcctgatctatggtgcatcctatttgcaatcgaggggtcccatctctcttcagtggcagtggatttggggactagtatttccacttctacgacccgtcacctagtcctgcaggcctagaacgtattttgactaactttattactagtactaaaagtntagaactaggtcgcccgtntcctacgtttccggccctaggggacctaaaacggtaggaaactcgaaaaccgtaatcggtacggtctaacgcctaacctagttccg

SEQ ID NO: 41932 - DNA, 484 bp, Homo sapiens
  misc_feature: GYAE6OF01ESOKW.33.63.F08.1.454.CMB.1.raw
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
  modified_base (482)..(482): a, c, t, g, unknown or other
  misc_feature (482)..(482): n is a, c, g, or t
tcagtacacacactcacgaccggtgctcgatttagcgatcgtataaggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaagggaagttcctagactcctgatctatggtgcatcactttgcaatcaggggtcccatctcgcttcagtggcagtggatttgggacagatttcactctcaccgtcaccagcctgcaggctgaagtattttgctaactttattactgtacaaaagtntagacagtcgcccgntcactttcgccctagggaccaaagtgaaactcaaacgatgtgactgcacntc

SEQ ID NO: 41933 - DNA, 590 bp, Homo sapiens
  misc_feature: GYAE6OF01BI8O3.33.63.F08.1.454.CMB.1.raw
  modified_base (192)..(192): a, c, t, g, unknown or other
  misc_feature (192)..(192): n is a, c, g, or t
  modified_base (584)..(584): a, c, t, g, unknown or other
  misc_feature (584)..(584): n is a, c, g, or t
tcagtacacacactcacgaccggtgctcgatttagcgatcgtataaggggcagaagtctctctcagtcaggacacagcatggacatgagggtccctgctcagctcctgggactcctgctgctctggctcccagataccagatgtgacgtccagatgacccagtctccatcctcctgtctgcatcagtggganacagagtcacatcacttgccggcgaggtcggacatttacaatttttggcctggtatcagcagagagaagggagtctagactctgatctatggtgcatcctactttgactaatcgacggggtcccatctcgtcttcaggtgcgtagtggagtttggactagtatttcacgtctcaccgttccaccacgcctgtaccagggtctacggtaaagtacgttttgaacgtaactttattaacgttagttaaactaaaaggttatacgtaaccgtaaggtccggtacccgtacgtaccttacccggtttccgacccgttacggggtaaacccgtaaacggttaaggaaacctaacggtaaaaccgtacgttacggtacggactacggactaacccgtnttaccg

SEQ ID NO: 41934 - DNA, 489 bp, Homo sapiens
  misc_feature: GYAE6OF01CIRF5.33.63.F08.1.454.CMB.1.raw
  modified_base (194)..(194): a, c, t, g, unknown or other
  misc_feature (194)..(194): n is a, c, g, or t
  modified_base (459)..(459): a, c, t, g, unknown or other
  misc_feature (459)..(459): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcaagtcagagcataagcaactatttaaattggtatcaaacagaaaccagggaaagcccctaaaggtccctgatctatgactgcgtccagtttgcagagcggggtccagtcaaggttcagtggcagtggatgtggacagatttcactctacacatcagcagtctgcaacgtgaagtattttgactaacttactactgtacaacagagtacacaacacccattcacttcgccctgggacccanagtcgatcgactaaccgactgtcgctgacc

SEQ ID NO: 41935 - DNA, 497 bp, Homo sapiens
  misc_feature: GYAE6OF01D5FB1.33.63.F08.1.454.CMB.1.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
  modified_base (469)..(469): a, c, t, g, unknown or other
  misc_feature (469)..(469): n is a, c, g, or t
  modified_base (494)..(494): a, c, t, g, unknown or other
  misc_feature (494)..(494): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtcttcatctgtaggagacagagtcaccatcacttgccggcaagtgagngcattagaacctattgaattggtatcagcagagaccagggaaacgccccaaactcctgatctctgccgnatccgatttacacaagtcgggtcccagtcgagttcagtgcagtgatcgtggacagtactttcactctcacataagcagtctagacctagaagttatttaggaatattacttctgtacaactagtaacttagtaacgtaaccctatacgtttcggaccaagggaccagctagganatacgaagcaatgtcgactgacacntcg

SEQ ID NO: 41936 - DNA, 508 bp, Homo sapiens
  misc_feature: GYAE6OF01AHDS5.33.63.F08.1.454.CMB.1.raw
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
  modified_base (503)..(503): a, c, t, g, unknown or other
  misc_feature (503)..(503): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggattcctagactcctgatctatggtgcatccatttgcaatcaggggtcccatctcgcttcagtggcagtggtatttggggactaggtatttcactctcaccgtcaccagcctgcctaggacttaaagtntttgactaacttattactgtacaaagtntgactagtcgccnctcactttcggccctagggaccaaggtcgaaatacgaaacgaacgtgtacggtctacgaccacctntctcg

SEQ ID NO: 41937 - DNA, 532 bp, Homo sapiens
  misc_feature: GYAE6OF01C5U3U.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttactaatttttggcctggtatcagcagagagagggattcagactctgatctatggtgcatccactttgactaatcgagggtcccatctcgtcttcagtggcgtagtggtagtttgggactagtactttcacttctccaccgtcaccagcctgcaggctagaagttatttgacttaacttcttctgtacaactactagttacaattccttaccgtactacgtttcggaccgtacgggtaccaaggtcgtaggaacgtacgtacgacgggaccgtaacgtcgggtaggcgtcgcctaacccg

SEQ ID NO: 41938 - DNA, 543 bp, Homo sapiens
  misc_feature: GYAE6OF01E00VO.33.63.F08.1.454.CMB.1.raw
  modified_base (392)..(392): a, c, t, g, unknown or other
  misc_feature (392)..(392): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctcgcttcagtggcagtggatttgggacagtatttcactctcaccgtcaccagcctgcaggctagaagtntttgctaacttattactagtacaaaagtctagaactaggtcggcccgcttcctaccgttttccgggaccccgttaggggaaccctaaagggttaggaaaacttccgaaaacgtaacgtacggttcggactacggcctaaccgtagttaccg

SEQ ID NO: 41939 - DNA, 500 bp, Homo sapiens
  misc_feature: GYAE6OF01AGBZD.33.63.F08.1.454.CMB.1.raw
  modified_base (421)..(421): a, c, t, g, unknown or other
  misc_feature (421)..(421): n is a, c, g, or t
  modified_base (472)..(472): a, c, t, g, unknown or other
  misc_feature (472)..(472): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttccgtagactcctgatctatggtgcatccactttgcaatcaggggtcccatctcgcttcagtggcagtggatttgggacagatttcactctcaccgtcacacgcctgctaggttaagattttgactaactttattacgtgtacaaagtntagacagtcgcccgtctacgtacttccggccctggacctaagtcgaaatanaaacgactgtgctcgactaccatctgtc

SEQ ID NO: 41940 - DNA, 542 bp, Homo sapiens
  misc_feature: GYAE6OF01CRIRD.33.63.F08.1.454.CMB.1.raw
  modified_base (194)..(194): a, c, t, g, unknown or other
  misc_feature (194)..(194): n is a, c, g, or t
  modified_base (441)..(441): a, c, t, g, unknown or other
  misc_feature (441)..(441): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttactaatttttggcctggtatcagcagagagagggagttcctagactcctgatctatggtgcatccactttgcaatcgacggggtcccatctcgtcttcagtggctaggtggtatttgggactagtatttcacttctacctaccgtccaccacgtccctgaccgaggtactaaagtattttcgactaactttatactagtactaaagtntagactaggtcgcccgtctcctacgtttcccggccgtacgggaaccctaaaggtacggaaatacgaaacgtacgttgaggtctacgaccacctgttctacg

SEQ ID NO: 41941 - DNA, 520 bp, Homo sapiens
  misc_feature: GYAE6OF01A7WEP.33.63.F08.1.454.CMB.1.raw
  modified_base (400)..(400): a, c, t, g, unknown or other
  misc_feature (400)..(400): n is a, c, g, or t
  modified_base (431)..(431): a, c, t, g, unknown or other
  misc_feature (431)..(431): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggactattactaatttttggcctggtatcagcagagagaaggggaagttcctagactcctgatctatggtgcatcctactttgcaatcgacggggtcccatctcgtcttcagtggctagtggtagtttgggacagtatttcactctcaccgtcaccagcctgcaggctagaagtnttttgactaacttattactagtactaaagtntagacagtcgcccgctctacttccggcccgtagggaacctaaaggtggaaactaccgaaacgtacttaggtcggctagaccactatccg

SEQ ID NO: 41942 - DNA, 551 bp, Homo sapiens
  misc_feature: GYAE6OF01EZBWP.33.63.F08.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggngagtcgggactatttacaattttttggcctggtatcagcagagagaaggggaagttcctagactctgatctatggtgcatccactttgcaatcaggggtcccatctcgcttcagtggcagtggatttgggacagtatttcactctcaccgtcaccagcctgctaaggttaagtattttgactaactttattactagtactaaagtatagactaggtcgcccgtctacctacgtttccggcccgttacgggaaccctaaaggttcggtaaaactacgaaaaccggtaacgtaggtacggaccgtcggaccaaccgtacttccgtgtttacccg

SEQ ID NO: 41943 - DNA, 499 bp, Homo sapiens
  misc_feature: GYAE6OF01CAO6S.33.63.F08.1.454.CMB.1.raw
  modified_base (421)..(421): a, c, t, g, unknown or other
  misc_feature (421)..(421): n is a, c, g, or t
  modified_base (494)..(494): a, c, t, g, unknown or other
  misc_feature (494)..(494): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggactatttacaattttttggcctggtatcagcagagagaaggggaagttcctagactcctgatctatggtgcatccactttgcaatcaggggtcccatctcgcttcagtggcagtggatttggacagtatttcactctcaccgtcaccagcctgcaggctgaagtattttgctaactttattactgtacaaagtntagacagtcgcccgctcacttcgcccgtaggaacctaagtggaaatcgaaacgaactgtacgctagctaccgnttccg

SEQ ID NO: 41944 - DNA, 559 bp, Homo sapiens
  misc_feature: GYAE6OF01ADEWM.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttacaatttttggcctggtatcagcagagagaaggggaagttcctagactcctgatctatggtgcatccactttgcaatcaggggtcccatctcgcttcagtggcagtggatttgggacagtatttcacttctcaccgtcacccagcctcgcaggcctaggtaagtattttagactaactttattactagtacctaaaagttatagactaggtcgcccgtctacctacgtttccgggtccccgtacggggtaacccgtaaaggtagggtaaaactccgtaaaaacggtaaccgttaggtacggtacgtagaccctacgtagttacccg

SEQ ID NO: 41945 - DNA, 534 bp, Homo sapiens
  misc_feature: GYAE6OF01B8PCQ.33.63.F08.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (422)..(422): a, c, t, g, unknown or other
  misc_feature (422)..(422): n is a, c, g, or t
  modified_base (457)..(457): a, c, t, g, unknown or other
  misc_feature (457)..(457): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgganacagagtcaccatcacttggccggngagtcgggactatttacaatttttggcctggtatcagcagagaggaagggaagttcctaggactcctgatctatggtgctatcctactttgactaactcgacggggtccctatcctcgcttcgagttcggctaggtcggtagtttggggactaggtatttcacctctccaccgtcaccacgtcctgcctaggcctaggaacgtnttttacgacttaactttattacctagtacaaagtntagactagtcgccgtctctcgttcgaccgtggtaacgaacgtagaaactcgaaacgactgtacgacanctanttacg

SEQ ID NO: 41946 - DNA, 576 bp, Homo sapiens
  misc_feature: GYAE6OF01DC7LA.33.63.F08.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatccctccctgtctgcatcagtggganacagagtcaccatcacttgccgggngagtcgggacatttactaatttttggcctggtatcagcagagagagggatctagactctgatctagtggtgctatcctatttcgactaatcgaggggtccctatccgtcgtcttcgaggttcggacgtaggtggtagttggaactagtacttcacttctcaccgtcaccagcctgacgagtctagtaagttatttgacttaacttattacgtataacgtaaaagttcgtagaccgtagtcggtcccgtacttaccgtaaccgttttccgggaccccgttagggtaaaccccgtaaaagggtacgaaacgttaaccgaaacgtagttacggtcggactacggaccaccgtcttaccg

SEQ ID NO: 41947 - DNA, 553 bp, Homo sapiens
  misc_feature: GYAE6OF01DG59Q.33.63.F08.1.454.CMB.1.raw
  modified_base (220)..(220): a, c, t, g, unknown or other
  misc_feature (220)..(220): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (406)..(406): a, c, t, g, unknown or other
  misc_feature (406)..(406): n is a, c, g, or t
  modified_base (546)..(546): a, c, t, g, unknown or other
  misc_feature (546)..(546): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatccctccctgtctgcatcagtgggagacagagtcacatcacttggccgggngagtcgggactatttaactatttttggcctggtatcagcagagagagggattctagactcngatctagtggtnctactcctattgacaatcgacgggtcccatctcgcttcagtggctaggtggtagttggactagtatttcacttctcaccgtcacctagtcctagcacggtctaggtaacgttntttacgactttaaacttatttaactagtaaacgtaaagttacgtagacgtacggtcggaccctcgtaccgttaccgtttccggacccgttaggaaccgtaaaggtagaaactacgaaacgtactaggtcgtactcgaccnctagtcg

SEQ ID NO: 41948 - DNA, 810 bp, Homo sapiens
  misc_feature: GYAE6OF01CMEEO.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatcgacccagtcctccactccctccctgtctgcatcgaggtgggagacagagtcaccatccacgttcggccgggcgtaggtcggggactaattttacttaagttttttcggccttaggtactacgagacgaggaaggagggaaggggtaacgtttccgtaacggtaccttccgtaggtacttacgtaagttcgggtagtacctacttacccttacgttttacgacctaacgttaccggtaaccgggggttaccctaagttccgtccgtaccttcggagggtcggtacgtagggtttacggtaggttttacggggaactaaggttactttaccgaaccttcccgttacctacccgttccaaccgtacgtcccgttacggaccgtacgggtacgtaacgggttaaacgtttacgttttacggaacctttaaacgtttttatttaaaccgttaagttaaacctaaaaaggttccgtaacggtaaccgttacgggttcccggtaccccgttaccggttacccgttacccggtttacccgggtaccccggtttaaggggaaaaccccgttaaaagggtaccggtaaaaccgttacgaaaaaccggttaacggttcgggtaccggtacccgtaacggtaccctaccggttaagtttacccgg

SEQ ID NO: 41949 - DNA, 580 bp, Homo sapiens
  misc_feature: GYAE6OF01DX0GG.33.63.F08.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (475)..(475): a, c, t, g, unknown or other
  misc_feature (475)..(475): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcaggtgganacagagtcacntcacttgccgggagaggtcggactatttactaatttttggccttggtatcagcagagaggaagggaagttcctagactcctagatactagtggtgactatcctactttgactaagtcgacggggtccctagtcctcgtccttacgaggtcggctaggtgtagtttagggacctaggtactttacgacttccgtacctacccgtcaaccacgtcctacgcacggtataggtaagtacgtttacgactaactttatactagtaactaaagtntacgtacgtagtcgacctctacgtacgttccgaccgtacggtaaccgtaaggtagaaactaacgaaacgtaacgtacggtacggtactaggaccactgttacccg

SEQ ID NO: 41950 - DNA, 531 bp, Homo sapiens
  misc_feature: GYAE6OF01EL2IC.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggactatttacaattttttggcctggtatcagcagagagaaggggaagttcctagactcctgatctatggtgcatccactttgcaatcaggggtcccatctcgcttcagtggcagtggagtttgggactagtatttcacttctcacctatcagcagtctgactaacctgaagtattttcgactaactttacttctcgtacaactatacgttacaacttcctacccgtactaccgtttcggacccgtagggtacccgtaaggtcgttaggacgtactcgaacggtcgaacgtggtcggcgtgacccg

SEQ ID NO: 41951 - DNA, 597 bp, Homo sapiens
  misc_feature: GYAE6OF01DHSQF.33.63.F08.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (299)..(299): a, c, t, g, unknown or other
  misc_feature (299)..(299): n is a, c, g, or t
  modified_base (392)..(392): a, c, t, g, unknown or other
  misc_feature (392)..(392): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgganacagagtcaccatcacttgccgggnagtcggactatttactagtttttgcctggtatcgagcgagaggagaagggtacgttctagtactcgtagactcgtatggtnctactcctattgactaatcgacgggtccattcgtcgtcttcagtcggactaggtggtattggactagtactttcactcctacaccgtcaccgngtcctgcgaggctaggtaagttgttttgaccttaacgtttacttacgtagttaacctaaaagttcgtagacgtacggtcggtaccccgtacttaccgtacccgtttccgggaccccgttagggaaacccgtaaaacggtaggtaaaacttacccgaaaacggtaacgttacgggtacggtacctacggacctaccgtacgttccg

SEQ ID NO: 41952 - DNA, 646 bp, Homo sapiens
  misc_feature: GYAE6OF01EG7TN.33.63.F08.1.454.CMB.1.raw
  modified_base (302)..(302): a, c, t, g, unknown or other
  misc_feature (302)..(302): n is a, c, g, or t
tcagtacacacactcacgaccggtgctcgatttagcgatcgtataagggggcagaagtctctctcagtcaggacacagcatggacatgaggtccctgctcagctcctgggactcctgctgctctggctcccagataccagatgtgacgtccagatgacccagtcctccatccctccctgtctgcatcgagtgggagacagacgtcaccatccacgttcggccgggcgaggtcggactatttactagtttttggccttggtatcagcagagaggaagggtattcgagactctgatctagtgtnctatcctactttcgactaacgtcgtacgggtcccagttcgtacgtcttacgaggtcggctaggtagggtagtttcggagtagttactttccaccttcctaccctaccgtccacccgtacgtccgtacggacgtacggttaacttaagtttcgtttacgactttaaacgtttacgtttaactagttaaactaaagttctacgacgtaacggttcccgacccgttacttacggttacccgtttccggacccgttacggaaaccgttaaaggtaccggtaaaagtaccgtaaaaacggtacgttaggtacggtacgtaacgtacccaacgttcttcggtttaacccg

SEQ ID NO: 41953 - DNA, 624 bp, Homo sapiens
  misc_feature: GYAE6OF01A9LV9.33.63.F08.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (288)..(288): a, c, t, g, unknown or other
  misc_feature (288)..(288): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctccagataccagatgtgacgtccagatgacccagtctccatccctcctgtctgcatcgaggtggganacagacgtcaccatcacgttggccgggnagtcagagcaataagactaaacttaatttaaagttggtatacaacgaagaaaccgaggggaaacnccccgtaaggtcctaggactctatgtcgtgcgtcctagttcgacaggacggtccggggtacccagtacgaaggttcaggtcggacaggtggtagtcgtaggactagtacgtttcacttctaccaccgtatcacgtctacgtcagacgtaagtcgaaagttgtttacgaccttaactttactacgtacgtaacaacgtacggtaacttaccaaacctaacccgtaccctacttaccgttaacccgttccggtaccccgtagggtaccctaaggtacgtacgggacttaccggtaaacccgtaaccgttacggttacggtcgtaccgtcggtaacccg

SEQ ID NO: 41954 - DNA, 616 bp, Homo sapiens
  misc_feature: GYAE6OF01CG5T7.33.63.F08.1.454.CMB.1.raw
  modified_base (195)..(195): a, c, t, g, unknown or other
  misc_feature (195)..(195): n is a, c, g, or t
  modified_base (305)..(305): a, c, t, g, unknown or other
  misc_feature (305)..(305): n is a, c, g, or t
  modified_base (475)..(475): a, c, t, g, unknown or other
  misc_feature (475)..(475): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatccctccctgtctgcatcagtggganacagagtcaccatcacgttggccgggcgaggtcggactattttactaagttttttggccttggtatcgagacagagaggaagggagttccagactcgtgatctagtggtnctatcctatttgactaagtcgacgggtcccattccgtcgtcttcgagtcggacgtaggtggtagtttggacgtagttactttcgacttctcctacccgtcacccagcctgacgtaggctagtaagttagtttacgacttaaactttattacgtagttaactaaaggttanacggtacgacggttccggacccttccgtaccgttccggtttacccggccccgttaaggggaaacccgtaaagggtaggaaaacttaccgaaaaccggtagttacgggtacgacggttacgaaccctaccgacgtttacccg

SEQ ID NO: 41955 - DNA, 622 bp, Homo sapiens
  misc_feature: GYAE6OF01EZSHQ.33.63.F08.1.454.CMB.1.raw
  modified_base (398)..(398): a, c, t, g, unknown or other
  misc_feature (398)..(398): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctcctgtctgcatcagtgggagacagagtcaccatcacttgccgggcgagtcgggactatttactaatttttggcctggtatcagcagagagaagggaagttcctagactcctgatctagtggtgcatcctactttgactaagtcgacggggtcccagtcctcgtcttcgagtggcgaggttcggagtttaggggactaggtactttcacttctaccaccgtcaccncgcctgcaggcctaggaacgttatttcgacctaaacgttttacttaacgttgtaacctaaaagtacgttaggaacgtacggttcggaccccgtaccgttaccgttaaccgttttccgggaccccggttaggggtaaacccgtaaaacgggttaacggaaaacgttaacgtaaaaccggtaaccgttacgggttaccggacgttagaccctaccgtagttacccg

SEQ ID NO: 41956 - DNA, 529 bp, Homo sapiens
  misc_feature: GYAE6OF01D5OQ6.33.63.F08.1.454.CMB.1.raw
  modified_base (194)..(194): a, c, t, g, unknown or other
  misc_feature (194)..(194): n is a, c, g, or t
  modified_base (338)..(338): a, c, t, g, unknown or other
  misc_feature (338)..(338): n is a, c, g, or t
  modified_base (380)..(380): a, c, t, g, unknown or other
  misc_feature (380)..(380): n is a, c, g, or t
  modified_base (523)..(523): a, c, t, g, unknown or other
  misc_feature (523)..(523): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggactatttactaatttttggcctggtatcagcagagagaagggagttcagactctgatctagtggtgctatcctactttgactaagtcgacggggtcccatctcgtcttcgngtggcgtagtggtagttggactagtattcactctcactcacngctgcgagctagaatatttcgactaactttattacgtagtaactaaagtatacgtacgtacgtcggcccgtactcgtaccgttccggcccgtacgggaaccgtaaagtacgaaactacgaaacgtacgtagtcgactagaccnctatcg

SEQ ID NO: 41957 - DNA, 509 bp, Homo sapiens
  misc_feature: GYAE6OF01CY50B.33.63.F08.1.454.CMB.1.raw
  modified_base (194)..(194): a, c, t, g, unknown or other
  misc_feature (194)..(194): n is a, c, g, or t
  modified_base (400)..(400): a, c, t, g, unknown or other
  misc_feature (400)..(400): n is a, c, g, or t
  modified_base (427)..(427): a, c, t, g, unknown or other
  misc_feature (427)..(427): n is a, c, g, or t
  modified_base (502)..(502): a, c, t, g, unknown or other
  misc_feature (502)..(502): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcacatcacttgccgggcgagtcgggactatttactaatttttggcctggtatcagcagagaggaaggggaagttcctagactcctgatctagtggtgcatcctactttgacaatcgacgggtcccatctcgcttcgagtggctagtggtatttggactagtattcactctcaccgtcaccagcctgacaggactaagtntttgactaacttatactgtataaagtntagactagtcgccctctctacgttccgaccgtagggaaccaaggtacgaatacgaaacgactggtgtctagcacntcgtacg

SEQ ID NO: 41958 - DNA, 681 bp, Homo sapiens
  misc_feature: GYAE6OF01BC2FK.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatccctccctgtctgcatcagtgganacagatcaccatcacttgccggcgagtcggacatttacaatttttggcctggtatcagcagagagaaggggaattcctagacctcctggatcgtatggtgcacgtcctaacttttcgactaagtcgacggggtcccacttctcgtcttcaggtcggactaggttggtagtttcgggaacgtagtacggttttcctaaccttctacccgtaaccgttccacccgtacgcccgttggaccgtacgggtcctaaggtaacgttacgttttttcgaacccgtttaaacttttacgtttaaaccgttagttaaaccgtaaaaaggttacggtaggtaaccggtaacgggttcccgggtaccccggtctttacccgttaacccggtttttcccggaccccggttaccgggtaaacccgtaaaggttaacgggtaaacttaacccgaaaacgtaacgttcggtacggtacgtacggaccaacctacgttaccgg

SEQ ID NO: 41959 - DNA, 624 bp, Homo sapiens
  misc_feature: GYAE6OF01D6LSS.33.63.F08.1.454.CMB.1.raw
  modified_base (194)..(194): a, c, t, g, unknown or other
  misc_feature (194)..(194): n is a, c, g, or t
  modified_base (305)..(305): a, c, t, g, unknown or other
  misc_feature (305)..(305): n is a, c, g, or t
tcagtacacacactcacgaccggtgctcgatttagcgatcgtataagggggcagaagtctctctcagtcaggacacagcatggacatgaggtccctgctcagctcctgggactcctgctgctctggctcccagataccagatgtgacgtccagatgacccagtctccatcctccctgtctgcatcaggtggganacagacgtcaccatccacgttcggccgggcaggtcggacttatttactaagtttttggcctggtatcagcgagagaggaagggaattcctagactcctagatctagtggtncatcctatttgctaatcgacgggtcccattcctcgtcttacgaggtcggctaggtggtagttttgggactagttactttcaacgttctaccgaccgtacaccctacgccttacggacgtacgtaccgttagtaaccgttagttttacgaacctttaaacttttaacggtttaaccttacggtaaaccgtaaaagtttacgtagtaacgtacggtcggtaacccctcgttaccgtaccgtttccggacccgtagggaaccctaaagggtactaaactacgaaacggtacgtcgtaacgcctaagccctacctacgttccg

SEQ ID NO: 41960 - DNA, 626 bp, Homo sapiens
  misc_feature: GYAE6OF01D7REL.33.63.F08.1.454.CMB.1.raw
  modified_base (195)..(195): a, c, t, g, unknown or other
  misc_feature (195)..(195): n is a, c, g, or t
  modified_base (515)..(515): a, c, t, g, unknown or other
  misc_feature (515)..(515): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcaggtggganacagacgtcaccatccacgttcggccgggcgaggtcgggactattttaactaagtttttggccttggtatcgagcaagagaggaaggggtattccgtagactcctgtatctagtggtcgctagtcctacgtttgactaacgtcggacggggtccctaagttcgtcgtcttcgaggtggcgtaggtggtagtttgggaactaggttactttcacgttcctaccgaccgtaccacccgtacgtcctggaccgacggtcctaaggtaacgttacgttttacgaacctttaaacgtttacttaaccgtagttaactaaaagttntacggaactacggtcggcccctattaccgaccggtttccggacccgtagggaacctaaaggtagtaaactacgaaaacgttcgtagtcggactacgacctacgtcgttacg

SEQ ID NO: 41961 - DNA, 548 bp, Homo sapiens
  misc_feature: GYAE6OF01BV9FM.33.63.F08.1.454.CMB.1.raw
  modified_base (220)..(220): a, c, t, g, unknown or other
  misc_feature (220)..(220): n is a, c, g, or t
  modified_base (536)..(536): a, c, t, g, unknown or other
  misc_feature (536)..(536): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttggccgggngagtcgggactatttactaagtttttggccttggtatcagcagagaggaagggtagttccagactcctgatctagtggtgacatcctatttgacaagtcgacggggtcccagtctcgtcttgagtgcagtggtagttggactagtactttcacttctacaccgtcaccgacgccgtgcgagctagtaagtatttagactaactttattaacgtgtaactaaagttatagaacgtagtcggacccgtactccgtacgttccggacccgtagggaacctaaaggtacgaaattaccgaaagtacgtcgtagacgtacnctacctgttccg

SEQ ID NO: 41962 - DNA, 638 bp, Homo sapiens
  misc_feature: GYAE6OF01BG8A3.33.63.F08.1.454.CMB.1.raw
  modified_base (323)..(323): a, c, t, g, unknown or other
  misc_feature (323)..(323): n is a, c, g, or t
tcagtacacacactcacgaccggtgctcgatttagcgatcgtataagggggcagaagtctctctcagtcaggacacagcatggacatgaggtccctgctcagctcctgggactcctgctgctctggctcccagataccagatgtgacgtcagatgacccagtcctccatccctcctgtcctgcatcgaggtgggagacagacgtcaaccattcacgttcggccgggcgaggtcggatatttacgtaagttttttcggccttggtactcgtagacgaggagaaggagggtaagttctacgacgttccgtgacttctagttaggnacgtatcctatttgactatccggacggtccagtccgtcgtcgttcgaggtcggacgttaggtggtagtttacgggaactagttacgtttcacgttcgtaaccgtccgtacctaccgacgtaccgtcgcgtacgacgtacggtaagtagttttccgaagttaacctttagtaacttagtaacgttaaacggttctaacggtacctagggtcccgtccctgttaccgtacgttcccgggacccgttacgggaaacgtaacggttagaaacttaccgaaacggtatcgggtagacccgtagtacccacgtacgttccg

SEQ ID NO: 41963 - DNA, 712 bp, Homo sapiens
  misc_feature: GYAE6OF01A3V7O.33.63.F08.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (389)..(389): a, c, t, g, unknown or other
  misc_feature (389)..(389): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtcctccatccctccctgtctgctatcgaggtggganacagtacgtcaccatccacgttcggccgggngaggtcggactattttacttaagtttttcggccttggtatcgagcgtaagaggaggtaagggtaacgttccgtagacttccgtagacttacgtagtggtgactacttccgtactttgactaacgtccggacgggttacccattccgtacgtcgttacgnggtcggacgtagggtggttagtttacgggaactaggtttactttccgaccttcctacccgaccgttccgaaccgacgtcccgtagtacgtaccgggtactaacggtaagtttccgtttacgaactttaaacgttttcgttaaccgttaagtaaaccgtaaaggttacttaacggtaccgttacgggtccgtaccccgtacgtttaccggtacccgggtttccggtacccgtaacggggttaaaccttaaacgggttaaccgtaaacgttaccgtaaaaccgtgttacgggtaccggctaaccggtacctaaccttcggttacc

SEQ ID NO: 41964 - DNA, 690 bp, Homo sapiens
  misc_feature: GYAE6OF01AZVKZ.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtcctccatccctccctgtctgcatcagtggagacagcgtcaccatcacgttggccggcgacggtcgggactagtttaacttaagttttttcggccttaggtactcagacaagaacggaaggtaaaggggtaacgttaccgtagtaccgtaccgtagacttacgttagtcggttacgacctacgttaccctaacgttttacgtaccgtaaacgttccgggaaccgggggttacccctaacttccgttcgtaccgtttacgtacgggttacgggaccgtagggttacggttaggtttacgggaactaagttactttaccacgttctaccgtaccgtcaacccgtacgtcctcgacggtacgcgttaagtaacggttattttacgacttaacgtttactaccgttataactaaagtacacgtaacgtcggccgtacccgcttacgttaccgttccggtaacccgtagggtaacctaaggtaacggtaatacccgtaaacgtcgtaggtcgtccgacacctcgtagtcccg

SEQ ID NO: 41965 - DNA, 913 bp, Homo sapiens
  misc_feature: GYAE6OF01AN3MP.33.63.F08.1.454.CMB.1.raw
tcagtacacacactcacgaccggtgctcgatttagcgatcgtataagggggcagaagtctctctcagtcaggacacagcatggacatgaggtccctgctcagctcctgggactcctgctgctctggctccagataccagatgtgacgtccagatcgacccagtcctccactccctccctgtcctgctatcgaggtgggacacgagacgtacacctactacgacgttcggaccgggacgtacggtaccggtacttagttttacgttaagttttttcggccgttaggttactcgagtacgaaggtaacggaagggtaaaggggtactttaccgtaacgtaccgttaccgtagtaacttcgttaacgttcgggtcgtacctacttacccgttacgttttacgactaaccggtaccggtaccggggttaccctacgttccgtaccgttacgttacgaagggtcgaacgttacgggttacggtacggttttacggggaacttacggtttaccgtttaccgtacgtttacccgtaccgtaacccgttaccgtaaaccccgtacggtcccggttaacggaccggttaaacggttaaccgttttaaaccggtttacgttttaaccgttaaccgtttaaaacccgttttacgtttaaaccgttaacgggttaaaacgttaaaacggtttaccgtaacggtaacccggttaagggttaccccgggtaccccctttacggttaaccccgtttaccgggtttacccggggtaaccccgttaaacggggttaaacccgtaaaaacgggttaaacccggtaaaacctttaaacccgggtaaaacccggttacggttaaccggggttaccgggtacccgttaaaccctaacccggtttaaccccttaacggtttcggtttacccccgg

SEQ ID NO: 41966 - DNA, 762 bp, Homo sapiens
  misc_feature: GYAE6OF01AURUD.33.63.F08.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
tcagtacacacactcacgaccggtgctcgatttagcgatcgtataagggggcagaagtctctctcagtcaggacacagcatggacatgaggtcctgctcagctcctgggactcctgctgctctggctccagataccagatgtgacgtccagatgacccagtcctccattccctcctgtctgcatcgaggtgganacagctcacatctacgtggccggngacggtacggactatttacgttaagtttttcggcgtaggtactcgagacgagaaggaaggaaggggtaacgttccgtagacttccgtgtactcgtagtggtcacctactacctctttagactagtcggacgggtcctagtctcgtcttggagtcggacgtaggttagggttagtttagggactagttactttcctaccttccgtaccgtaccccgtacgtaacccgcgttacgtacggtacggtacggtactaacggttaagttacgttttacgtaaaccttttaaactttacgtttaaaccggttaagttaaaccgtttaaaagttcggttaaccgttaaccgggtacgtttaccccgggtacccgttacccgttaacggttttaccccggttaccgggttaccccgtaaacggggttaaaaccgtaaaccggggtttaaacggtaaaccggtttaaaacccggaaaacgggttacccggtttacgggtaacccggtttacccggtaaccggtacccgttaaacccggttcggttttaccccg

SEQ ID NO: 41967 - DNA, 1033 bp, Homo sapiens
  misc_feature: GYAE6OF01DK3D8.33.63.F08.1.454.CMB.1.raw
  modified_base (228)..(228): a, c, t, g, unknown or other
  misc_feature (228)..(228): n is a, c, g, or t
tcagtacacacactcacgaccggtgctcgatttagcgatcgtataagggtgcagaagtctctctcagtcaggacacagcatggacatgacgggtccctgctcagcctccgtgggacctcctgctgctcgtcggcctacccgagaactaccgagatcggtcgacgtccagactcgacccagtcctcctacttccctcctcgttctcgactacgtacgaggtacgggganaaccgtagggtaaccgtaccaacctacgtttacccgtaaccggtttccgggggcccggggtaaccggggtaacggggtttaccggggtaaaccttttaacgttttttaaaccggtttttaaccggttttttttccgggaccggtttacggttaaactaccggaaggtacggaaagggtaaaggggtaacggggtaaaaccgggggtttaaccgttccgtttaacggaacccgtttccggtagttaacgttcgttaggttacggtacgtaccctactttacccgttaacgtttacgacccgttaacggtccgggtacccgggttaccctacgtttcccgtcgtttaccgttacggacgggttacggtacggtacgggtttacgggttaacggtttacgggaaacgtttaccgttaacgtttccctaacccgttcccgtaaccccgtaacccgttacccgtaaacccgtcggttaaccgtcggtacgttaaccgggccggtttaaagtaccggtttttaacttaccgtttaaacccgttttaaaattttcgggtttaaacctaagggttttaaaactaaacggtttagggtaacccgggttaacggttaacccgggtaccccggttacccccgtttaacccgggtttaaccgtttaccccggggttaaaccccgggaacccggggttaaaagggtttaaaaacccgggtaacggttaaaccggtaaaaccgtttaaaacccggaaacggttacccgggttacgtacggggtaaccctttaccccggggaaccttaacccgtttacgg

SEQ ID NO: 41968 - DNA, 529 bp, Homo sapiens
  misc_feature: GYAE6OF01DTJ5W.33.63.F08.1.454.CMB.1.raw
  modified_base (387)..(387): a, c, t, g, unknown or other
  misc_feature (387)..(387): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaagggagttctagactcctgatctatggtgcatccactttgacaatcagggtcccatctcgcttcagtggcagtggattggactagtatttcactctcaccgtcaccagcctgcaggctgaagtntttgactaacttattactgtacaacgagacgtcaaccaaccacccctattacctaccgtttccggaccccttggggaacccacgtaggttaggtaactacggttaccaaacccggtaactcggttaggacctgcctaacccg

SEQ ID NO: 41969 - DNA, 721 bp, Homo sapiens
  misc_feature: GYAE6OF01AC740.33.63.F08.1.454.CMB.1.raw
  modified_base (338)..(338): a, c, t, g, unknown or other
  misc_feature (338)..(338): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatcgacccagtcctccactccctccctgtcttcatctagtaggagacagacgtcaccatcacgttcggccgggacaaggtgagagactaagttaacgaaccttagtttaggtaagttggtactcgagacaacggaacgaaccggaacgggaaacccacccccgtaaactccgtagactccgtcncgcccgactacgtaccgtacttaccacgtaacggtccgggtcccagtcggtaggtcaggtcggctaggttggacttcggtaggactagttactttaccacttccacctaaccgtaagtaccggtacgtaacgttaccgtaacggtaaaccgttaggtaaaggtttaacggtttaacggaaacgttaaccgttttaacttacgttaacgtaacccgtaacgtaaaccgtttaactttaaccgttaaacccggttaaccccgttaacgtttaaccggtttaccgggaacccggtaaaccggggtacctaacgggtcgtacgggaacgtacgtaaccgaaacggtacgtaacgttcgggacgtaccacggacctaaccgtcttccg

SEQ ID NO: 41970 - DNA, 719 bp, Homo sapiens
  misc_feature: GYAE6OF01AKFS2.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcaggtggagacagacgtcaccatcctacttcggccgggcgaggtcgggactatttactaagtttttggccttggtatcagcagagaggaagggtacgttaccgtagtactccgtgattctagttggtcgtactactcctactttgactaacgtcgacggggtcccacgttccgtccgtccttacgacggttcggacgtaggttacgggtacggtttcggggactaagttacctttacgtaccttaccgttaccgtacccgtacccacccgtacggtcccttacggacgtacggtcgtaaggtaacgtttacgttttaacgaacctttaacgtttaacgttaacgttacgttaaacgtaaaggttactaacgggtaaccgttacgggttacccggtaccccgttacgttaccccggttaacccggtttcccgggtaaccccggttacggggtaaaccctaaagggttacggtaaactaaccgtaaaccgtaacgttacgggtaacggtacctacgacctaaccgtcgtttacccg

SEQ ID NO: 41971 - DNA, 667 bp, Homo sapiens
  misc_feature: GYAE6OF01C9FKP.33.63.F08.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagtacacacactcacgaccggtgctcgatttagcgatcgtataagggggcagaagtctctctcagtcaggacacagcatggacatgaggtccctgctcagctcctgggactcctgctgctctggctcccagataccagatgtgacatccagatgacccagtcctcccaccctcctgtctgcatctgtcgganacagagtccacatctcgtggccggnaagtcagagcactccgtccgtactttaatttaaagttggtactcgaagacaacgaaaccgagggtaaccaaccgtaccccttaaactccgtagacttctatcgtactcgtccgtacctagtctagacgtaacggttcgggtaccctaagtaccgtaacggtttacgaggtcggacgtaggttaggtacgtcggtagggaactacggttactttaccacgttacctaccgtaacctataccgaagtaccgtacgttacctacgtactaaacccgtagtaacgtttactttacgtacctttaactttaccttacgttaccgtactaacctaacgttaacgttaacctaccttaccgttacccgttacgttaccgtttcggaaccgtaacgggaaccctaggtacgtacggtacgtacgtaccgacggtacgtaacgtcggtacggtaccg

SEQ ID NO: 41972 - DNA, 601 bp, Homo sapiens
  misc_feature: GYAE6OF01B5YBM.33.63.F08.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (437)..(437): a, c, t, g, unknown or other
  misc_feature (437)..(437): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacgttggcccgggngaggtcgggactatttactaattttttggcctggtatcagcagagaggaaggggaagttcagactcctgatctagtggtgctatcctactttgctaacgtcgacggggtccctagtcctcgtccttcgagttcggacgtaggtgggtagtttcgggactagtactttcgacttctccaccgttccacctcgcctcggctacggcgtagtaacgtntttacgacttaactttattaacgtacgttaactaaagttatagtactacggtccggtacccgtacttccgtaccgtttccggtccccgtacggggtaacctaaaggtaggaaactaccggaaaaccgtaacgtcggtacggacctagaccaccgtacgttaccg

SEQ ID NO: 41973 - DNA, 639 bp, Homo sapiens
  misc_feature: GYAE6OF01CE7SF.33.63.F08.1.454.CMB.1.raw
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatccctccctgtctgcatcagtgggagacagagtcaccatcacttggccgggngagtcgggactatttactaatttttggcctgtatcagcagagaggaagggtagttctagactctgatctagtggtncatcctactttgactaacgtcgtaacggggtccctatccgtcgtcttcgaggtcggcgtaggtggtagtttgggaactagtcttttacaccttcctactacccgtacacccgtacgtccctggtaccgagggtaccgtaaggtaaagttacgtttttcggaaccttaaacttttaagtttaactaggttaaactaaaagttacgtagtaccgtaggttccggccctaccgtaccgttaaccgtttccggaccccgtaggggtaaacccgtaaacggtaggaaaactccggaaaaccgtaccgttaacggtcgggttacgacgtaaccgtacctacgttaccg

SEQ ID NO: 41974 - DNA, 737 bp, Homo sapiens
  misc_feature: GYAE6OF01BOU1J.33.63.F08.1.454.CMB.1.raw
  modified_base (123)..(123): a, c, t, g, unknown or other
  misc_feature (123)..(123): n is a, c, g, or t
  modified_base (192)..(192): a, c, t, g, unknown or other
  misc_feature (192)..(192): n is a, c, g, or t
  modified_base (327)..(327): a, c, t, g, unknown or other
  misc_feature (327)..(327): n is a, c, g, or t
tcagtacacacactcacgaccggtgctcgatttagcgatcgtataagggggcagaagtctctctcagtcaggacacagcatggacatgaggtccctgctcagctcctgggactcctgctgctntggctcccagataccagatgtgacgtccagatgaccagtctccatccctcctgtctgcatcagtggganacagagtcacctatcgacgttcggccgggcgaggtacggactatttacctaagtttttcgcgttggtatcgagcaaggtagaaggtaaggggtaacgttccgtaagtaccttccgtaggtacttcgtagtggtanctacttcctaacgtttcggaactaactcggtaacggggtccctaatccgtacgtcttacacgggttcgacgtaggttacggtaggtttaggaacctaggtacttttacgaccgttcgttacacccggttacaacccgtacgtccgtggtacccgaggtaccttaaggtaaaccgttagttttacgaactttaaaccgtttagttaactaagtaaccgtaaaaagttctacggtaaaccgtcggtaccggtaccctacgttaacccgttccggtttacccggtacccccggttaaaggggtaaacccgttaaaacgggttacggtaaaaaaccgttccccgtaaaaaacggggtacctttacggggtacgtacccgtagggtaaccccctaacgggttatttaaccccggg

SEQ ID NO: 41975 - DNA, 678 bp, Homo sapiens
  misc_feature: GYAE6OF01CV71S.33.63.F08.1.454.CMB.1.raw
  modified_base (124)..(124): a, c, t, g, unknown or other
  misc_feature (124)..(124): n is a, c, g, or t
  modified_base (199)..(199): a, c, t, g, unknown or other
  misc_feature (199)..(199): n is a, c, g, or t
  modified_base (556)..(556): a, c, t, g, unknown or other
  misc_feature (556)..(556): n is a, c, g, or t
tcagtacacacactcacgaccggtgctcgatttagcgatcgtataaggggcagaagtctctctcagtcaggacacagcatggacatgaggtccctgctcagctcctgggactcctgctgcttcncgcctccagataccagatgtagacgtcagatcgacccagtcctccactccctccgtgtcctgcatcgaggtgganacgaggactcacagtcacgtcggcccgggagacggtcggtaacttacgtttacttagttttcgccgtaggtactacagagaaggaggtaacgggaagggtaacgtttaccctaaggtaccttccgtagtacgttacgtaggtggtacactacttaccttacgtttacgaactaacggtaccggtaccgggttccctagtcccgttcgtcgtttacggaggtcggtagagggttagtacggtttagggaacttaagtcttacaccttccgtaccgactccacgacgtcacgagtacgagttaagtaagtttcgtttcgaaccctttaagtttaacgtacttaacgtaaagtaaacgtnaacgggtacgaccgtcggaccccttggtacccgtacgtttccccgggaacgttaacggaaaccgtaaaggtaccaaacgtaacaaacggcgttaggtaccgagtaccaccttagtcgttacg

SEQ ID NO: 41976 - DNA, 806 bp, Homo sapiens
  misc_feature: GYAE6OF01EEVF1.33.63.F08.1.454.CMB.1.raw
tcagtacacacactcacgaccggtgctcgatttagcgatcgtataagggggcagaagtctctctcagtcaggacacagcatggacatgaggtcccgctcagctccgtgggctcctgctcctctggctccgaggtgccagatgtgacgtccagatcgaccctagttcctccatccctccgtgttcttcattcgtggtaggagacgagtacgtccaccgattccgacgttcggacccgggactaacgtcgaaggacgtacctacgttccggtaccgtactttaaagttttaaaacgtttcggttactacgtacggaacctaaacggaaaccgacggtaccaaccgtaacccccttaaactccgtagtacttaccgtagtcggtacgtcggtccggttacctacggttacgtacggtaaccggtaaacgggttcccgggtacctaacggtaaccggtaagggttacgaacgggttcggacgtaagggtaggtaacgtaccgggtacgggtaaccgtacggttactttaccgtaaccttccgtaacctaaccacgttacctacgtacctaacggtccgtaaccgtaacctaaccgttaaggtaacgtttactttaaccgtacctttaaactttacgttcttaacgtaaacctaacgttaaccgttaacgtttaaccctaaccgtttacccgttaaccgtttaaccgttacggttaccgggaacccggtaaacgggtaaccgtaaggtccggtagggtacgtccgaacgggtacgtacggttacgtcggtacggtctaacggtcctaaccg

SEQ ID NO: 41977 - DNA, 693 bp, Homo sapiens
  misc_feature: GYAE6OF01ASZ7P.33.63.F08.1.454.CMB.1.raw
  modified_base (159)..(159): a, c, t, g, unknown or other
  misc_feature (159)..(159): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
tcagtacacacactcacgaccggtgctcgatttagcgatcgtataagggggcagaagtctctctcagtcaggacacagcatggacatggagggtccctgctcagctcctgggactcctgctgctctggctcccagataccagattgtgaccgtccagtntcgaccctagtcctccactcccttccctgtcctgccatcaggtgganacngtacncacatcgtacgtcggccgggagcggtcggacttatttacgttaagtttttgaccgtggtatacgagtacgaggtaggaaggtaacgggtaactttacccgtaagtccgttccgtagtactcgttaagttggtcgtactacctcttacgttacgacgtaattccgggtaccgggtccctacgtccgtcgtcttacggacgtgtagcggtaggttacggttaggtatacggttactttccacttccgtacctaccgtacctaccgtaccgtcgtacggaccgttacgtaacgttagtacgttattttacggaactttaacgtttagttaacgttaacgtaaacggtaaattacggttactaacggtaccggttcgtacccgtcttaccggttccgtacccgggtcgtaaccggtaagtaaccgtaaggaacctaaacgtaacgtacgtacggtacgtccgtaggtacccaggttctaccgg

SEQ ID NO: 41978 - DNA, 836 bp, Homo sapiens
  misc_feature: GYAE6OF01EISA2.33.63.F08.1.454.CMB.1.raw
  modified_base (819)..(819): a, c, t, g, unknown or other
  misc_feature (819)..(819): n is a, c, g, or t
tcagtacacacactcacgaccggtgctcgatttagcgatcgtataagggggcagaagtctctctcagtcaggacacagcatggacatgacgggtccctgctcagctcctgggactctgctgctctggctcccagactaccagatgtcgacgtcagactcgaccctagtcctcctacttccctcctgtctacgcatcgaggtcggatacagactaccactatccgtacgttcggccgggacgtacggtccggtaactttaacgttttaacgttacggtttttttcggaccgtttaggttaactcgtaagaccgtaaagggtaacgggaaaggggtaaacggggttaaacggtttccgtaaacggtaccgttaccgttaacggtactttaccgtttaaggtcgggttactaccttaccgttacccgtttaagtttacgtaaccgtaacgttacgggtaccgggttaccctacgttccgtccgtttaccgtacggtacggtacgtacggtaggggttacggttacggtttacgggaaactttacgtttaactttccgtaacgttcccgtaaccttaccggtacctaccgtaccggtaccgtacggtaaccggtaaacgttaacgtttaaacgtttacgtttaccgaaccgtttttaacttaacggtttaacgttaaccgttaaaaggaaacgttttacgacggttaacgttaacgggtcccgtaccgttaccttacgttcccggtaacgggtcccggtaacggaaacgtacgtaaacgtaaccgaacgtaaaccggtacgttgggaccgttacgaccgttanccgttacgtcgttaccg

SEQ ID NO: 41979 - DNA, 867 bp, Homo sapiens
  misc_feature: GYAE6OF01CMPCX.33.63.F08.1.454.CMB.1.raw
  modified_base (166)..(166): a, c, t, g, unknown or other
  misc_feature (166)..(166): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctccagataccagatgtgacgtccagatcgacccagtcnccatccctccctgtctgctatcgaggtggagacagacgtaccacctacgtctaccgttcggcccggggacgtacgggtcggggtaacctaagtttttaaccgttaaagtttttttcggacccgttaggggttaacttccgaaggtaaccgtagggaaagggtaaacggggtaaaggggggtaaaccgtttacccgtaacggtaccgtttacccgttaggtaacgtttccgttaacgttgggttacgtacctaactttaccccgttaacgttttcggaacctaaacggttccggtaaaccgggggttcccctaacgttcccgtttccggtacctttacggacggttacggaccgttaacggggttagggttaacggttttacggggaaaccgttaaggtttacctttttaaccgaccgtttacccgttacccgaaccccggttccaacccgtaaccgtccgtacgaaccgtaaggtaaccttaaaggtttactttaccgtaacttaactttttaaccgtttacgttaacgttaaacgttaaaagttacgttaacgtacccgtagggttaacccgccccgttagtttacccgttaacccggtttccgggaaccccgtaacggtaaccgtaaacggtaacggtaactaaccggaaagtaaccggtcgtacggaccttaacggactaaccgtgttccgttaaccg

SEQ ID NO: 41980 - DNA, 648 bp, Homo sapiens
  misc_feature: GYAE6OF01AFFQA.33.63.F08.1.454.CMB.1.raw
  modified_base (199)..(199): a, c, t, g, unknown or other
  misc_feature (199)..(199): n is a, c, g, or t
  modified_base (315)..(315): a, c, t, g, unknown or other
  misc_feature (315)..(315): n is a, c, g, or t
  modified_base (626)..(626): a, c, t, g, unknown or other
  misc_feature (626)..(626): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgaccgtccagatgacccagtcctccactccctccctgtctgcatcaggtggganacagacgtcaccatcacgttcggccgggcgaggtcggactatttactagtttttggcctggtatcgagctagaggaggaacgggtattccgtagacctcgtagtatcgtagtggtnctactcctacgtttcgactagtccggtacgggtaccctagtccgtgtccgttacgtaggtcggacgtagggtggttacgtttcgggaactagttattaccgtacctctacccgtacctccgaccgtactccgtacggaccgtaacggtaactttaacggttactttaccgtaacctttaacgtttctttaaccgtaagttaacgtaaagttacgtacgacgtacgggtccgtacccgtacgtaccgttccgttacccggccgttaacgggaacgtaacggtacgaacttaacggacgtacgtagtcgtacncgtacctcgtccttcgttaccg

SEQ ID NO: 41981 - DNA, 704 bp, Homo sapiens
  misc_feature: GYAE6OF01C0EBQ.33.63.F08.1.454.CMB.1.raw
tcagtacacacactcacgaccggtgctcgatttagcgatcgtataagggggcagaagtctctctcagtcaggacacagcatggacatgaggtccctgctcagctcctgggacctcctgctgctctcggcctcccagataccagatgtacgacgtccagatcgacccagtcctaccactccctcctgtctacgctactcgaggtgggagacaggtactaccaaccataccgtaccgtcgggaccggtacgaacggtcggtacttaattttaacgtttaagtttttcgccgttagtaactcgaacggacaaggaacggtaaagggtaacggggttacttaccgtaacggtaccttaccgtagtacgttaccgtagtcggttcgaccttaaccttacccgttaacgttcggaacctaacggtccggtaaccgggtccctacgttcgtaccgtcgtttagacggtcggacgttaggtcggttaagttcggaacttagtaccttcaaccgttccacgaactagaacgtcgtacgttacgaacgtacgtagtaacgttaagttacgacttattccttacgataccaagtactaacgttaccgacgttaaccgtacttacggtaccgacggtaaccggtaacagtacgtggaaacgtcgtaacgaaagtccgttaacgtgttaaccggacttgaaaccctgtcccgttacg

SEQ ID NO: 41982 - DNA, 691 bp, Homo sapiens
  misc_feature: GYAE6OF01CKK0U.33.63.F08.1.454.CMB.1.raw
tcagtacacacactcacgaccggtgctcgatttagcgatcgtataagggggcgagaagtctctctccagtcaggacacagcatggactatgaggtccctgctcagtctctggactcctgctgcctcgtcgctacccagactaccagatgtgacgtccgagatcgacccagtctccactccctcccgtgtcctagcaagtcgaggtggagacagacgtcacatctacgtcgcggcagtcggatattactattttgccgtgtactcagcagaggagagggtatcacgactcctagacgtctagtggtcacgtactcctactttgaactagtacgtacggggtacccattccgtagtccttagtacgtgtacgtagttacggtagttacggaccgtaggtacttaccgtacttcgtacctaaccggtacctaccgacgtccctaaggtaccacgggtaaccctagttaaacgtttacgtttacggaacctttaacggtaacttttaacgtacggtttaaaaccaaaaggttacgtaccgggtaacgttacggacccgggttacccgtacttaacccgttacggttttccccggacccggttacgggaaaccgttaaaacggtaaccggaaacttaacgaaaaaccggtttcggaagttcccgggataccggtaccctaaaggtcgtttaaccgg

SEQ ID NO: 41983 - DNA, 824 bp, Homo sapiens
  misc_feature: GYAE6OF01C1RD0.33.63.F08.1.454.CMB.1.raw
  modified_base (207)..(207): a, c, t, g, unknown or other
  misc_feature (207)..(207): n is a, c, g, or t
tcagtacacacactcacgaccggtgctcgatttagcgatcgtataagggggcagaagtctctctcagtcaggacacagcatggacatgacgggtccctgctcagctccgtggactcctgctgctcgtggcctcccagactaccagtatgtcgacgtcagactcgaccagtcctccactccctcctgtctgacagtcgaggtaggganacgaggtactaccaccatacctcggtcggccgggtacgacggtacgggtacctttaagtttacgttaacgtttttacggaccgttaggttactagacgtacgaaggtaagaagggtaacggggttaacttacccgtagtaccgtaccgtaggtattaccgttagtacggtcgaaccttaccttaccgtacgtttacgaaccgtaacgtaccggtaccggggtaccctacgttaccttaccgtacttaccggagtcggtacgtaggtagttagtacggtagacgttaccgttcgaccttacgtacccgtaccgttaccaacccggtactacccgtaagaccggttaaacgttaacgttaaagttttaccgttaacgtaaccttaaacgtttacttacgtttaacgaaacgttaaagtacgttacggaaccgtaccgttacccgggtaccctacgttacccgtcccgggttttaaccgacccgggtaaacgtaaaacccgggtaaaaccgggtttaaacgaaaacccggtttaaaaccccggaaagggttaaccccggttggtaaaccccgtcggtaaacccgttacctaacccctttaagggtttccctttaacccgg

SEQ ID NO: 41984 - DNA, 926 bp, Homo sapiens
  misc_feature: GYAE6OF01CE9T3.33.63.F08.1.454.CMB.1.raw
  modified_base (200)..(200): a, c, t, g, unknown or other
  misc_feature (200)..(200): n is a, c, g, or t
tcagtacacacactcacgaccggtgctcgatttagcgatcgtataagggggcagaagtctctctcagtcaggacacagcatggacagtgagggtccctgctcagctccgtgggactcctgctgctctggctcccagatacagatcgtgacgtccagatcgaccagtcctccatccctcctgtctgcatcgacggtggganacgagtacgtaccaccacgttcacgttcgggccgggacggaacggtaccggggacttaaagttttaacgtttaagttttttcgggtaccgttagggttacttccgaagtaccggaaggaacgggtaagggaaacggggggttaacgtttacccggttaacggtaaccgttcccgttaaggtactttaccgttaaggttgttaccggacttacccgttaccgttaacgtttttacggactaaccgggtttaccggtaccgggggtttaccctaaccgttaccgttccgttccggtttacggacggtttacgggtacggtacgggttagggttaacgggttttacgggaaacttaagggtttacctttacgtaaccgttccttacccggtaaaccccgttaccacccgttaccgccgttacggtaccgtaacggtaaccgtttaaaggtttcgttttaacgtaaccgttttaaacggtttacttaacgtttaaacgttaaacttaaaggtaaccgttaagtacccggtagggttaacccggtaccccgttaacgttcccggttaacccgttttacccgggaccggtaaaccggggttaaaccgttaaaccgggtaaacccggttaaaagttaaaaccccgggttaaaaggtacccccggttaagggttaccccgggaacccgttacgggtaacccctacccggttaaaccttttccgttaaaccccgg

SEQ ID NO: 41985 - DNA, 816 bp, Homo sapiens
  misc_feature: GYAE6OF01CU5DY.33.63.F08.1.454.CMB.1.raw
  modified_base (195)..(195): a, c, t, g, unknown or other
  misc_feature (195)..(195): n is a, c, g, or t
tcagtacacacactcacgaccggtgctcgatttagcgatcgtataagggggcagaagtctctctcagtcaggacacagcatggacatgaggtccctgctcagctcctgggactcctgctgctctggctcccagataccagatgtgacgtccagatgacccagtctccatccctccctgtctgcatcgagtggganacagagtcaccatactacttcggccgggtacgaaggtcgggtaacctattttaaccgttaagttttttcggccgttaggtatcgagtcaaggaggaacggtaaggggtaacgttacgtaacggtacctaccgttagtaattcgtaagtcgggtagactaacttaccgtaacgttttcgaacgtaaacgtccggtacggggttcccctaagttccgttccggtacctttacggagggtacgggtcgtaagggttggttaacgggttttacggggaaacgtaaggtttaaccttttaccaaccttttaccgacccgttaacccgttaccaacccgtacgtcccgttaggaccgacggtactaaggtaaagttactttttaaggaaccttaaactttacgtttaacgtaacggttaaactaaaaaacggttgtaacgggaaccgtaacgggttacggtacccccgtacgtttaccgttaaacccgggttttccccggaccccggtttaacggggaaacccgttaaaagggttaaccgggtaaaaacgttaaacccgaaaaccggttaaacccgttgggtaacccggtaccttaccggaaccccctaaacgttccgttaaaccgg

SEQ ID NO: 41986 - DNA, 764 bp, Homo sapiens
  misc_feature: GYAE6OF01DQHJ8.33.63.F08.1.454.CMB.1.raw
  modified_base (199)..(199): a, c, t, g, unknown or other
  misc_feature (199)..(199): n is a, c, g, or t
tcagtacacacactcacgaccggtgctcgatttagcgatcgtataagggggcagaagtctctctcagtcaggacacagcatggacatgaggtccctgctcagctcctgggactcctgctgctctcggctccagataccagatgtgacgtcagactgacccgagtcctccacttcctcctgtctgcagtcgaggtcgganacacggtactaccaacctatccgacgttcgggaccgggtacgtacggtaccgggtacttaacgttttaacgttacgtttttacggccgttaggtactacgagacgaaggtaagggtaaggtaaaggggtacttaccgtaacggtacctcgtagtagttacgtaggttcggtcgactactaccgttagttcgaacgtacgtacggaccggttccaacgttcgtacgtcgtacgtacggacgtacgtaggtggtaacgttcggaaacgttcgttaacttccgtaactaccgtccgaaccgtactaccgacgtccgtaacgacgtcggtaacgtacgtaacgttcgttacaacgtttaacgttacttaccgtaacgtaaaattaacgtacgtaacggtaccgtacgggtacccgttacccgtacttacccggttaacccggtttacccgggaccggttaaaccgggtaaacccgttaaaacgggtaaacgttaaaccgtaaaccggaaaaaccggttcggtaaacggttcccgtaaacgtccgtaaaccgcccggttaacttacccgg

SEQ ID NO: 41987 - DNA, 860 bp, Homo sapiens
  misc_feature: GYAE6OF01CM7NO.33.63.F08.1.454.CMB.1.raw
  modified_base (207)..(207): a, c, t, g, unknown or other
  misc_feature (207)..(207): n is a, c, g, or t
tcagtacacacactcacgaccggtgctcgatttagcgatcgtataagggggcagaagtctctctcagtcaggacacagcatggacatgaggtccctgctcagctcctgggactcctgctgctctggctacccgaggggaaagacgcccaccccgtctccctgcagggcccagtcagaggtgtagcggtaccagcctaggtaaccaanagacgacctggccaggcctcccgaggcctcctcttcatgatcgacactccaacgcggccagtcggaccactcccgagacccgtaggttcgaggtcgggtcgggttcgggtcgtaggggacctaacgtaccgtttcccaacgttcctaccaaaccctacgtcgaacggtccgtaacgttacctacggaacccctaaaacgtacggtaaaagtttacgtttttaccgaacctttaaaaccctttttcgttacccgttacggttaaaccaaacccgttaaaccgtaccgtttaaacccgtaaccttttaacccccgttaaccccggtttaaccccgttttaaccggtttaacccggggaaccccgggttaaacccgggggtaaaccctaaaggttacccggttaagggtaacccggttacgtaccggtaaacgggtaacccggtaaacgttcgggtaccggtcgtaacccgtaccgtaacccgttaacgttcctttaccggtttaccctttaccgtaccgtttacccccgttacccccggtaaccaccgttttaccggtaacggtttacgttacgggttaacggtttacgtaacccgggttgggtaaccggggtccggtacgggttaacgggaccggttaaaggggccctaaacgg

SEQ ID NO: 41988 - DNA, 729 bp, Homo sapiens
  misc_feature: GYAE6OF01C43W4.33.63.F08.1.454.CMB.1.raw
  modified_base (134)..(134): a, c, t, g, unknown or other
  misc_feature (134)..(134): n is a, c, g, or t
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (425)..(425): a, c, t, g, unknown or other
  misc_feature (425)..(425): n is a, c, g, or t
tcagtacacacactcacgaccggtgctcgatttagcgatcgtataagggggcagaagtctctctcagtcaggacacagcatggacatgacggtccctgctcagctcctgggactcctgctgctctggcctccanactaccagatgtgacgtacagatcgaccctagtcctccactccctcctgtctcgctancgaggtgggactacagactacaaccntcacgtcggccggacgaggtaccggtattacttttaacgttaacgtttttcggaccgttaggtactacgacgacgaaggaaggtaggaaacggggttaacgttccgtaacgtacctacgtacgtacgttcgtagtcggtcaactacgttacctacgttcgaactaaggtaccggtaccgggtaccctagttcccgtacgtcttacgnggttacggacgtaggttaggtacgttagggaacttacgtacgtttccaacttcctaccgacctaacgaccgtacgcttacgacgtacgcgtaagtaacttacgttttacgaactttaactttaagtaccgttaagtaactaaaggttcgtaacgtacggtaaccgtccggttacccgtaacttaccggttaccgttaacccgggaccgttaaaacggtaaaccgtaaaacgggttacggaaaacccttacgggtaaaaaccgttacgttacggccggtaaacgtgaaccccttacgtactttcg

SEQ ID NO: 41989 - DNA, 596 bp, Homo sapiens
  misc_feature: GYAE6OF01D5A9R.33.63.F08.1.454.CMB.1.raw
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
tcagtacacacactcacgaccggtgctcgatttagcgatcgtataaggggcagaagtctctctcagtcaggacacagcatggacatgagggtccctgctcagctcctggactcctgctgctctggctcccagataccagatgtgacgtccagatcgacccagtctccatccctccctgtcctagcatcaggtcgggagacagagtcaccatcaccgttgccgggcgaggtcggactattttactaagttttttcgccgtggtactcagcagagagaaggtacttcagactctgatcgtagtgtnctactcctactttnactacgtccgacgggtcccattctcgtcttcgagtgctaggtgtagtttggactagtactttcacttctacctaccgtcaccgtactccgcgtcacggtataacggtaaacgtttagtttacgaccttaaactttacttaactacgtaacctaaagttctaggtaccgtaggtccgtccgtacgttccgtaccgtttccgggacccgttacgggaaactaacgggtaagaaactaccgaaacgtacgtcggtacgtactacgaccctaccgtattccg

SEQ ID NO: 41990 - DNA, 837 bp, Homo sapiens
  misc_feature: GYAE6OF01E3T20.33.63.F08.1.454.CMB.1.raw
  modified_base (352)..(352): a, c, t, g, unknown or other
  misc_feature (352)..(352): n is a, c, g, or t
  modified_base (461)..(461): a, c, t, g, unknown or other
  misc_feature (461)..(461): n is a, c, g, or t
tcagtacacacactcacgaccggtgctcgatttagcgatcgtataagggggcagaagtctctctcagtcaggacacagcatggacagtggacgggtccctgctcagcctcctgggacctcctgctgcctcgtggccctcccgaagacttaaccgagtattcggtacgaaccgtacagtaactcccggaaccctgtccccttacctacccttcccttcccgttggtcctagactacgtagggagggtacggaacaacggttacgaccttaccacctacgtaccgttccggtacggggaccggtccggttacggtacttttactttacttttaacgtttcggtttcgcggttanacgtagaacggaggtaaggaacgggttaacggacggttactacgtacgtcgtactagtactgtacgtgtaccacttacgttcgtaagtccaacgtccgtacgtacccgntttaccgtccgtaggtcccgtaaggtcgggtcgttaaggttacggtttcgtagttaaccgtacctacttaccgtcctaaccctccgacccttaccgacgttacccggtcgtaccgggacttaggttaaacccgtatttaaacgtttacgtttacgttaaaccgttaacgttaaacgttacttaaacggtaacgtttaaccgggtaaccgtacggttacccgggttaccgacccggttaccggtaccctttacgggtaaccccgggttaccggtacccgggaaaacgtaaacccggttaacgtacgtaaaccgtaccggaaacggtttaccggaacgtcgtccgtaaccttacccgccctttaaacgtccgtttacg

SEQ ID NO: 41991 - DNA, 640 bp, Homo sapiens
  misc_feature: GYAE6OF01AW0L7.33.63.F08.1.454.CMB.1.raw
  modified_base (225)..(225): a, c, t, g, unknown or other
  misc_feature (225)..(225): n is a, c, g, or t
  modified_base (629)..(629): a, c, t, g, unknown or other
  misc_feature (629)..(629): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtcctccatccctccctgtcctgcatctgtaggacgacagggtcaccatcacttcggccgggnaagtcagagcaataagacaacttatttaaatgtatacaacaagaaaccgaagggaaacgacccctaaggtcctagattactagtcgctacgccgtaccagtttcacgacggacggaccggggtccaactacgaaacggtttcaggttcggacgtaggtaggtactcgtacggggactaacgtacttttaccgaccttcctaccaacccgtattacgaacgtaccgtaacggttcgtaggtaaccaacgggtataaacggttattttacgacttaacgttacttaacgtcgtacaacgtagtaactccaaacaaccctaccctacttaccgtaaccgtttccggacccctacgggaccacggtaggttcgacgttcgaaccgaaccgtaacgttcggtagtccgngtccccgtacg

SEQ ID NO: 41992 - DNA, 997 bp, Homo sapiens
  misc_feature: GYAE6OF01BZ9F4.33.63.F08.1.454.CMB.1.raw
tcagtacacacactcacgaccggtgctcgatttagcgatcgtataaggggcagaagtctctctcagtcaggacacagcatggacatgacgggtccctgctcagctccgtggacctcctgctgctctggcctcccagactaccagtatgtacgaccgtccagatcgaccagtcctccacttcctccctgtctgcatcgaggtgggaagacgagacgtaccaaccgtactaccgtaccgttccggaccggggtacggtagggtacccgggtaacttacgtttttaaccgttttaggttttttaccgggaccgtttaggtttacctaccgaacggtaccgaaagggtaacgggtaaacggggtaaacggggttaaccgtttaccccggttaagttaacccgtttcccgttaaggttaaacccgtttcggtttaaggtttcggggtaccttaaccgttaacccgtttaccccgtttaaccggttttacccgaaaccgttaaacccgggttacccgggttaacccgggggttacccctaaccgtttaccccggtttacccggttaccgtttacgggttaaaccgggtaccgggttaacgttaccggggtaggtttaacgggtttaacccgggaaattttaccggttacgtttacccacccggttttaccacccggttaacccgttccggaaaccccgtcggttaccccggtaccgtaccgggtaaagtaccgttaaacgggtttaaccgttttaacgtttaacccggtttaacccttaaaggtttttccgtaaaacgtttaccgggtaaaaagtttaaacccgggtttaagacggttaacccgtccgggttaacccggtcccttacccgttaccgggtttaccccggtttaccggaaaccccgggtttaacgaaaacccgggttaaagaacggtaaaaccgttaacccgaaaagttccggtcggttaaccgccgtaacccgtacgtttcgccgtttacccgg

SEQ ID NO: 41993 - DNA, 801 bp, Homo sapiens
  misc_feature: GYAE6OF01C0BMW.33.63.F08.1.454.CMB.1.raw
  modified_base (146)..(146): a, c, t, g, unknown or other
  misc_feature (146)..(146): n is a, c, g, or t
tcagtacacacactcacgaccggtgctcgatttagcgatcgtataaggggcagaagtctctctcagtcaggacacagcatggacatgagggtccctgctcagcctccgtgggactcctgctgctcgtggcctaccagactaccagntgtcgacgtccagatcgacccagtctccactcccgtccctgtctgcagtcgaggtggaagactaggtacgtacacctacgttcgtaccgttcgggcccgggacggtaggtaccggtacttaacttttaactttacggtttttccggaccgttaggttactaccgaagacggaaggaaggaacggggtaacgggtaaccttacgtacggaccttcgtataacgttacttaggtcgggtcactaaccgtttccgttaacgtttacgaaccgttaacgtacccgggtaccccgggttacccttattcccggttaccgttcgtttaccgaggttccggagtttaacgggtgggttaacgttaacggacttagtttacccgttactacccgttccgtacccgtacccgttacccgaaccctcgttacccgttcgggaccgtacgtacgttaagtaacgttttcccgttaacgtaacttttaaaccgtagtttaacgtacggttaaaaaccgtagttaaccgtacggtaaccgtcggtaaccgtccccggtactttaccgtacccggttacggacccgtaacggaaacgtttaaccggaacttaaacgtaaccgtaacgttaggacgtccttaacggcctttaaaacccgcctttaagtcg

SEQ ID NO: 41994 - DNA, 766 bp, Homo sapiens
  misc_feature: GYAE6OF01C33GH.33.63.F08.1.454.CMB.1.raw
  modified_base (162)..(162): a, c, t, g, unknown or other
  misc_feature (162)..(162): n is a, c, g, or t
  modified_base (208)..(208): a, c, t, g, unknown or other
  misc_feature (208)..(208): n is a, c, g, or t
  modified_base (751)..(751): a, c, t, g, unknown or other
  misc_feature (751)..(751): n is a, c, g, or t
tcagtacacacactcacgaccggtgctcgatttagcgatcgtataagggggcagaagtctctctcagtcaggacacagcatggacatggaggtccctgctcagctcctgggactcctgctgctctggcctcccagactaccagatggtcgaccgtaccagtntcgacccagtcctccactccctcccgtgtctgcagtcgaggtgganacgagactccacctatcgacgttcggccgggcgaggtcggactatttacgttagttttcgcctggtatcgagacaggaacggaagggtaacgggtacgtttccgtaacggtacccgttaccgtacgtacttaccgttagggtcgggtactacctactttacccgtacgttttacggaaccgttaaccgtccgggaaccgggttccctacgtttcccgtccggtacgtttacggaggttcggtacggttaagggtcgggtttaggttacgggaacgttagttaccttttacgacccgttcccgtacccgtaacccgttaccaccgtacgtccgtagtacgtacgtacgttaaagttctttacgactttaacgtttagttacctagtaactaagtactacggtacgtcggtccgtacccgttcttacccggttaccggttacccgggtacccggtaaagggtaaacccgtaaacggggttaaacgaaacttaaccggtaaacggttacggtaccggttacgtccggtaactaccgttaacccgtntttaccggttaaccg

SEQ ID NO: 41995 - DNA, 675 bp, Homo sapiens
  misc_feature: GYAE6OF01ENRLG.33.63.F08.1.454.CMB.1.raw
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (445)..(445): a, c, t, g, unknown or other
  misc_feature (445)..(445): n is a, c, g, or t
tcagtacacacactcacgaccggtgctcgatttagcgatcgtataagggggcagaagtctctctcagtcaggacacagcatggacatgagggtccctgctcagctcctgggctcctgctgctctggctccagactaccagatgtgacgtccagatcgacccagtctccatccctccctgtctgcagtcaggtgggagacgagcgtccaccagtccacgttcgggccgggcgaggtccgggaactattttacttaagtttttcggccgttggtatcagacagaggaagaaggggtacttcgtacgtactccgtagtctattcggtgtagctcgtccttagttcgataactcggtaacggggtcccacgttccncgttcgttacgnggtacgtgtaggtcgtaggtttcggataggtactttcgactccttacctccgactacccgngtccgtcgcggtaagtctaaggttaccgttagtttacaccgttaaacttttaccgtacttaaggttaactaaaaggttacttaggaaccgttacggtaccccgggtcctacgttttccccgtaacggttcccggtacccgggtaaccggtaaaccggtaaaggttaacgaaaagtaaacccgtaaacttacgggtaggttacgtacccggatacccgagttccttaaccg

SEQ ID NO: 41996 - DNA, 874 bp, Homo sapiens
  misc_feature: GYAE6OF01BNTC9.33.63.F08.1.454.CMB.1.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
tcagtacacacactcacgaccggtgctcgatttagcgatcgtataagggggcagaagtctctctcagtcaggacacagcagtggacagtggacgggtccctgctcagtctccgtgggacctcctgctgctctcggcctccagtactaccgagtagtcggtcgaccgtccagtactcgacccgtgtcctccacttccctaccgtntctagctagtacggtaggtcgggaanacacgtactaccacctacgtacgtacggtccgggccggggtacgtcgggtaccggttaacttaacgttttaacgttttacggttttcggaccggtttagtactaccggaagacgaagggtaaacgggtaagggtaacggggttacttcccggtataccggtacgttacgattacggttagtcggtactacctacttaccccgttagttaccgacgtaagttcccgggtacggtccctacgttcgtccgtactcggaggttggaccgtagggttcggttagttacggtaattcccgtttagtccctcgttacctcgggtaaccctaccgtacgtcgtaccgtacggtacggtacgttagttaaggttaacgttttaccttaaggttacctttaacggttttaacgtaatttaacggtaaaccgttaaaggtttacccggaaggttaacccggtacgggtttaaccccggttaccccgtacccgttaccggggtttacccgttacccccggggttaaaccgggtaacgggtaaaccgggtaaaaccggttaaccggtaaaacgttaaacccggtaaccgggtacggttacccgggtaccggttaacggttaccccggtacccgttaaacggtcctttaaacccggg

SEQ ID NO: 41997 - DNA, 470 bp, Homo sapiens
  misc_feature: GYAE6OF02J00WW.33.63.F08.1.454.CMB.1.raw
  modified_base (387)..(387): a, c, t, g, unknown or other
  misc_feature (387)..(387): n is a, c, g, or t
  modified_base (423)..(423): a, c, t, g, unknown or other
  misc_feature (423)..(423): n is a, c, g, or t
  modified_base (467)..(467): a, c, t, g, unknown or other
  misc_feature (467)..(467): n is a, c, g, or t
tcagtacacacactcacgaccggtgctcgatttagcgatcgtataaggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctcgcttcagtggcagtggatttgggacagatttcactctcaccgtcaccagcctgcagctaaagntttgcaacttatactgtacaaagtatgacagtgccntcactttcgcctggacaagtgaatcaacgactgtgctgcacatntcg

SEQ ID NO: 41998 - DNA, 493 bp, Homo sapiens
  misc_feature: GYAE6OF02HGAIP.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaattttttggcctggtatcatcagagagaaggggaagttcctagactcctgatctatggtgcatccactttgcaatcaggggtcccatctcgcttcagtggcagtggatttgggacagatttcactctcaccgtcaccagcctgcaggctgaagattttgctaacttattactgtacaaagtatagacagtggcccgctcactttcggccctgggaccaaggtcggaaatacgaaacgactggtcggctgcaccatcg

SEQ ID NO: 41999 - DNA, 477 bp, Homo sapiens
  misc_feature: GYAE6OF02H3AZO.33.63.F08.1.454.CMB.1.raw
  modified_base (423)..(423): a, c, t, g, unknown or other
  misc_feature (423)..(423): n is a, c, g, or t
tcagtacacacactcacgaccggtgctcgatttagcgatcgtataaggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctgcttcagtggcagtgatttgggacagatttcactctcacgtcaccagcctgcagctaaagattttgcaacttatactgtcaaaagtatgacagtgcccgntcactttcggcctgggaccaaagtggaaatcaaacgatgtgctgcaccatctcg

SEQ ID NO: 42000 - DNA, 492 bp, Homo sapiens
  misc_feature: GYAE6OF02GYVH5.33.63.F08.1.454.CMB.1.raw
  modified_base (489)..(489): a, c, t, g, unknown or other
  misc_feature (489)..(489): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctcgcttcagtggcagtgatttgggacagatttcactctcaccgtcaccagcctgcagctaaagtattttgctaacttattactgtactaaaagtatagactagtcggccgctcacgtttcgccctggaccaagtggaatcgaaacgacgtgtacgctgccactatntcg

SEQ ID NO: 42001 - DNA, 499 bp, Homo sapiens
  misc_feature: GYAE6OF02GGXYO.33.63.F08.1.454.CMB.1.raw
  modified_base (194)..(194): a, c, t, g, unknown or other
  misc_feature (194)..(194): n is a, c, g, or t
  modified_base (467)..(467): a, c, t, g, unknown or other
  misc_feature (467)..(467): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttacaatttttggcctggtatcagcagagagaagggaagtcctagactcctgatctatggtgcatcctactttgctaatcaggggtcccatctcgtcttcagtggcagtgattgggactagtatttcactctcacatcagctagtctgacaacgtgaagtattttgactaacttactactgtacaacgagtagtccaacaaccaccctaattccactttccgaccctcggaccacngtcgatcgtacaacgacgtgtcggtactgacc

SEQ ID NO: 42002 - DNA, 587 bp, Homo sapiens
  misc_feature: GYAE6OF02HADY3.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaattcctagactcctgatctatggtgcatccactttgcaatcgacgggtcccatctcgtcttcgagtggctagtggatcgtggacagtactttcactctacacctaataacgctagttctaggaacctagtaaagttagtttaggaagttacttacttcgtagtacaaacgtacgtaacttaagtaaccgttaaacccgttacttaacgttttacgggacccgtaacggggtacctaacggtacgtagggtaacgtaacgtaaccgtaacggtaccgtaacggttcggtacggtaccgttacggaccgtaccgttaacg

SEQ ID NO: 42003 - DNA, 520 bp, Homo sapiens
  misc_feature: GYAE6OF02GOLWO.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcgaggggtcccatctcgcttcagtggcagtggatttgggacagtatttcactctcaccgtcaccagcctgcacggctagaagtattttgctaacttattactgtacaaagtatgactagtcgcccgtctcctactttccggcccgtgggaacctaaaggtacggaaactacgaaacgtaacgtaggtcggtactaggcctacctattccg

SEQ ID NO: 42004 - DNA, 526 bp, Homo sapiens
  misc_feature: GYAE6OF02GXGIS.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagggtcaccatcacttgccggcaagtcagagcataagcaactatttaattggtatacaacagaaaccaggaacgacccctaaggtcctgatctatgctgcgtcagttgcagagcgggtcccagtcgagtcagtggcgagtggagtcgtgggacagtattacacctctcctaccatcagcagttcctgacaacgttgaagttatttcgactaacttactctacgttacaacagataccaaccaaccaccccattccctaccttccggacccctgggaccctacgacgtggtacgtacgtaccctaaccgacctggtacgtccgtgtacccg

SEQ ID NO: 42005 - DNA, 501 bp, Homo sapiens
  misc_feature: GYAE6OF02HXCND.33.63.F08.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (392)..(392): a, c, t, g, unknown or other
  misc_feature (392)..(392): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcggganatttacaatttttggcctggtatcagcagagagaaggggaattcctagactcctgatctatggtgcatccactttgcaatcgagggtcccatctcgcttcagtggcagtggatttgggactagtatttcactctcaccgtcaccagcctgccaggctgaagtnttttgactaacttatactgtacaaagttnagacagtgccctntctactttcgacccgtggaccaaaggtcggaaatccgaaacgactggtagcgttagactcctatccg

SEQ ID NO: 42006 - DNA, 552 bp, Homo sapiens
  misc_feature: GYAE6OF02G6A0T.33.63.F08.1.454.CMB.1.raw
  modified_base (426)..(426): a, c, t, g, unknown or other
  misc_feature (426)..(426): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaagggaagttcctagactcctgatctatgtgctatccatttgcaatcaggggtcccagtctcgcttcgagtggctagtgtatttgggacagatttcactctcaccgtcaccagcctgcaggctagaacgtattttgactaatttattactagtactaaaagttntagactagtcggtacccgcttacactttccgggacccttaggggaaccctaaaacggttacgggtaaaactacgtaaaaccggtaacgttacggtacggacgttacggacctacccgtaattccgg

SEQ ID NO: 42007 - DNA, 493 bp, Homo sapiens
  misc_feature: GYAE6OF02HHT55.33.63.F08.1.454.CMB.1.raw
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaagggaagttcctagactcctgatctatggtgcatccactttgcaatcaggggtcccatctcgcttcagtggcagtggtatttgggacagtatttcactctcaccgtcaccagcctgcaggttaaagnttttagactaactttattactgtactaaaagtntagacagtggcccntcactttcgcctggaccaagtggaaatcaaacgactgtgctgcctacatctgttcc

SEQ ID NO: 42008 - DNA, 499 bp, Homo sapiens
  misc_feature: GYAE6OF02HQZQU.33.63.F08.1.454.CMB.1.raw
  modified_base (408)..(408): a, c, t, g, unknown or other
  misc_feature (408)..(408): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctcgcttcagtgcagtgattgggacagacttcactctcacatcagcagcctagagcctagaagattttgactagtttatacttgtntgcagcgttagctaactggacctaacgtaccttacggaccgaagggaccacggactaggaagtaagttaaacgacttaggtaggactgacc

SEQ ID NO: 42009 - DNA, 536 bp, Homo sapiens
  misc_feature: GYAE6OF02FLLYT.33.63.F08.1.454.CMB.1.raw
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccacgtctccatcctccctcgtctgcatcagtgggagacagagtcaccatcacttgccgggcgagtcgggacgatttacaatttttggtcctggtatcagcagagagaggggaagttcctagactcctgatctatggtgcatccactttgcaatcaggggtcccatctcgcttcagtggcagtggtatttgggacagatttcactctcaccgtcaccagcctgcaggcttaggaanattttgcaactttattacctgttacaaaagttntcgtaacagttcgggcccctcttctaccttttccgggcccctaggggaccctaaaaggtcggaaaatcccgaaaacgacgttgtagggccttaggcaaccctattccg

SEQ ID NO: 42010 - DNA, 535 bp, Homo sapiens
  misc_feature: GYAE6OF02IZ1JM.33.63.F08.1.454.CMB.1.raw
  modified_base (194)..(194): a, c, t, g, unknown or other
  misc_feature (194)..(194): n is a, c, g, or t
  modified_base (338)..(338): a, c, t, g, unknown or other
  misc_feature (338)..(338): n is a, c, g, or t
  modified_base (393)..(393): a, c, t, g, unknown or other
  misc_feature (393)..(393): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttactaatttttggcctggtatcagcagagagaaggggaagttcctagactcctgatctatggtgcatccatttgactaatcgaggggtccatctcgcttcagtggnagtggtattgggacaggtattcactctcaccgtccacagcctgcaggctgaagtntttgactaatttattactgtacaaagtgtagacagtcgcccgtacgtcctaccgtttccggcccgtagggtaacccgtaaaggtacggtaaactaccgtaaacgacgttacggtacggtacctacggacctaccgattaccg

SEQ ID NO: 42011 - DNA, 535 bp, Homo sapiens
  misc_feature: GYAE6OF02GIUJO.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttacaatttttggcctggtatcagcagagagaaggggaagttcctagactcctgatctatggtgcatccactttgcaatcaggggtcccatctcgcttcagtggcagtggatttgggactagtatttcacttctcaccgtcaccagcctgcacggctagaagtattttgactaactttactactacgtactaaaagtatgaactaggtcggcccgtctacctacgtttccggccctagggaacctaaaggtacggtaaactaccgaaacgtaacttggtacggtcgtacggctacctattaccg

SEQ ID NO: 42012 - DNA, 542 bp, Homo sapiens
  misc_feature: GYAE6OF02G7ET5.33.63.F08.1.454.CMB.1.raw
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcgaggggtcccatctcgcttcagtggctagtggtagtttgggactagtatttcactctcaccgtcaccagcctgcgaggctagaagtatttcgactaacttattacgtgttacaaagttntagacgtacgtacggcccgtntccgtacgtttccggacccgttacgggaaccctaaagggtacgaaacgtacgaaacgtacgtcggtacggccgtaggacctacctattccg

SEQ ID NO: 42013 - DNA, 487 bp, Homo sapiens
  misc_feature: GYAE6OF02GUW9I.33.63.F08.1.454.CMB.1.raw
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
tcagtacacacactcacgaccggtgctcgatttagcgatcgtataagggggcagaagtctctctcagtcaggacacagcatggacatgagggtccctgctcagctcctgggactcctgatgctctggctcccagataccagatgtgacgtccagatgacccagtctccatcctccctgtctgcatcagtgggagacagagtcaccatcacttgccgggcgagtcgggacatttacaattttttggcctggtatcagcagagagaaggggaagttcctagactcctgatctatggtgcatccactttgcaatcaggggtcccatctcgcttcagtggcagtggatttgggactagatttcactctcaccgtcaccagcctgcaggctgaagattttgctaacttattactgtacaaaagttntagacagtgcccgntcacttcggccctgggaccaaagtggaatcgaaacgatgtggctgcacatcg

SEQ ID NO: 42014 - DNA, 576 bp, Homo sapiens
  misc_feature: GYAE6OF02FNLY9.33.63.F08.1.454.CMB.1.raw
  modified_base (194)..(194): a, c, t, g, unknown or other
  misc_feature (194)..(194): n is a, c, g, or t
  modified_base (424)..(424): a, c, t, g, unknown or other
  misc_feature (424)..(424): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttacaatttttggcctggtatcagcagagagaagggaagttcctagactcctgatctatggtgcatccactttgcaatcaggggtcccatctcgcttcagtggcagtggatttgggacagatttcactctcacgtcaccagcctgcaggctgaacgattttgactaactttattactagttacaaaacggttnttacgaactacggttacggtccccgtactacctaaccgttttccggtaccccgtaggggtaacccgtaaaaggttacggtaaaacttaaccgaaaaccggtaaaccgttacggttacgggtaccttacgggaccctaacccgtagttacccg

SEQ ID NO: 42015 - DNA, 592 bp, Homo sapiens
  misc_feature: GYAE6OF02IJZS6.33.63.F08.1.454.CMB.1.raw
  modified_base (193)..(193): a, c, t, g, unknown or other
  misc_feature (193)..(193): n is a, c, g, or t
  modified_base (410)..(410): a, c, t, g, unknown or other
  misc_feature (410)..(410): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctcctgtctgcatcagtggganacagatcaccatcactgccgggcagtcggacatttacattttgctggtatcagcagagagaaggagttcagactctagatctatggtgctatcctactttcgctaaagtcgaggggtccctatccgtcgtcttcgagtcggcgtagtgtagtttggactagtactttcgactctacgtaccgtctaccgacgtcctggactaggctaggtaaacgtnttttacgacctaaacgtttataacgttacgaacttaaaagtatagtaacgtaggttcggacccgtacttacgtaccgtttaccggacccgttagggtaacccgtaaaaggttacggtaaactaacccgtaaaacgtaacgttacgttacgggaccttaacggaccgtacctagtttacccgg

SEQ ID NO: 42016 - DNA, 490 bp, Homo sapiens
  misc_feature: GYAE6OF02FMVTQ.33.63.F08.1.454.CMB.1.raw
  modified_base (279)..(279): a, c, t, g, unknown or other
  misc_feature (279)..(279): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (471)..(471): a, c, t, g, unknown or other
  misc_feature (471)..(471): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcggacatttacaatttttggcctggtatcagcagagagaagggagtcctagactcngatctatgtgcatccatttgcaatcaggggtcccatctcgcttcagtggcagtgatttgggactagatttcgactctcaccgtcaccngctgcaggctaaagtntttgactattatactgtacaaagtntagactaggtgcccgctctactttcggcccttaggacctaagtggaaactacgaaacgtatgnggtactgccgacatctacg

SEQ ID NO: 42017 - DNA, 504 bp, Homo sapiens
  misc_feature: GYAE6OF02I4RFS.33.63.F08.1.454.CMB.1.raw
  modified_base (366)..(366): a, c, t, g, unknown or other
  misc_feature (366)..(366): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgaggtcgggacatttactaatttttggccttggtatcagcagagaggaaggggaagttcctagactctgatctatggtgctatccactttgactaacgtcgtacggggtcccatccgtcgtcttcagtggcaggtgtagtttggganagtacttcgactctcaccgtcaccagcctgcaggctagaagtntttgactaacttatactgtacaaagtnagacagtcgccncttcgacttccgccgtggacgaaggtacgaatacgaacgacgtgcggcngcacntc

SEQ ID NO: 42018 - DNA, 650 bp, Homo sapiens
  misc_feature: GYAE6OF02IN94B.33.63.F08.1.454.CMB.1.raw
  modified_base (194)..(194): a, c, t, g, unknown or other
  misc_feature (194)..(194): n is a, c, g, or t
  modified_base (513)..(513): a, c, t, g, unknown or other
  misc_feature (513)..(513): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgcccgggcgagtcgggactatttactaatttttcggcctggtatcagcagagaggaaggggtaacttccgtagtactcctgattcgtatggtcgactactcctactttgactaagtcgacggggtcccagtcctacgtccttacgaggtcggacgtaggttggtacgttttggggaactagtagtttccaacgttcctaccgaccgttaccacccgtacggtccctgaccgtacggtcctaggtaaactttacgttttacgaccttaaactttacgtttaactacgttaactaaaacgttntacggtaactacggtccggtacccgtccttaccgtacccgtttaccgggaccccgtaaggggtaaaccctaagggttaacgaaaccttaacccgaaaggtaccgtaggtacggtactacgacctacgtacttaccgg

SEQ ID NO: 42019 - DNA, 542 bp, Homo sapiens
  misc_feature: GYAE6OF02F1ZG6.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctcgcttcagtggcagtggatttgggacagatttcactctcaccgtcaccagcctgcaggctgaagtattttgactaactttattactagttacaaaagttatagacagttcgcccgtctccgtaccgtttccggccccttaggggaaccctaaaggttacggaaaacttaccgaaaaccgtaaccgttaggtacggccttaggaccctacccattaccg

SEQ ID NO: 42020 - DNA, 610 bp, Homo sapiens
  misc_feature: GYAE6OF02INSFL.33.63.F08.1.454.CMB.1.raw
  modified_base (193)..(193): a, c, t, g, unknown or other
  misc_feature (193)..(193): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgganacagagtcacatcacttgccggcgagtcggactatttactaatttttggccttggtatcagcagagagaagggaattctagactcctgatctatggtgcatcctactttgactaatcgacgggtcccatcctcgtcttcgagtcgcagtggtagtttagggactagtactttcacttctacctaccgttcaaccgacgtcctggacgacggtacttaggtaaagttagttttacgaccttaaactttacttaacttagttaactaaaagttagtacgtaactaggtaccggtcccgtacttaccgtaccgtttccggaccccgttaagggtaaccccgtaaaaggttaacggtaaaccgtaaccgtaaaccggtaacgttacggtacgggtaccttacggacctacccgtacttacg

SEQ ID NO: 42021 - DNA, 497 bp, Homo sapiens
  misc_feature: GYAE6OF02GXPKJ.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggacatttacaatttttggcctggtatcagcagagagaagggaagttcctagactcctgatctatgtgcatcactttgcaatcaggggtcccatctcgcttcagtggcagtgtatttgggacagtatttcactctcaccgtcaccagcctgcaggctgaagattttgactaaactttagttactagtacaaaaagtatagactagtgtcccgctcactttcggccctagggaccaaaagtggaaatcaaaacgaatgtgctgacaccgatcg

SEQ ID NO: 42022 - DNA, 523 bp, Homo sapiens
  misc_feature: GYAE6OF02FME24.33.63.F08.1.454.CMB.1.raw
  modified_base (195)..(195): a, c, t, g, unknown or other
  misc_feature (195)..(195): n is a, c, g, or t
  modified_base (396)..(396): a, c, t, g, unknown or other
  misc_feature (396)..(396): n is a, c, g, or t
  modified_base (425)..(425): a, c, t, g, unknown or other
  misc_feature (425)..(425): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatccctccctgtctgcatcagtggganacagagtcaccatcacttgccgggcgagtcgggacatttacaattttttggcctggtatcagcagagagaaggggagttcctagactcctgatctatggtgcatccactttgcaatcaggggtcccatctcgcttcagtggcagtggattttgggactaggtatttcacttctcaccgtcaccagcctgcaggctgaagtnttttgctaacttattactgtacaaagttntagactagtcgccctctccgtacgtttccggcccgtagggaccctaaaggtggaaaactcgaaacgtaactggtacggctacggactacctattaccg

SEQ ID NO: 42023 - DNA, 646 bp, Homo sapiens
  misc_feature: GYAE6OF02IYK4Q.33.63.F08.1.454.CMB.1.raw
  modified_base (219)..(219): a, c, t, g, unknown or other
  misc_feature (219)..(219): n is a, c, g, or t
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatccctcctgtctgcatcagtgggagacagagtcacatcacttggccgggngaggtcgggactatttactaatttttggccttggtatcagcagagaggaagggaagttctagactcctgatctatggtncatcctatttgactaatcgtacgggtcccatctcgtcttcgagtcggctaggtgtagtttgggacagttnttcactctccaccgtacaccagtcctgcgagcgtagtaacttatttacgacttaaatttacttacgttacgttaaacgtaaagttaacgtagtaacgtacgggttaccgaccccggtaccttaccgttaccgttttacccggggtaccccgtttaacgggtaaacccggtaaaacgggttaaccgggtaaaacgttaaacccggtaaaaacccggtaaccggtttacggtaccgggtaacccgtttacggaacccgtaacccggttaactttacccgg
